United States Patent 10,279,031 (COMPOSITION COMPRISING ANTIGENS AND A MUCOSAL ADJUVANT AND A METHOD FOR USING) - sequence listing, part 6

SEQ ID NO: 6 - DNA, 2265927 bp, Haemophilus parasuis
tttttaggtttttggcaaattccgctgccaaggcgtgaagttgtttttcgttcataataaaatacctgtgtctgaatgtattatctcagaaacaggtatttacacaaattgtgggagaggctccaaatcgacggcagcaattattttttcatctacttcagaccattttttctttaacgacttcccattccatttcattgaaattcaaaaagtatcgccatcaattctagtctgaatttctgttagataaagtgtatttgtgagaggtatagcttgtttaagtagcttgcctcccccaatagtcatgatttcattgctactataaaagcctattcccattgttgccgtgcaagcgaacatcagaaagcccattatttggtaacgctgttcatcactagacttggactataaagagaaaataacagcgcatataatgtatttccttcataataaaaagaaatgcgcctactaacgactacttaaacagtcatagatagacgcataattaaactataataacgacggcgctgcatctaatagaattttggtgtactcttcttttggtgtgtcgaatacatcggcggcattaccttgctcaacaattaatccaccattcattaccacaattctatctgaaacttggcggacggtttgtaaatcgtgagagataaacaccatcgcaagatttaactcttttttcagatcggctaacaggtttagtacctgcgcacgaacggatacgtcaagtgctgaggttggttcgtctgcaacaatcagttttggatttaacgctaacgcacgagcaatcgctacacgttgtttttgtccaccagataaacgagttggctcaacaagtgcggcggaacgtggtaaaccaacacgagaaagtaagtcgtaaacacgtttttcacgttcgtgcggttgcagtacgttgtgaatatccatcgggtctttcaaaatatccaatactcgcatacgagggtttaacgctgttgccgggtcttggaagatcaccgatacttgacggccaaactgtttacgggcttctgcactgccgtatttcatttgtaagccgttgaatttggctgtgcctgatgtcggtttttgtaagccgataatcacgtttgctagggtagattttccgcaaccagattgtcctactaaaccgaccgtttcacctgcattgacttctaagctcacaccgcctacggctgtgaattttttcgggttaaacagcgtgccatcacgagatgggaaccgtacaacaatgttctctaattcaatgataggctgttcttttaatggtttcatactcattgtttatccctccaaatgtgaagcccaaaggtgtttcggattgtcgcttgctggtacaagtttcaagcgttgatttggatttgcatctggacgtaatgaacggcttgcaaagcggtcgcctttcgcaaaatcaaacggtgatggaacactgcccgggatttgatataaacgctctgcacgacattctgttgagagtacagaaccgagcaagcctcgtgtatattcgtgtgttgggttagacaataacgctgaagtcggtgccatttccactacttgtcctgcgtacattacgatgatgtggtgtgccatttgtgcgactaatgcaaggtcgtggctcacgaacaccattgcaaagccaagtttttcacgcaattcgttgagtaatttaattacttcggcttgaacggttacgtcaagggctgtggttggttcatcagcgataagtaattttggttcacgtgctaatgccattgcgatcaatacacgctgacgctgaccacccgataattcgtgtgggtagcggtttaaggttttctccggatcgagttttacccattttaatagggtttcagcagattgtttaccaccacggctgataagctgtgccatttggtctttaatacgcattgatgggtttaatgcacttaaggcatcttggtagatcatagagatctcgtgtccacgtaattcgttgagcttatcggtttttaagagatcgtgttggttgcctgcacggtcggtaaagagaatttccccagtgattttggctgtcggtggtaataagcccataattgagaaggcagagatagatttaccacagccagactcgcccactaatcccattgtttcgccttcattaacggtaaagctgatattatcgacaagcggaatatcgccataacgatttgggaaacggattgagaggtttttcacctgtaaaatcggttttgcatttgggtttaattgcatacggtctgtgcgagttgcttctttctcgtgcaatttgagtaagtagcgttttaatgcaagactttctgccattgcttcttgtacatctgttgaaagcggttttgatacgtcttcttttgatgtggttgggctacgtttcaattttggattgactaacgcgtcagttaaaccttctgagagaatgttgagcgagagtactgttaggagaatagccaaaccggcaaaggttgttgcccaccagaaaccacttaatacgatgttacgtccttctgacaggatatttccccaagatggttgtggaagttgtacacctgcacctaagaaagagagagaagcctcaagtacaatcgcatcagctaccattacggttgcaaagactaatacaggtgcggctgagttgcgaacaacgtgtttgactaagatgtgggtacggctaccaccgataacacgttctgcacgaacataatcttcttcccattgagaaaccacgttagcacgcaccacacgagcaagttgtggggtgtaaacaatcgcaatggctaagatgataatcggcactgcgttacctaaggttgcaagcaatactgcggcaagtgcaatacctgggaatgccattaagatgtccataaaacgcataatgacttcgttaccaagtttgtctgcggtagcggctgttgcccctaagatacttcctagaacaatggcaagtcctactgcaccaagtccgataaagagtgatgtttgagcaccgtaaattaagcgagataaaatatcacgtccaagacggtctgtcccaaaccagtaatctgcatttggtgcttgaaccgggcgaagggtttgcaatgggtcgtatggtgatacccacggtgctaaaatagccagtaatgctacaagcacaataaatcctaatgcgagtttagaggcggttgataatgctttaaatcttgccccgcctgaagcaagtctatcagctaatccttggcgaaacattataaactccgaatttttggattaatcagtaagtaaagaatatctacaatgatattcaccaagacgaaagtaaaggcgatggtcaatacgaccccttgtacgaggtgtaagtcgtggtttacgataccgttaaaaatcaatttacccattcccggtaagtcgaagatttgttcgataaccactgcaccacccagtagatagccgacacgcaagcctaaaacagtaacaggggtaattaaggcattacgcaatacgttatgacgaataaccgttgcataaggtacgccattaccaattgctgtacgcacataatctttgtccatttcttctaccattgtggtacgcaccacacgaattaatgacgcacatacagggattgccaatgctaatgctggtaatgccattgaacggaaatattctgttggatcttcactaaatgacacaaacccacctgatggaagccagtctaattcaagagagaagtattgaattaataagatacctaaccagaatgatggggttgccactgccgctactgagagtaggcggataacttggtctgcccaacggtcacggtagagtgccgcaataatccctaaagagaatgatacgattgctgctaaaaagaccccaatgaaagtaagttgtaatgtaagtgggaaggcttttgcaatcaatgaggtgattggctgttccggcggtgtggttagaccgaagtcaagtaccaaaacgttaccaatgaaacgaaagtattggacgataacaggatcgttcaatccgtgttgttcacgatacaattctttcgcagcatcacttgcactttcacccaatgcaacagaagctggatctccaggtgtgaactgtagaatgataaaaactaatgcacttacgccaagcatcatcagtggtaatgccattaatcggcgtagtaacagacgaagtacgatttctattttttttctccgactacaagaaaggttagtgggataggtttatataatttttataagaaaagcggtgagattaccgaaaaggtttacaacttttacaacaatcttatcgcttgaaagaaaccttaagtaagacgctactttaaacgccttcacccgaaggtgaaggcactatgattatttacggcttacaccaatgaatgacatacctgtggttgataatggtttaaagccatctaatgctttgttactccaagctgttggaagtttacggtgaataattggataaagtgctgcttcttcagcaatgatgttaatcgctttaccccaaatttcacgtgcttctgccggagttttcgcagccaccgcagcgtcaagaagtttttgaacttccgcatattcaggtgtatttgaccagcggaaacgttttttcggccatacatcaccacggtaccaccagcttaataataagtctaagtcgttaccgaatactgatgggtcacctggtgcgattaatacttcaaagttacctgcatcaacaccgtcattgtatggtgattgtgaagcgatgtttgtcacttttacaccagggatcttgttccagtcttcaatgatcatttgaacagagtccactacccatttatgtgcggttgaacgtgttgtaaactcaagtttatctacacccgcttctttcaacaatgcagccgcttttttcggatcgaaatcatagactgttgaggctttcacatagtctgggtgagagtcttgaacataagatgttgcaggttttgcgttgcctaagaacaccacatcaactaatttttgtgtatcaattgcatattgtaatgcttgacgtactttcttgttgttaaacggtgctttttcacagttaaacattaagaaaattaagccgaatgattgcactgattctacagctgctttacgttttaagcgatccgcatctaagtaaggtacgttttcaatcgcttgtacacgacctgactcttgtgctgcaacacgtgctgcgtcatcagagagtaagaaccatgtcattttttcaacagttgcaggatatggacctgtgtaagcagggtttgcttcaaatacgatacggtcatctttgactgctgaaacaaatttatatggaccagtaccaacagggtttgcatcaaagactgattgaccttgagcttcaattaatgcttttggtacgattttgataatggttaaacgttctttgaataatgcaaatggatatttcaatttaaattcaactgttttttgatccactgcagtgactgatttaatgaatgggatgaattgtgcaaagagtgattttgtatttggatctaatacacgctcaaatgaaaacacaacatcagcactggttactgctgaaccgttatggaataccgcaccgtcacgtaaagtgatgcgataagttacatcgtcaactttttctggttctttcgctgcaagtgctagatatggctggcgagttgctgggtgtaaatcaactaaaccttcaaaaatgtggatattagccgccattgaagatgcaccagttgaactcattgggtcaaaacccgttgaaatcggataagcaatacctgcttcgatagttgaaccttttgctggtgcagcataagcctgagaagcaaaagtaccgattgaacctgagaatgctaaaccagcaccaacacctgcaactaatttcataaagccacggcgagattcattgtgttcaaaatgtttagtcacattagactccttgatagtatcgtttttgtaaaatggttatgtgcagtacaacacacattaaacaaccaaaaagtttcgtatttacttctcattttcaagtgaattaatcaaaatgaaaggtaaaaaatgaattgaaaacattataacactaatcaaggcgatgtcaatatattgtcaagacgagtatttacatttgtgatctacttcacgaaatcagaaaataatctagctttagctaggcggataaccgacatcttctaaagtaggattatttgcaccttcttttgctaattgatcacaaatttcattttctgtatgtccagaatgacctttaacccattgccattcaacctgatggcgtgttatggctttatccagagctatccacaaatcctgatttttaactggcgtattattactggttttccagttatttttcttccaattaaaaatccatttttgaataccattttgcatatattggctatcgctatgcaaatgtacattacaaggctccttcaaggcatttagagcggtgatcacggcaagaagttccatacgattatttgtcgtcaagtagtaaccctgacttatccgtttttctttgccttgataacgcaataaaatacctatgccacccttacccggatttcccaagcaagaaccgtcagtgaaaatatcgacaagtttcattggggttatagtacgatagttttattttgataaacaaaaacacgatcagcaagcaccaattctaatgctctgctcaataccgttttttctacatctcgtcctgctcgcatcatcgcatctgccgtataagtatgatccacattaatcacattttgcataataatcgggccttcatctaactcgttattaataaaatgtgccgttgccccaataattttaacaccacgctgataggcttgctgataaggcttcgcaccgataaatgcaggtaaaaatgaatggtgaatgttaatcacacgatttgggtatttcgccacaaactcagggtttaacacacgcatatattttgccaacacaatataatcaggggcatattcatcaattttatccgccaataatttatcgtgttctacacgagttaaaccttcgtggcttactaaatggaaaggcacatcaaaacgttccgctaaacttcttaatgtatcgtgattaccaatcacagctgcaatttcaacattcaaaccaccataataggtcttcattaaaatatcacctaaacagtgtgcttctttagtgactaaaatgacaatacgtttacgttgttgcggaacaagtttataaatagatccttttggcaaggtaaattctaaatcggctaatagggtctgatcgttgaaaataccttgtaattcagtacgcataaaaaagtggcgagtatcactttcaacaaactcactatttttaataatgtttaattgatgtttataacaaatattcgtgattttagcgacaagccccgtatcatcaggacattccgttaataaaattttattttcaatcattttgttttctctatttattagaaaaatagctaattcatatcaatcataaaaaaagaaaacccacatcttgtgggcttctctgtattcatatcaaattagattgcaaaatctgctaatgatttacccgcttctaatgcttgttgaatttcacgaggggttctgccttgacctgtccaagttttttcattaccgtttgcatcaatgaatttatattttgctggacgaggatcacgttttttacgttctactttggttgtgccggctaataataacgcaagttcttctgctgaaataccatcttgagcaagtaactctttgtatttatttaggctttctaaacgttttgctttttcttcttgttgagctttaacttcttcacgtttttcttcaataacaatagcaaatttttccgcaatcgcttctaattgttctagtgataattcacgagcaattacacgtaaactacgaatatttgataatgtttttaataaatcagtcatgtttttctcctaaatgtaaatagaacatattaatttagactctttttatattatcgcaataattatttcaggtaaatatacaaaaataaaattcttattatattttcttaataatttaagggatgagaatggctctttcatattaatttatcaaaatctatatcctccctattggcaacagacatttcttcaggtaagctattggtgtcctacaaattgtagaggtgcgaatgcgataagtattctttcagagtggaaaacgatgaagaaagaggaaaggcgtattcgccgaaatcaattaagcgtcatcttaattggttggtatcgttatcgaaaggaacgatactgtcatagcggaggctatggagtgctactgttaggctgggtttattctgtttttcttttgttcccttccctaaataccttgcttcatcaaaagtaagtttattccagtagatctctttctttgtttgacgtgttattttattaaaaacaatcttagaggttttatgaatctagttgattattcaagttcattgtggtctgtagtgcctgcattattagcattggtacttgccattattactcgtcgagtattactctcattgagtatcgggattattgtcggtgcgttaatgcttaccagtggcaacccgattgatgcctttttacatttgaagaaaaatatcacttcgttaatttatggcgaagaaggattaaattcaaataacgtacacatcattcttttcttacttttattaggggtactcaccgccttattaagcatttcaggcagtaaccaagcctttgtaaattgggcccaaaaacgtattcaaggaaaacgtggtgcaaaattaatggcggcggcgttagtgttcgttacctttatcgacgattatttccacagccttactgtaggtgcaattgcacgtccagtaacagacaaattcaaagtttctcgtgccaaattagcttatattcttgactcaacagcagcgccaatgtgtgtgttaatgccaatttcaagctggggtgcttacatcatcactttaattgcaggtctattaaccacttacggcattacaaactacactccattgggggcatttatggcaatgagtgcgatgaacttctacgctattttctcaatgattttagtctttgtagctgcttatttctcaatcaacttaggctcaatggctcgttttgaacaacaagctgagcaaactgcagatgttgaagagcaacaaattgtcgaagcaagtggtagtgtgatgaacttaattttaccaatcatcaccttaattttggcaacccttgcaatgatgatgtacacgggtgaccaagctctagcagaaagtggcaaaccatttgatgtattaggcgcatttgaaaatactactgtaggtatttcattggttgtaggaagtttgagtgcattagctgtagcgactttaatgattgcaataggacgtaaagtaacaatgagtgattactggaagtcgtacggtatcggtgcaaaatctatgatgggtgcaatcaccattttattctttgcttggacaattaacggcatcgtaagcgatatgcaaacaggtaagtatttatcaacccttgttgctggcaacattaaccctgcatttttacctgcaatcctctttacattaggagcagcaatggcattctcaacaggtacaagttggggaacattcggtattatgttaccaattgctgcagctatggctgccaacgcagaacccgcattattattaccttgcttatctgcggtaatggcaggtgcagtatgtggtgaccactgctcaccgatttcggacaccaccattttgtcttcaacaggtgcacagtgtaaccatatggatcacgttacttcgcagttaccttatacgcttgtcgttgcggtggcttcagcagtgggttatttagtgattggttttactacctctgcattcctcagctttgcagtaacagcagcggtattagttactcttgttatcctattcaagcgtaaaaaatagtgatatcagctcttatagtaagatatgagtaaaacaaagcgaatcctcgtaattcgctttgtttatttatagcaaccggttaaaatagctcgattttttacattttatggatagattatgcttcccgaactgggttatttctgtttagtcttattagctggtatttcagggttacaggttttatgttccttatggggagaaattcgccatcaacccttttggttgagtggaaatcgcctatttagtttaattcaagccttattagccttagcatgttttggctgtttagcctacgcttttatctatgatgatttcagcgttgcctatgtcgctgctcattctaatagtcaactaccctcattcttcaaatttgcagccacttggggaggacacgaagggtcaatgctgttttggctaacggcattggcattatggacaggcatattttgcattttttcaggcaaaatcgaccgcttgtttacttaccgcaccctagcctctctcgccttaattattttaggctttgctttgtttattctcttggtctctaatccatttgagcgtagttttcccccttccccagaggggcgagatcttaatcctatgttgcaagatgtcggattaatttttcacccaccactgctttatttaggctatgtaggctttgctgtcacatttgcaatgacaatggcaatgttgcttggtggcgtgtttgattatgctattgctcgttggatccgcccttggacaatggtcgcttggggatttctaaccgcaggcataatattaggtgcttggtgggcttattatgaacttggctgggggggctggtggttttgggaccctgttgaaaatgtctctttaatgccgtggttacttggtactgctctgttacatagtttagtcgttagcgaacagcgaggcatttttagttattggacgattttattagcgatctttgcctttgcattaagtctgttaggcacatttattgttcgttctggggttcttacttctgttcacgcatttgtagtggacgcagagcgaggaatggctctgcttattttgttctttagcttgagctttgttgcattgactctattcgctttacgagtgaatttatggcaaggcaatgttcgttttcatctgttttcaaaagaaacggcattattattggttaatggcttatttgcattagccacgctggtggttattcttggcacattttatccgatgattttcagtgcgatgggctggggatccatttcagttggtgcgccttatttcaacacgatttttgctcctttagcattgattttgttatgtctaatgggatttgcaatagtgctacgttggaagcatattccacaacgtcaaatcttatggcaactggcattattacccgttgcggtgctacttagtttaggcttcagttatcaagttttgcaacaggtctatgtacatcaattacagtggcaacccactctttttatctcactggcaatttgggttgtactaactcatctaccttatcagcgatttatgtggcaaatccgaccgcttgcaatgcgactggctcatattggttttgcgataagtgtgattggggcaatgatgaatagctattatgctgatgaagttggggtgagattaaaaccaacgcaatctgctgaattagcggggttacgctttgaatatgtcaaacaccacaatgaaattggggcaaactacaccgctgaagtggcagagtttcacctttatgatcaacatcatcaaaaattggcaaccttattgcctgaacgccgttactatgatgtccgcacaatgacaatggcagaagtggggctagcccattatggtttagatgatatttatattgtgatgggcgataagtttggtaataaagagtacgcatttcgtctgcactacaaaccttatgttcgtattttgtggctaggcggtgcaataatggtcttggcgagcctattggcattggttggttatcggagaaaaaatgaaaaaaggattgctgtttttaccgcttgttatcttatttgcggttgtactttttttagtaatgcaattaaaagaaaaagacaatgtgccgttaagcgaagattggcaaggtaagccgttacctgaatttagcttaaaacatttactggataatcaagcggctatcagtaaagcaagtttactaaatgagccttttattttaaacgtttgggcgagttggtgtacttggtgtattaaagagtttccgattttacttgagatgaaacaacaaggggtaaaaattgttgggctgacctacgcagatcgccccgaaaatgcacggcaagcccttgctcagtggggaaatccatttgagcttgtgattgatgattgggataaaggttttttaacggaaaccctcagaatttcttctgccccctcaagttatctcattgataaaaatggtattgttcgttaccaacaaaaaggctacaaccctaattttgctcaagattttatgcctcgtttgcaagcattgaaggaacaggataaatgaaacggatcttatttttactgttcagttttatcgccctcgtagctcaggcagaaatggtggacacctttcagtttcattctgatagcgaacgtattcgtgcgattaacctagcgaaatcattgcgttgtttacagtgtcaaaaccaaaatctagtagagtccaacgcttctcaagcctacaaattacgtatagaagtctatgaaatggtcaatcaaggaaaaagcgaccaagaaatcattcaaataatgacagatcgcttcggggacttcgtccattatcagcccccctttaatcctcaaacgtgggtgttgtggggaatgcctgttggcttacttgttctactctttagcctgattttttggcgaacacggagaaagcaaaatgattaggaacgaacttaatcgggcttattatcaacaagcggaacgatttgccgatacttttgcagaaaaagagcgtaatgaatatttagccgaattggcaagccgtcaagcgtttgaacaacaaaatgatgtagtatcgcaatggcagaaaaatccacttaaacgcccgcttgtagtaaccgttttgttgattgcccttgtcgccagccttctctattattggcagacagggcgttatagccttgctattcaaggggagcaggcttttgctcaatttcaacaacagcgtgcggaagaaagtagtgaacagcgtaatgatcactatattaccaaccttcaacatcagcttcgccagaatgccaatgatggcaaactctggtttgagctagggcaggcttactcactcaataacgatttcgaggcagctttaacttgttttcgtaatgctcagactgtactgggcgaaaaggcgagtattttaggtgcaatggcaacagccgattactatttgaataaacagcgactttccccgcaagcaaaggcttggcttgagcgagcgttacgaattgatgataaagagagtgccagcttgcttttgcttgcctccgatgcttttttacataacgatttcaaacaggcaattcattactgggaaaaagtattagacaaccagaacgaagccttagatcgtaaagagatcattcaaagtataaaaatggcggagcagatgttacgtgagaaatagtgccatttatggttgtttgatattgatcatcacaataatattttaaaagattctaaatttttaatcttagtttttctttatagcaaacaacaccaactctctcatctggaaacttaccgatacttttgcttccagtggcaaatctgccgtttggtaagcggtaacatttgtgccgtttattgcgatttgataacggtagaattgccctaataacagtttttcaatcactacaccttgcccgttatcatcggcttttagggtaatctgctctgggcgaagcaaccaatgataatcgccaagcggatactcgatttcagggaattgataagtaccaatcgggctttcaaggaagtgattttctaacactttgcacggcaggtagtttgtgccacctaaaaagtcagcaacgaaagcgttcacaggggcgcggtagagttcggttggcgtaccgaattgtacgatcttaccctgatccatcaccgcaattttatctgcaaaggcaaaggcttcttctttgctgtgggtaacgaaaatcgcagggactttttggctttttaagatctgtttaatctcttggatcatcgcatagcgagtttggctgtcgatgttggaaaagggttcatcgagcagtaataattcaggttcacaagctaaagcacgggcaatggcgacacgctgttgttgtccgccagagagttcgtgtgggaagcgtccttcaaagccttgtagtttcaccacggataacatttgctgggtgcaacaatgttggtcggatttacacattttgcataagccgaattgaatattttgtgccaccgttaaatgcggaaagagagcgtaatcttggaaaatcagcccgatttgacgctgttcaatcggttttttctgtaaatcttccccagcaagaaaaatgttgccttcgctaatcggaagcaaacctgcaatcgctttgagtagcgtcgttttgccacaaccgcttgctcccaatagacagacgatttcattttcgtccacggcaagatcgagggattttagtaccacattgtcgtcaaattgacagctcaaattttgaatatcaagtaatttcatattaacgttctttttgcgattgagagattaacgaacgggtcagccaaataacagggattaatccgactaacaccaacacaatggctggcaaggcggctcgctctaattgttcgtccgaagtaaaggtgaaaacgtgggtcgctaaggtatcaaagttgaacggtcgcaataacagtgacgcatttaactctttcatactttcaataaagaccattaagcctgcggtaataattcctttggtaatcaaggggatatgcacacttctaaacatggataagcccgtttttcccattgtctggcttgccatatccaacgacggtgaaattttgccgagtgaggtttcaaggctaccgattaccattgcagagaagcggatcacataggcaaggactaaggcaaacagtgagccagaaaaaatcaagccgacaggggaaagctctaaagatttcagtagcgcgtgtagttggtgatcggcaaaggttaatggcgacaacaagccgattgccagtacagtccctggaatggcatagcccaatgaggaaaattgtaacgacaagcgggtcgatttcgtccaaaatctgcgattgaccgacagacgatgagcaaaatgcagtaacagagcaagggcaacggtaatgatcgaggcaataatggatacttttaagctatttgaggcaaattgcacaaaatctaaattccacgactgttcaaaatagtggaaagaccaatagattaatcgaccaaatggaataaagaacgccaatgccaacaacccccagcaccagccttgtgcaagccacagtttccagcctgtgagctgtttgaacgaggttttcttttcatagccacgctgatagcttttttgtttgcgacggctgtattgctcaaggctgataaacagaaaaatcatcagcaacataaaaatggaaatacggcttgccgtgccgagatcttgaaagccgagccacgagtcgtagatggcagtcgtcaaagttggcactgcaaaataggacaccgtgccgaaatcgcctaaggtttccattgcgactaacgccataccgacagcaattgcagggcgaattaaagggaaagtaattttacggaaaatatccgctggcgatgaacctaacattctggcactgtgagtgaggttttccgattgttctaataatgccactcgagccagtaagaaaatataagggtagagtacaagggctagcacaaagcaagcaccgtaaagggtgcggattttcgggaaccaataatcgtgcggtgtttgccaaccgaaaataccacgcaacatttcctgaaatgccccagaatagtcgagtaaatcggtataaagataagcgattaaataagcaggcattgctaacggcaagcaaagcaaccattgaagtgttttttgcccacagaattgataattagcgacgatccaagcggacggtaatgcaaaaaaaagtgcaaggacgacagtgcctaagactaacaggcttgagttaagcagataagtgcctagcattgtatcccagagatgaacgagattttccatttcaccttcaaaagcgtgatagccaatggcaagcaacggaagaaggattaacagcgtagttgcaagagcggaaagttgccaagtcaggtatcggtttatcataaatcgatcaaaatctcattccattaaaaaacaaaattccccctttgcgaagaagggggtagaaattaaattcgacgtatttgtagggacacgaagcttcgtgtcccaatatccacattggttgtgtattagcattggacgccaagcgtggcgtccctacaaacgttacaatattaattatttcgcaccgaaatcatcaaatttaacttcatcaactaatttcaatgctttttcatagtttttcgcaatgtcttctaattttaatgcatcggttgagtaagttccccagccttttacaagatcagaaggtgcaacgtcagcttttactgggtactcgtggttaagtttagcatataaaccttgagcttggttgccactgagatactcaattaatttaattgcatttgctttgttcggtgaatgttttgctaatgctacaccactgatattaacgtgtgtaccgtattgaccgttagggaagttaatgatcgcagactcagcccaagatctttgtttttcatcatctaacattttaccgtagtagtagctgttacctaacgcataatcacaaatgccttctttgattgctttaacttggtcacggtcgccaccttgtggtttttgtgcaagatttgcttttaagccttctaagaatgctttggttttttcttcaccgtagtgttcgatcattgcagcaaagagagaaacgttgtaagcatttttgccagaacgaacgcacactttgcctttatattcaggcttagctaaatctaaatagtcaaacccagcaggtaatgcacctacacgatcttttgatgtataaataacacgagcacgtttggttaaaccgaaccattcgccatttgaatcacggaactgcgcaggaatatttttctctaaagtttttgagtctactttttgagccaagccagctttcacaatttgcattatacggctaatatctaccgttaaaagcacgtccgcagggcttaattcgccttctttttgtacacgttcaactaaacctttgtctgcaaagatcacgtttactttgatacctgtttgtttttcaaagtcttttaacatcggctcaattaagtacggctgacggtaagagtaaacattgacttcgtttgcagctaacgcagaagttgaaataacagaagataatgcaagtgcaagcacagaaagagattttttcataaaaatgtcctcattaggaaagggataaactcactataaatagcgagcgtttacaaaacattgtgagtttaaaatgtttacatttttatgtcaagtaagaactatttttatttactaatgggtagttaatctcattcttaataagatgaaaagtgaaacctttttggggcatcctatagtcgcaacatattatccggtattatgaatcaagtgcacaaatacctcatttcaataaaatctgtgtataatacctgctgttttgttagcaataattttgctttcaatgaagttaatgtttgctcgtataattttgtactgccttcgtgattaatagagcaacagactgtaaagcctatgtgaagcagagtattgtctttttcatttaaattattccgtaaattaagataggttaaaaactaacttaattgtgcaaaaagaaacaaaatgcaatcaagatttaattgataaacattaaatttagcgtctaaaaaatatttagagatgaaagaaaggttttaacgattattcaaatagcatttataaattaaatctattgaattagatcaaaataaccgtagttttttatagggataatatattcgctttttactttatggagtgttaccaatgaaaaaactactgttatcagcaattgctttgggcgttgctggatttttaggggtggttgggtatttgcatacctttgaccaagaccaagcagcaaaactacttgcacaaactaattttagtggtaaacagcaagaagtggcgaaagtcttttttgaaaatggctgtcagtattgccacagtcctaatgcagaaatgcctttctatgccaaaattcctggtgtaagttcaatgatggaaaatgatgttgcaacaggcaaccgctttttccgtttggataaaatgttagaaggaatgaaagatcctgctaaattatctgaagcggatctggctaaattagaaacggtgttacgcaacgatacaatgccaattgcgagctttattcatattcactggggttctcgccctgatgagcaagaaaagaaaacggtgcttgactggatccatcaacagcgtgcagaacattttgtaccgaaaaatacggctggagttgatccaactcgcttagttcaacctattcctgatgcattaactacagatccacgcaaagttgccttaggggatcaaatctatcatgacgggcgtttatcaggcgatggcactgtggcttgtagcaactgccaccaattagataaaggcggtgtggacggcttgactacatcaacaggtattcgtgggcaaaaaggcggtatcaatgccccaacggtatataacgcagcctttaaccacttgcaattctgggacggtcgtgcgaaagatttagcggatcaagcaaaaggcccaccgcttaaccctgtcgaaatgggttcacatagttttgatgaaattttagcgaaattcaaacaagatcacgcttttatgcaagagttcttagcggcttatcctgaattaaccgcagacactttaacagatgccattgcagaatttgagaaaacgttgatcacgccaaacagtgctttcgacaaattcttaaaaggcgatcaaaatgccctgaataacgcacaaaaacgtggttacgaagcatttaaagcggcgaaatgtgacacttgccatacaggtaccgcaatgggtggacaatcctttgaatatatgggcttatatgatgattatttcaaaacgcgtggcacaccaattaccgcagacgatcacggtcgtttctcacaaaccaaagatcctgctgatatgcatcgcttcaaagtaccaaccttgcgtaatgtggctttaaccgccccttatatgcacgacggtagcgttaaggacttaaaagaggctgttcgagtaatggctcactatcaaagtggtaaaaccttaaccgatcaagagttgaacgatattacttcattcctagaagccttaaccggtgaatatcaaggtaaagtattaactcgtcaggattagcataaattgctaagtcgtcacaaaaacgatataggagaaattaatctctgacatatcgtaagaacaagaaactaaaagggctgaaatcaatataatattgttttcagcccttgattaataatttagatttatacaaaccttccttgcttaattttcatcaaacaagaatttttcaaaacattagcgacgtaaacctaaacgtgcgatagtttctgagtatttagcaagatcagtacgttttaagtagtctaataatttacgacgacgtgaaaccatacgtaataagccacgacgaccgtggtgatctttcttgtgctcagcaaagtgtgcttgtaagtggttaatttgtgctgttaaaagagcgatctgaacttctgaagaaccagtatcttttgcatcacgaccaaattcagcaacgatttttgcttttgcttctacgcttagagacattttttactcctaaaaagtagttaagtttatattcatcaatagccgatctctaattcagctacgacacgaagttgcgtattctaaagagaaaagctgtcaagagcaatgcttttctctcagaatagcttaaactaatgtttggtatccgattgactttgtggttgtagatattcttctcgattcggatcaacttgttttgatttacgaatcattggctcaatagttgtaccttgtaccaaaatagagaacatcacaacagaatatgtcatcaccagaattagatctttaacatcaataccattggcataagcagttttggctggaatagaaagtgccattgctaatgccaaacctccacgtaatccgccccagctcatgatttttaaggtatatggattgtaagtacggaactgttgtagcgccttatatggtaaccataagctgatatagcgagatgctagacaaatcggaattgtcagaatcatcatcacaataccgtagatattaaaatcgacgagtaagatcgcaaaaccgataaggaagaaaagcagagaatttaagaaatggtcaatcatttcccagaagtgatcaagataacgttggctctgttcagaaaagcctgaacgacgggtccagttaccaatcataatgcctgccacaatcattgccaacgcacctgaaacgtgcagaacattgtttgcaaacataaagcctgcggttggaatggtcaaagttaataaaatttctaagctaccatcatcggttgatgaaattaaaatatgagcaaggaagcctagcacaaatccaaacaggataccgccgatagcttcatgcaaaaagaggctcataattccactaaaactggcttcttgaccaccaaatgcaacagcaaacacagtgacgaagataactaaaccaacaccgtcattgaaaagcgactcaccttctacttgcatagataaacgcttcggtgctcgtaaatttttgatgatcgcaagtacagcaattgggtcagttggagaaatcagagcaccaaaaacgatacagtaaatcaaatcaatttgtagcccaattaagttggctaccccatagacgaagaaaccaataatcaaagttgaagctaaggttgagaataacgcaaaaatggtaatttcccatttttgatctttaagaacagggagtttaattcctagtgaacctgcaaagagtaggaaccctaaaataccgttaagtaagaaactcttgaagtcgatctgttccatgacttctgttgcgacagcatcaaggttaaaccagccgaaagttccgagtaacagtagtaagagagaaccgatcattgctgcagctgtaatagcaatggtcgattggattttatcgctgattttatgagtaatgaaacctaataaaatagaaagtgctgataaaaaacagatataagtataaatacccatgatggtatccttatggagacaaaaaagaaagatccttgttataaatagtctgcaaattaaaccaaatttttaatctgattgcaaaaaaataaaagatattaagtgagctatttcacaagtaacaatttgagaattttccactttaacggtataattaagagtagttttttgtaattttagggatcataaagatgattgaaaaaatgcatgagaaatctggtgggtgggtatttaaaatcatttttgcattagtttctctttcgtttgtattaggcggtattggtggtgggttgatggctacagacaattccgttgccaaagtcaatggagaagaaatttctcaacaagtatttagccgagcaaaaaatcagcagcaaaatatcctaaatgctcaattaggtgagcgtttttgggatttaatggacaatcctatttatgtcaaacagttccacgagagtattttaaatggtttagttgatgacgagcttcttcgtcaatacgctaagagccttaaaattgacgttagtgccgatcaaattaaatcagaaattgtaaacagtcctgctttccaacaagatggtaaatttaataataatttatatcagcaagcattacgtaataatggtttaacggctgatggttatgctgcaattgtttatgaaggcatgctatttgcacaaattcaagaggctattgtaaatagtagttttaccgttcctgcacaacaagaactattagcgaaattattgttacaaaaacgtcaagtacgtctggcgacctattcaattgcaaaagaggtgaacaatcaaaccgcttctacagaagaaatgcaagcctattatgaggcaaataaagcgaattttgttaatccagaaaaattgaccgtagaatatatttctattgaaccaaaggatttggctaataaaattcaagttactaacgaacaaattgacacttattatcaaacaaacaaagctaaatatacgacaaaaggcgaagcgaaaatcgcacatattcaagtagccactgaagctgaagcaaatgaaatcgtacaagcactcgctaaaggtgaggattttgcacaattagcaaaagcaaaatcacaagataaattatctgctgctcaaggtggagatttaggttgggcgaaagcgggcgtcttcccgaaagcctttgaagatgcggctaatatgttagacgctggaaaaacaagccaaccaatcaaggtagataatgctttccatattataaaagtattagaacgtaatgtagaaactgttgtgccgttagagaaagtaaaagctcaaattacggatacaattcgtaacgagttacttttaacggagtattcaaacatcacccgtgaaatggcaaacgtagcatttgaaaatagtggctcacttgaagcggttgcaaaagtagcgaatgttctagttcataaaacagatgctttcacacgtgaaactgtacctgctgaacttgataacgagaaagtcctacgcgttttattcgacagtgaagtgcgccaaaatgggcaaaattcagaagctattgatttaagtgatgccacaaatactaaaacgatgtttgttcgtgtaagtcactatcaagctgaaaacgtacaaacttttgacgaagcaaaatcagcagttgaacaagcagtgaaacaacaaaaagcgctcaaagtcttagaagagaaagccactacacaagttgcagcattgaataaaggcgaaacagtagaagtcgcatttggtgcctctgaagaacttgtctttgcacaggcacaaatcactgaaccggctttagcacaagcggtcttttcaatggcaaaacctgcagaaaaaccgacatatcagaccgctcgtaatacgaatggtgacgtggttgttatcgctttagataaagtgagcgatggcacagctgacgagtttaaacctttacaagcacagtttaaccaagcagagcgagttgtgttacgtaatgatttactcaaagatttacgtgaacgtgcaaaaatagaagtaaatcaagacttccttgaccaactcgaaagcagcaaataatataaatgtgaatttggttaaaaatttgtaattgactttatctataaatttccgcaaaattcacgtaaattttttaatcttcagggcagggtgaaattcccgatcggcagtaaagtctgcgagcggcggcgaaagccaaagcaggaactggtgaaattccagtaccgacagtgatagtctggatggaagaagagctagaatgtctacactcgaacactgttcgagtgcttttcttatgcttttaacgccttgagatcgtgagatttcaaggcgtttgttttttcctctcccgtttacgggagagggaggagccaattcggtagaatttgcggagggagagggtttgcaataaacttccctctctctgcttttcgtaaagccgttactttgctcaaagctgtctctctcccgtgaacgggagagaattattcttcttccttgcccttcaatttatgatttaaaacccaaaatgacacactctatttttatggctcgtgccattgaactggctgaacttggtcgtggctggacaaatcctaatccgttggttggttgtgtgattgtcaaggacggcaacattgttgcggaaggctatcaccaacgctacggcgaatggcacgccgaacgtaaggcgattttacattgtcaggaagatttaagcggagcaacggcttacgttacccttgagccttgctgtcaccacggacggacaccgccctgttctgatttgttgattgaacgggggattaaaaccgtcgttatcggctcaagtgaccccaatcctctcgtggcaggcaaaggtgtggcacaacttcgccaagcggggattgaagtgattgaaaatgtgatgaaagccgaatgtgatgcgttaaatccaattttctttcactatattcaaaccaaacgcccttatgtgttgatgaaatatgcgatgaccgcagacggtaaaattgccaccgcaacaggcgaggccaaatggatcacaggggagcaagccagagccaatgtgcaatgcacccgacatcaatacagtgcgattatggttggagtagataccgtgttggcggataacccgatgctcaatagccgaatgccaaatgccaaacagccagtacggattgtgtgcgatagccggttacgtacgccattagagtgtcaattagtccaaactgccaaaacctatcgcacgataattgcgacagtttcagacgatttgcaaaaaatcgcccaattccaaccgcttggggtggaagtactggtctgtaaagcaaaagacaagcggatcgatttagccgatcttttacagaaactcggcgaccaaggcattgacagcttattgttagaaggtggttcaagtttaaatttcagtgcgttaaacgctggcattgtaaaccgtgtgcattgttatatcgccccgaaattagtcggtggagttaccgccaaaacgcccatcggtggtgaagggatcggcgtgttggcaaatgcggtgcaattgaaaaatgcaaagatccgccaaatcggcgaagatcttctgattgattatgaagtaggaacacattgatatgttcacaggtattattgaagaagtcggcaaagtcgccaaaatccacaaacaaggggaatttgccgttttaaccatcacgggaagcaaaatttttacggatatgcacttaggcgacagcattgcggtcaatggtgtctgtctaaccgtaaccgaatttggtgcgaaccatttttccgcagatgtgatgtcggaaacactcgctcgtacatcattgggcgaattacaaccgaacagccccgttaatcttgaacgtgcaatggcggcaaacggacgtttcggcggacatattgtgtcggggcatattgatggcacaggggaaattgtcagcattacccctgcgaataattcggtctggtatcagattaaaaccacggcaaagctgatgcgttacatcattgaaaaaggctcaattacgattgacggaataagcctgacggtggttgattgtgatgaaaacagcttccgcgcatcgattattccgcataccttaagtgaaacgaatttaggcacgaaaaaagtcggtagtattgtgaatttagagaacgatgtaatcggaaaatatgtggaaaaattgctgtcgccgaaacagagcgagccacagagcaatatcaccgaagagtttttaaagcgagtggggttttaaatcccccttagcccccctttttcaaaggggggaattatcaaaaaggaaagcaaaaaattccagaatttaaagtagggacgccacgcttggcgtctgtaacaagcggtcagatttaaagaaaaggaaagcaaatgtttcaattttcaagcgtagaacaagccttagacgcattacgtcaaggcaaaattattatcgtcagcgatgatgaagacagagaaaacgaaggggattttatctgtgcggcggaatttgccactcctgaaaatatcaactttatggcaacttatggtaagggcttgatttgtatgccaatttcaacggcgatagccaaaaagctcgacttaccgcagatggtttcttacaacaccgataaccacgaaactgcctttaccgttgctatcgatcacattgatacaggcacgggcatttcggcttttgagcgttcgcttactgtactgaaagtggtggacgacaacgccaaaccaagtgattttcgccgtccagggcatatgttccccctgcttgcaaaagacggtggcgtgttggtgcgtaacggacacacagaagcaacggtggatctgactcgtttagcagggcttaaacacgcagggctgtgttgtgaaattatggcaaacgacggcacaatgatgaaaatgcctgaactacaagcctttgccacaaaacacaatatgccgtttatcacaatcgcccagcttcaagaataccgccgagcaaaagattgtttaattgagcagatttctgtggtcaaaatgcctaccaaatatggcgactttaccgcacatagttttatcgagaaaatcacaggcaaagaacacgttgccttagtgaaaggggatattggcaatggagaagaggtgctgtgccgtattcactctgaatgtttaaccggcgatgcctttggttcacaacgttgcgactgcggtcagcaatttgccgctgcaatgagccaaattgagcaagagggtagaggcgtgttgctctatttacgtcaagaggggcgaggcattggcttaatcaataaactgcgtgcttatgagttgcaagataaaggaatggacaccgtcgaggcaaatttagctcttggcttcggtgaagatgaacgtgaataccatatcggtgcacagatgtttcgcagtttaggcgtaaaaacaatccgcttgctaaccaataacccagcgaaaatcgaggggttacagcaagttggcttaaatatcgtggcacgagagccgattatggttgaaccgaataaacacgatttggaataccttaaagttaaacaagttaaaatgagacatctgtttaatttctaaacttgttaaataacattcattttacggacacacgcagtgtgtccctacgacagttttatatcaatttacattcaatataaggaaaagcaaaaatggcaattatcacaggtaatttagtggcaacagggttaaaattcggcattgtgtgtgcgagatttaacgattttatcaacgataaactgttaagcggtgcgattgacgcactcgttcgtcacggtgcaagcgaaagcgatattgataccgcttgggtaccaggcgcatttgaaattccgttggtcgcgaaaaaaatggcggaaagtggtaagtatgatgcggtgatctgcttaggtacagtaatccgtggatcgactacgcattatgattatgtgtgtaacgaagcagcaaaaggcattggggcagtgagtttacaaacaggtgttccagtgatttttggtgtattaaccactgaaaatatcgaacaagctatcgaacgtgcaggcacaaaagcaggcaataaaggctctgaatgtgcgttaggtgcgattgagatggtgaatgtgttgaagggactttgatatttttattcactagagccttctccttttatggtcacattatggcgatcgtcaaataacacaataaactactttggataatacaatttaccttcgccatataaaaagagtttataacaacaacccatcatcactcaacttctcgtggcgactttgctcaaatagacgcaataaatctggtacatccatcttcttgcgggcatcgcccgccacatcaaaagccacctgaccttgatgcaacattacagttctatccccataatctagggcttgtcgcattgagtgcgtcaccattaacgtagtgagtttttgctctctaacaattttattcgttaattctaacacgaaagcggtcgttttcgggtcaagtgctgcagtatgttcatcaagcagtaaaatatttgaaggttgcaacgatgccattaataaactaaccgcttggcgttgcccccctgataatctgcccatttggtcagtcaagcgattttccaagtctaatccaagtaaggataatttctctttgaacagctctctgacttggcggttcagtgcaaaacctaaccctcgtttttgacctctttgataggctaaagccatattttcttcaatggttaaggcttcgcaagttcctgtcattggatcttggaaaacacgggcaacttgcttagctctttgccagctagtcaatttactgacttctttaccttgaataaaaatctcaccgctatctattggataatcgccactgatgacattaagtaaggtcgattttcctgctccgttactgccaatcaccgatacaaattccccttcggcaacattcaggctcaatcctcgtaatacaggattttcaatcacagtacctttattgaacgtaataaatagattattcaactcaatcattatcgacctctttttgctgtgaatttgtgcttgaatttaggtaacgcaagaaccgctacaactaataatgccgtgattaaattaagatcttgaggcccaaaaccgataccattgagcgtttcattatttaaggctaatgcaatgaaaaagcgataaagaatagaaccaataatcaccgctgcagttagacaaataatacgttttgcagagaaaatcgcttcaccgataatcactgcagcaagcccaatcacgatggtaccgaccccaatcgaaatatcaaagccaccgttactttgtacataaagcgatcctgctaatgcgattagcccgttagagatagccataccaagcaaggtcatcttattaattgcaataccttgtgcttttgccatacgaggatttgtccctgttgcacgcacagctaaaccaatttgtgttgcaaagaaaagatcgaaaatcaacttagcaataatcaccacaaaaattgccattaacaaccgcaccattgctaactgaacatcatcttgagcggtcattacatcataaatcgtcgcttcacctaacaaagaaacattaggcgatcccataattcgcaaattgatcgaataaagtgcaatcatcatcaaaatactggctaacagtttttcgattttaaaaccaatatgcagacttgccgtaatcatacctgcaaccgcaccagcaaacattccgcacaacgtagcaatccaaggatcgatatgatgcaaaatgcaaagcacacagacaccgccacctaaaggaaaagagccatcagcggttaagtctgggaaatctagaattttgtacgaaatcagcccccctagagcaactaaagcataaatcaagcccagctctaaagcccctatccaagtaacattggtgaaataagtcgtcaaaaattgaagtaaggaatccatcttaaaaatactattttactagtacaacaatgtttcgcattgtacgctatttcagataaaaaaacagtaaaaaaatagatttttgtaaatttttttcacgcaaacctttgcttttcaatgggttgccgacaagagaaaaaataagcggtagaataagcagtagatttttcaaataatagaggatacaaataaaatgaacgcaatcgaaattttaggctatgttgcaatgattttagtcgcaggttctttcttattaaaagacgtagtaaaacttcgtttagtgaatgcacttggtgctgtatgtttcgtgatttatggtattttgattaattcattccctgtaacaggattaaatatctttgtggtgtgtgtgaatgggtattatatttggaagagtcgctgttccaaataaagagttcatttagaattgctaaataataggcatttgatttcataagtaatcagatgcctatttatgtatagtaaagagtcattcatgtagagctcttctagagttctatattttcaatgttgctgacctaatatcacaaagccaatgcggcgccgttgtgcgatgcaagattttaaacgatgagcttgcaaaattcggcgatatttactgatagttaagcgtttaacacgctgtttcaatttacgttttatcataaatactccttatttactctatttttaattgatttttatgatttcctgtgtgttatttgagtttgatatttcttgctctttcactctctgatgattgatcaagctattgtaataacgtcggatattttctacatattgaaaggcttcaaatccacgagcatatccgtattttagttgagtatagtaatgttttttagcaagtagaggcaaatttttctttacatcaagccaattatctggatttcctccaagttgtttagttaaacgccgcacatcaatcaaatgtcccattcccatattatatgccaccaagctaaaccaaatacgatcttccgatgcaatactttgaggtagctgattcattaataaatgtagatattctgaaccagctttaatactttgttcaggattaatacgatctgttacattcatcctttctgcggtatctttagtgagcatcattatgcctctcacccctgttggtgatgttgccgtaggatcccaatgagactcttgataagcaatggccgcaagcatctgccattctaatattcctcggtatttttcaaataaatgtaaatatttaggcaaaacagtgtcgatagcttttaaatagctttggctatccacgtagtcaaagcgatttaaataattgaaatatttttcctcaattcttgctattaagcctgtttcattcgcattatccataaaacttaatacggcagcttgcagttcactatacccgctattttgtaaataccatacaacaggctcctcatcggttaaatcaaatccaacggcaacatcaggtttaatatgttgtgcagctgagacatcaatagacacggctacagtataaggaattttgccatcggctacttgtattaataattcctcttgagtgaaattgtctgttactttccatttcaatgaggggtactgttcttgcaatgttgttaaaattggaataacagctgaacctgcagggattagtaattcatcttttaaatcaccaatgctgtaagggcgctgacttccttttttatacacaatctgccatgaggcagaataataacttggaccaatttggaatttatctgcattttctaattgatatagcaatcctgcagcggcaatatcaatttcattgagtttcaaaccattaaataattgttcgctattattgtagtttttaacttctaacccgacacctaaatattcagaaaacgctttagcaagctcatattctatccctgcggttccttctgctccctcaaaataagagatggggtgattaatcattcccaccttcagtattttacgttgttggatctgcgtataacgattttcttctgcctgcattgcttgttgccaaggaaataccatatcccatgcccacagcaataatgcaatcccacatgcaattctgatagctaagcctttcaatttctcctctctaaccttcactctcaacagagtgctgtagtttagcaaatctattatgagttcaatatgaatatattcttaataaatcaatttagtttaaccagtattcccagtttgaaaagaggaattaggggttgatatgtcgttgataagctagaagcgtattttgcattaacatagcaacggtcattggtccaacaccacctggtactggagtaatgaattttgccttttgggaagccacttcatattcaacatctcctaccaattttccctcaatacgattaatgcccacatcaatcactatggcattttctttaatccattccccaggaattaaattaggctttccaactgcgactactaataaatcggcttggcgtacatgattttctagattctttgtaaaacgatgagtgacagtgacagtacagcctcctagtaatagttccaatgccattggacgcccaacaatattggatgctccaacgataacggcatgttttccataaagattctcccctgttgtttctaagagcttcattacaccataaggggtacaagctcttaatgttggaatacgttggcataaacgcccaacattatagggatgaaaaccatcgacatctttatctggagagatggcttcaatgatttttgttgtatcaacatgctcgggaagagggagctgaactaaaataccatcaattttttcatcattgtttaatttgttgattaaagagagcagttgtgtttccgttgtgtctgcaggtaaatcataagattcagaataaattcctaattccgcacacgttttacgtttactcccaacatatacctgtgaagcgggatctgagccaacgagaatgacggctaaaccaggagcacggtatccttgttgcacgtaagacgcaatgtgttcaaaaatttgagttttaatttgttgtgcaagtttattacccgaaataatttgtgcggacatgactaattttccctatgtaattgacaatatacattcggtattctctcaaaaaaattgctttttagtaagcattaatcttgaagatgtttaaagaacgaacatttaattgcaattacttaaaaacttattgaccttaataataaaatttttataatagcacgcaccttttttcaagacaaggcggcgagtagcgcagcttggtagcgcaactggtttgggaccagtgggtcgtaggttcaaatcctatctcgccgaccattctatcgttttcaaactactatcttatcatagtgcaatgcgcccttagctcagctggatagagcaacgcccttctaaggcgtgggtcaaaggttcgaatcctttagggcgtgccattaaattattttaaaatcaatcacttacaaactatgcaactaatcttaatcgtggttcattttgcgaatgttccgtaaatgtaccgtaaatttcgaccttgtttgcgtgttccagtaaatgatctgcatttaaatgagcatactttttaaccatttctaaggtttcccaaccgcctaattcttttaatgtgaaaagtggtgttcctgcttgaacgtgccaactcgcccaagtgtgccttaaatcgtgaaagtggaaatcagttaataagcatttttttgtagccaaattaaatgcttttcggttaatatcctgtaaaggattgccgtttctgcccacaaatacatatttagaatggcggttgcggatagactcaagaagttttatggcttcttggttcaataatagcgatcgtgccttacctgactttgcaacatcattagtcacgattgctactttcctttcaaaatctatcttatcccaagttattgttaaaatctctgtgcgtcttgctcctgtcatcaaggcaaatttgcagatagatttcatccagtctgaacttaatttatctatgagctgttttgcttgttgtttcgtgatccaacgcactcgaattggcggttcttcctttttctgtacatatggcacagaatccagcataccgagcttatgagcgatatttaatactctcaataaagattttacatacttgttttgcgtactatgagataatgggtccttagtattcgcattcttttttgggatatttaagataatttcttgtgctgttaaagagctgagttctcgccctgcgaatttagagagccagtattctgcgtgtcgctttttcgtggctttatcctttaattcttcagcggaacggacataatgtaataaagcatcttcgaagatgtattttctctttgtttcgagcttatcttctgcccacatttcttgcttgagtttgtcgtgatactgctgtgcttcacgttttacaagcgtgcgagtgcttctcttaattctcttgccgtttggggttgtgatatcaacccaccacggaccgtttgcttttcgtctgtagatcgacattttcttttctcctcgaccgacagagataccccacggtcattattcgcttgtttttttactcggtcaagatctgatcgtttaacccgccaaactttagatcctgccattttaaaaaatccccaatctgctaggtgctggcggacggtatttgggtggcaatttaactctttggcgacttggttaattgttaaatgttctatgtgtgtcattctttttacccaataaaaaacctagctttcgctaggcttgttcgttgatccataaaataaaaccgcccataaagagcagttggttgtggttaaaagtttgctaatcgttgttgattaagctggggtatggcttgttcaatgaatgggtcaagccatacgttaaactcgtgtgcgatgtcgtaggcttttcctgcaatatcgtttttaacatagcgagaaatgcccaaatcttcgtacagtttacggtggaatacttctacttctttggcaaaggctctggctcttacaagatatttggcaatttgttctgcatctaaacctgcaatggtgatgtcttttttactgcggtcaatcgggcggtattggttgccgagtgtgtttaagaagttgataacgcgttcaaacattgtttgcggtagttggtcatacttcgctacgttaaaagtgcttttgagccgagagtagatttcttgccagtgtaatcctgttcgatagtgagcctgttgtaccgcttcctgtatagctcgttgttgctcaggggtaattgtaagcggtgcgatttgttgttcattttgcaaaatctcacgatcaagaatatccagtacccatttgcgaaactctttggcgactttggtgcgggcgaacattgcgatgaggtgcgcaccacgcaaagagaagacgcgaacttgttgttttccgcctgcggtttgcagttcgataagtgcggtcatttctgcggtaaattcgtctgcgttgcggttgtagatttttacgattgcttttgtaggatcagcgtattctaatgctgtacctaaatcgcttgctgttaagaatgtgtggttgtttttattgataaccgaaagagtagtgttttgaaatgttaatgtagtcattttattattccttgtgtttgttttaaaactcatcacaagctactgcaataactggtgatgaactggctaaggtttgcagtaaccgttacacaaggaagacggcagatctttcgatctccttaaccagcccatcattgactacttttaaaggggttccccaatttgggggtacctttgaaaggtttgatttgactagatttcggctataaaaaaagtcgcttttggcgactatcattatctccgccactcaattcaggactgcgatcccgactttctgttgaaagtgggagtatcttaaactgaattgggtgacggtgtcaataaaaaagcctgcgtggtgcaggcttttaaaatcaattattattttcttcggtgttatttgactttggtgcttcaatttttttgccgatcacaaacacccctgcaatagtcgccaacacactaatcattactgttgcagctaatcctgggtgaccttgtgaaacaagataaaaacagaagcctgctacaataacaacactcaacataccaaaccataaaccgagtgatttttgttttagtgaggttttatttaattcaaaacgttcattttttgcctgttcggcataagtcatcactctgtcgccaaagttaggaatatgcttggcatattctgccatttctcttgctggtggcagtggaccgtggtgtaaagacattgcttgttgaacaatgattgtttgtgctgcatcggtattgataacttcagcaagtaattctgggtctttagtaacaacttcgacgatttcttgtttattttcgctgtgcattaacaacttctcctatcccttttcgtaaatcatcaccaagctgcctaaaatcattctgcatattttttaagtcatcttgtggagaaccgatatcaattgaagcaaataatggggcgatattgaacatagaaccaaaaccaataaagaaattggcaatgcattgatgttttgtcattttcatattgatttcctaaattaaagttattaagccacacacaaaaaaagcctgcaaatgcaagccctgtcacgttctgtattttaaaaaagcactttctgttgaaagtgggggtatcttaaatcaaagggcggtgggtgtcaatactagataaaacaaaggggagccttttagctccccacttcacgattaagttagcttgttatcgctttgcttaatcgaccaaacatttttcagcttggttttacaagcccctttcgggttcactgttaatttaacttaactttaaggctttagcaactgcttttttgatatttgcaaaatcttcatcatcgatcacaggtacgacatattcacgtttttttagcttataacgatctaatcttgataatgatactgtataaaccatatcacatttagcccaacattgaatattgcttttatcaggtaacgggttattaggcattgggtagtgatagggctctaatggctccggtttggtagtacttaatggcacaatggtaaccaattcgctatttttcttgtgctttgatataacgacaacaggacgagttttcaccatttcaggggcaataaaacccgaaaaatcgcacattacaacggctttttctttaggttgatattttaatgccattttaaaatccttgtaataaaaaagccgtaaaatacggcttgaaagtgcggttatcttaatcctaattggcggtgggtgtcaatatcaataaattatataaataatgcttgtattttgtttttattatttatataatgaacttgttttcggaatggttctgaaaataagaagcccgactgaaatcgggcctttaaaaaaggagctaggattatgttttggaaaatcgcaatcctagttatcttgttagtggtaagctcaaatgcttactagttaatagataaccctgcgggggatatgtggaagtgtcccccaacggctcctaatataacaacttcagttttaaaaatcaaccaaaggtaataaaaatggcaaacgctcaaacagaacattctcgtaaacttcgtgcggaaacttcacgccgattaaatgataaagccttagcggaaggtaaagcacgccgtattttaatgcaattaccttcggaagttgccgatgaatttgatgccatttgtgctgaaatgggtgtttctcgtccacaggcgatcaaggctttatgtgcgttgtatcgggggaagtaggggaggttttttctcctgttaaaaattaaacccctgcccgtgtgttacgactttttcgatttcttcgtagcggcggacgttaaatttctcaaactctaatactttgactaggctttctgctttagccttgagttgttcgagttcttgctgttgtttgaaattctgtgcgacaagttctgaaatgtgttcgtttgctcgaataacggcaagggcttgccgtgagcagagtgttacataatagtttaactgcttacgcagtttgaaaggattgagggttttcatagtggttcctttggtcaatcgagttagttaagaattctactttgagcaacttcaatcagtagtttgtattcgtgatgggtcttgtcatcgtggacttcttttgattttgataaaaactcgtccaccgtgcctgtaaagcaaccacgagtaacaattaacccaaattttccattaaagaccgtaagcgttccattttctgagcctacattacttgcccaaaaaatcattttgcgttcagagataactgcaaaagatctcacccgagcatcaccgaacacccgagcgatatcgtacacccgagcatcaccgcacaccccagcgttaccgtacacgcaagcgtcaccgtacacccgagcatcaccgaacacccgagcgttaccgaacacccaagccttaccgtacacccgagcattaccgtacacccgagcattaccgaacacccgagcgttaccgaacacccgagcattaccgtacaccccagcgttaccgtacacccaagcattatcgtacaccccagcgttaccgtacacgcaagcgtcaccgcacacccgagcattatcgtacacccaagcattaccgctatgatctaaattcttttcggtttcgatataaccgcctaattggcctgctccaactaaaccaaatgtaataagtgctttaattcgatagagcgttctgcctaaatgttctactgtgtcatctttgagtagttcgtatttcttttgtgtagtttgttctgtcatttttaatttcctcgcaataaaaaaccgcctgtattgctacaagcggttggttttcgtgaaaatgttgcaataaaaaagccaccgtaaaaacgatggcttttcttaaaacttcttgattttgttagtacactaatctataatgcacttgttttcagcaatggtgctgaaaacgagctgggtccgaccttaaatctaacccaacttttggagggataacatatgctttaccgcattatcctagttatcattctcttagtaattagcttgccggcttactaagttgaatgaactaagcagggggagaaatctccctgctcttcaaaactgatattaaggatttattatggcattgtcaagaagtgagattgtggctcgcagtgatgcaaaaaaggggatgcaagccaaaacctataaacttccgcaagcgttggtggctgaaattgagttgttagccaaacagtgcggtatctctcaaggattgttaattgctcaagccgttgagctgtttaagcaatcgcagaaaggggcgtaatgccctttattaaaacgccctcaaaactaagggcgttaattaaactcaaaacggtatttcatcatcaaagttatttgctggcagacgttcatcatcagcataaccgtcccattctttctgttttgtttgttgttgctgttttggcttaccctgtggttcttgtgcccagttgttgttactgttaccaccttgcgaactactgagcatttcgagtttgtcggcgataatctcggtggtatagcggtctgtaccgtcttgtgcttgccatttgcgggtacgaagtttcccttcaatgtaaaccttagagcctttctttaggtattgccccataatttcggctaatttcctaaaagcgataatgctgtgccattcggtattttgctttttctcgcccgtttgtttgtcggtccattcttccgatgtggcgacactaattttaacgacggggtcaccgtttggcattgtacgcatatcagggttattgccgagattgccgactatgattactttattcacgcctgccattacatatactcctgaatgatttgttgataataattttgtgctgaggtgagcctttcttggattttggcaatcacttcttcatctcgcttgatggtgacggtggtaattcgcttggattgtggaatttgctctacaaggtcgattaacttttcgctgttgtcgtagcttgagattaaatcaagtggagtggggaagagtacaaagtcgatttgtgcctcttcgcaatcccaaagccacatataaccttgcatttggtagtcataacctgcttttttggctttttcttcggcttcgtcttggaaaaatgggtgagaaccaatgtcccacgagcatttagtgtcaataatgagcttgcgtgacggaacgtaaatatcgcattcgcctgtaatgaaggcgttttctctgcgttctgtgttctttttaagaaccaatccacgagtaaagccacttaatttaatagcttggtcttcgagctgattgcctttttcggtgtacttgttgccgtcaaaggactgatagccgaacaagtcaaattttgcaatttctcggactgcatttttggcagtgtcggaaattttgccagcatctttatctgcttttgagcgtggctcgctcattagttggtggagctgagagcaacggacttttaggttatacattttttccattgtgtttcctttgggtgatgatggtggattaaacttaatttgatgggtgtcaatcattcccttttattttcgagctcttctaaaatcgcatactgctctttgctgaattcatagccgttatcgcataagtcttgcaaagtggcatcaccgctgatgatgttttgcttacatttttcaaacacgtcatcattgacttttaattcggtaaattcagcttcttgaacttcattatcagggtaagaaaattctgcgttttctacatctttgacaaccgcttgatctgccagtaccgcttgttgcatttctacggaaagtggggcttgtttagagagtagcaacttaagaaccgttttgattgccatcgcctcaaagttgtcgtgccatacgccataaccttttttataggtttgtgagtagcgtgcggcgtggtcgtacacgtcttgggtactcatatagagttcggcagtaaattcgttgatcaacttgaaataagcatagtagccgattggtttttcatctttggctggcttttgtttccagtcaaattcaaaaccgtttattgggtcttcagcaatcagttgtttctcgtaaactggcactgcaacaaggcgtttaaattgccctgaccgttgtgccagttgaattaagcctttatagccgagttggaactgggcttccgtctttttctcttttcgattttgatacggcacaatgtatgcaaaacctaagccattttgtagcggtagattgagcgttgctgccatacacgccgcattaaatacactcattggatcggcattgcgaagcattgcgttgctattgacgatttgcagaacgctggtggtaaatgtcgcagcgtttttgttaagcaatgcttgtaatttttgctgtacgtttgggctttcaaataaagtcttaatcgggaatttgttttctttgttttgagttgctggtgtggtttgtgtggtcatacgtcttttctcccaaatagccaagtttggtcttggtaatctcgctctcttggattgcagatgagaacttcttcgcaaaactcgtcccattcatcagggacgacttcatcgttatatttcgcttgttgatgtgcttcaaacttttctagtgcgtcgtagtaatcatctttggtttcgtatcgcattgggtcaggtactcgcattttgttgctcctgagttttcttcaccatttccgctaatgctccgaacatctgcggttcaagtacaatcgtgttggcgttggctcttctgtctagcattaggcggacattgccgtttttatctaccagatagccttttaagccgtaaggggtaaatggtttgcgtttgggctgtgatggcttcggcttcggctcaacttgttctgttggtgctgtttcaatctcaacttgttccgtcggtgctatttgctcaacctgctctgcttggataactgttacttttagcccaacttttttagcttgctcaattacaatcggattatgcccttcgatttcagggtagtgagggatagctcttttaccgactaagcctttttgactgttatatctatcaatggctttgtttaaatttcggatagcaataatttccgatgtcattggtatgccttgaaacactagatgtttatccacccacatttcaccgaagtattttttatttgggttttgtaaaatttgaagtttgatcatctttttgctcctacaatcagtttgttaagttggttttggttatgttgtttaatcagcttcacatcttcacctgtaacgttatcaggcggtggaagatgtagggctaatgcgttgtaatttacctcttcaggggtgatttcagcttgtttgaagtcatcttccgtccaaatcttctctgcttggaaattgctttctacggggagagtagagacaagctcaggctcttcacagccagttaaacttccgcctgtcacaaaggcgataagcaaggcaccgagtaggtatttcaggttgagttttttgataagtgtcttcattttttattccttttgttgaattttgggtgtaggaagccaccgcaggctttcggggaaagtgcggtggggttgggttgtggttaaaatcttgctaatcgttgttgattaagctgaggtaagacttgttcaataaaagggtcaagccatacgttaaattcgtgtgcgatgtcgtaggcttttcctgcaatatcgtttttaacatagcgagaaatgcctaaatcttcgtacagtttacgatgaaatacttccacttcttttgcaaaggctctggctcttactaggtatttggcaatttgttctgcatctaaacctgcaatggtgatgtcttttttactgcggtcaatcgggcggtattgattgccgagtgtgtttaagaagttgataacgtgttcaaacattgtttgcggtagttggtcatacttcgctacgttaaaagtgcttttgagccgagagtagatttcttgccagtgtaatcctgttcgatagtgagcctgttgtaccgcttcctgtatagctcgttgttgctctggggtaattgtaagcggtgagatttgttgttcattttgcgaaatctcacggtcgagaatatccagcacccatttgcggaactctttggcgactttggtatgactgaacattgcgatcaagtgtgtaccgcgtaaagagaacacgcgcactttttgtattccgcctgcggttgacatatcaatgagagcggtcatacaaggagtaaattcgtcttggtggcggttgtaaatatttttaatgccaatatcgccatttgaatatccaagagctttgccaatatctaaagcagataaccagatttgattttgttgattgataaccgaaagagtagtagtttgaaatgttaatgtagtcattttattaatccttgtgttttgttttaaaactcatcacaagctactgcaataactggtgatgaactggctaaggtttgcagtaaccgttacacaaggaagacggcagatctttcgatctccttaaccagtccatcattgactactttttaaagggggtctcaaattgagttacccttttgaaaggtttgattttctgattttcggctataaaaaaatcgccagtaggcgatctatcatttccgccttatgtattcaggtactgcaatacccgactttctgttgaaagtgggtatatcctaaatcaaagggcggtgggtgtcaaataaaaaagcccacaaaatgaattgtaggctttctttaaatttctgttgatttgtatgtaaacatactatataataatctcactttcaagggatagcttgaaagtgagtgcgaggcttaatcctcacgcttgaagaggaaagaaatatgttaattcgcattttccttattatcgtgttacttagtgttagcttgccggcatactaattaaccgatagtaaactgggggtgaaagctcccagttcttcaacacttcaaatcataggattttattatggctctgtcaagaactgaaattaacgctcgcagtgaagctaaacgtgggattgttaccaagtcgtttaaaattcatcaatcagtatcagaacaaatcgaccgcttagccgttgagctaggcatttcaaaaggtaaagtgcttgagcaggcgattgaactcttcgagcaatctcaaaaaggggcgtaatgcccttttttgattttgggcggtgtcaatcccacagactgaaatccccttgagttgtgctagaatgtaagtgctcaatttatattcatcaacaaaaggagatttcagtatgtgggaagcgttgattgcatctcttttttctctcttaaaagaacatttcgaccatattattatgcgtattacaacttggtgcttatcgtttattctttgttggttgtacttgcctttaagctttaaatacggcttagaagcacgtccattgccagcattaccttcttatgctcttgtttatttattctatttgactgctgctactgcattctggcaaggcttttttatcttcttggagataatggggttgatcattgaaaaaattgttaaatgcaaagctattcaaccacaagccaatagggttaaggttgataagcaacaggagaagtaaacatttttttaaggtcatttttattccttactttatataaaaataccagtttatttagcgggtgatttttcgttaagcccaaagcaattcagccaatcgcactttttctttaaattcattgacggattttttagcgtacgtcaatgaataagaatgttctcgtttttcagggaatttttttaggtccgaatgcttgtcttctgcctcttttagcttatgtttgaaatactcaaggctttcaggcatagataaatcaattttttcagccattgattcccagtatgcaattttatcggcataactttcggcttttttcatttcttcaacagccttatccattcttttagcattacgttcaatcaaggctctgtgttgtttttcgctgtgatgtccgatttttattggctcagcaagacttaaaaagtcacgcccctcattagccgcctcacaatattgattactgcgttttgcggcgttatcagcatattcttgataacgttgtgctttcgctgaggctcgagcttgactatccaacccatcacaacggacaaaagagtaaaaataaaatccaccttgttgtttaacgaggttgtgtatttcaacctctgtttcattgccgtatttacttgtcacggtaataatttcgttcttttcgtgctgctcttggcattttgctaaaaatacgtttgggcagaactttgcatatgtattcatttttttacctcaaaaaaacacccacctgttacagtgggctaacgtagcggatcatcattatgattacgggtgttttaagtgcttaccgcatacacttttgtttgttgccattcagaaccgctctccaagacaatcaaggagaaaattgtctagtgttagcaagagaacggttttgaatggcgaccgcagagagactcgaactctcaacctactgcttagaaggcagttgctctatccgattgagctatgcggtcgattttacttgcgtttgtgctacctgattcactgccagtgcttaacctttccacaagtaatcacaccgcttgagctatggctttcacatagcttgttgataccatctcacctttggcaagcggtgcgtttttgtctaaattgtgtcgagatgaaataatggaattagccgcctttttggagtaatctacgcattaaccttgctatttttgaaagcgggttttcagggatatatactgaaagatgtatctcgccatcaacggtcgcttgggacattgctttgactttttcttgcgcctcttcaaatgagttggcataaacttctgttgcccacttctttccgccgaagctataagaaacagcatagcatttcattttttcgtgcataagaagttacctctatgtattttcaaattttccaaggtgttaatggtcagtggtattggcgattgtgtcgcgttttgtctagtggcttgattgatattattgcaacaagccatcaagcctattcagataaatctgtttgtgaaattgatattatgaatgtcaaactcacaaatgctacaacgccaattcgttatatttaaccttaagtcctgttagagcagggctttaaatccgtatcaactcccgacaactacgtctgattttctctttggctcgaactgttgttggtttgattttgcctttgttgcaagcgtaatttgcaatatcaatcatttttttgcttggtctttcaaggcaggctatatctactcttgaaagggtgttagcggtctgttttttgcgattttttgcgaacattctcgctagtctgccagctttacccgttgtgcgaacttctgctttttcgcagtatttgttgcttgttgggttacgtttgataatgattttagtcattgccgtgtcctctgtttgttgccattcatagcgacacttgtctaacatttcctttccgatctcagttcgttgtagataaatccgcattgatgtgagatgttccagttctctataaatgtcgctatgaatagcaattcctgtttgcctcagccccactggtacaggcgaccaaccttgtttggtgatgtgggttattcgtgttgttaaagagcattgagccgtagctcgttttgatgggtgtataatacactatgtattttataagtaaataccaaatgtattatttttcgcaataaaaaatacaaaatgtatttaattgattgattttaaaggaaaataaattttgtgaagtgtgtttgattgcttgttttttaatcatattcctgatgtcgggaagatgtttttgcaaaaaaatgatgaaatgtgaccgcttgtggtgtgttaggtggggtagttaatagtagtatggagtagttagtagtagattttgggtgaggataatacttgtagaagtggggtaggggataaaagaaaaccgccacggtgggcggtttaaaagagttagataaacgagttcgacatcatgctgtcgatttctgcattaaaaatatcagtatcaaaattaaaagactcttgccaagaaagataagtagatacttttctaaaatgatgtcgatatggagataatttgcttaatagtaaatcatatcgtttatatgttatctccatattttttaatgcttcagatggggttcttgcacttttactccaaacggcatcttgatgcgaaagcctatttctaaaatctctaacatctcttaaatcattaaagagctgcggaatggtattaaaacgattattaaatatctttcggtaaaatatattgttccaatacaaatagttagggttctttcttttgttattatttatgagatttacccaaaaaccgaaagtcatatttgcaataatatcatcagctgatatattttgttgtataagcctttggtaagcgtagtttgtgttattgagatgctgtaccgaataattgggtggaagagtgttatttagtagtttgattaggcaactttttaattcattttgactatatggagataactttgttgtcttatcaatggcaagaaaacagaaatgacttaataagtcattattctgcgtaagattttgttttattatttgtgtcatttcatttcttacactaatttcaatttcttggataagtgaagaaaaaatagatgcacgatgttgcaaggctgtatatatgcaaatagtgcgtttagacagagagaattgtaattcacctgggtacgcatttttacatagagcactgtagggcgctaatcggcttttcgatattgcattaaaatgttgtaatactgacatatcttctaaaaaattattgacaatagcggaatactttattaatctagctacatctggcaagttgcccggtgggcgtagggtaaagcttacgtaccttcgataacctataaggcaggatttctatcctgcctttttcattttaaattagctcgtaaccatgatctcaatgtttcagttgtccatcgagggtaactacctatatagacatcaggtttagcaaatttgtaatgttcagttcgttctaacgatgagttaaacattgccctgccgagctctccaaatagtgagtttgtagggatttgatatttggggtctgcattttttacccattgatgaaaaacttctataggaatacctagacgagaggctatattatccgcagttaaaagtggattccttcccataataatttcatcaatcaatttatctttatcaaagtctcctttttgctcttgtaagagcatattttttgctgcttttaatgcagaagtttcttctttcctaaatgtgtctgcaagatctgaatttggtagtttgatttttctcatgttatttcctttgtatttttacaataaatttactactatttcccaacaagattcaacgtggctctacaaataacccctatgctcaaccgccactcctataatacgaatatcttgtttcattgagctaagcgttgggaaatcttgatttaatggcactagctcaaaatgtggattgcctgatggtgataactctccaagctcacgataacgttttaaggtcgcttcgccattgccatttactgctgcaacaaaatcgccaggatgtgggcgttttctgacatcgatcagcactaaatccccttcgctgaatttaggctccatagacattcctgacactcgtaagaagaatgcatctggacctgcgtcaatttccgtgtcgatatagtcgtacccttctgtatctcgatagtcaaagacttcagtccacgtacctgcttgaattgagctaatgagaggataagctcgagatttttttacagaagttggggttatatttggatcgaaatcctcaatagtaccatcaccatttaagataaccttattcactcctgttagatttatcatttgagcaacttcatttacattaggcattcttcttcctgtaagccaatgaccaatagctccctgagtcttccccattgattctgcaatatcatcttgtcttagattttgctcttgcattttttcacgtacatattggttccattgttttttcatactacacccacctgaacaataattaactaattattacttaccgtattaaatattcaaaatacaaaaagtattttgtttttgactttataaaataccttatgtattattaatgcatttttaatacaggagctaaaaatgaacagaatttctgagttcagaaaagctgccaaccttactcaagtcgaaatcgctaaattgatcaataaaactcaaggtgcttttggtcattacgaaactggcttgagagagccgtcacttagtacagcaaaaaagattgtgcgagtacttaatgaacacggtgttgcttgttctttagacgacgtttttcctgttggcagttaatttacccaaaggagtgtgcaatggcacgcaatgaattaagcaagtctgcaatgaagattgcggacttaatcagacagaaggcatcatagacgaaagatgctcaagcggcagaatatgttggtgtagatgcatcaacgatttgtcgttttaaggcagaacatttagacaaattctgtgcttaccttgattttttagaattggaggtatcagaaaaaggtttaaatcgtttgacagacagtgaactggatgctctcaagctatttgcagagaagggcgttcatgctattggaaaataaaaacccacgctggaacgtgggttagttacggaggttttcacttatgaatgaacatcataccgagttgcattctagcgaaaaatcgtccttttggcaagagatggagtatcgaaagcgatgttatgccgaactagagcgtcgtaattttgcaggtaacgtggactatgacgagatttttaaccagattgataaggatttaagcgatgaatgcagtagtaaaagttaaagaaacaccgatttttaagttaggcgaaaacagacaatcacaagaggctaggaaagtgagtgttgatgatggatttacggcaattccaaatgagcttctaaaggcaattttacgctcaaaagtattgggctggaaaggctcttacttgttggcaaccattcttaaaacgctttcttggcataaagaaagtgattggtttactcactctcaagtctgcgaaatgatgggcattgaaccaacaaaatatcatgtcaatcaactttcagcagcacgtaaagagcttatcaaagagcaagtcttatttgaagatggtaaaaaaacgggtgtaaatctagatgtttttaactgggaaatggtgaatcccgaaaaagtagggagttcccgaaataatagggaattagttcccgaaattgtagggaataagtatcccgaaaaagtagggaacacaaaagaaactattacaaaagaaaaaataaataatacccccttaccccctaaaggggaatcggctatcgccgatgaacaaccgcaagcggtgaaatgtgaacaacattctgcaaaaccagaaaagattaaatcaccgcctatggactatcaggcggtagctgatttgtataaccaagctaatcagaattcgggttcaagattgccgatggtggaaaaaatcaatgatgctcgtcggaaagggattaaaaaattaatggctgagcttagagagccaagtttggaatgtgctgagctgtatttcaatgcgttgtttgcaagcctgcgtccgtttcatactggtgaaaatggcggttgggtggctaattttgattgggcaattcgccctgcgacggtgctgaaagttcgtgaaggagcgttgtgatgtctgaaaatctgcgaaaaatcacttacgaggtcgaggtaagtaccgttggttctctgttgaatggtggattgacggctcaggcgagagaggtgttgagttggttaaaacctgagatgtttttgacgttcaagctaggtgaaatctattcaaacattcaacgccaagcgagcaaggataatctgattgatatgttgttactgagttctgagtacggtgttcagcttgccgatatggcggaaaccataaaatcagtggtgtctgcatcaaacttaacgggatatgctacgaaggtttttaatttctatcagcgtagagaagtgttgaaagtgcttgtgagccttgctggtgagttgaatttagctcgtgatgaacagttagatgcgattgcaacaaagggcgttgagcatatttctgcgttgctgaataagagtgcgagtgttgcacctacgggaatggggagtttgcttgatggctattatcaactactgcaagacaggcataaacctgaatttaaacggcgtttgttgtttactggtattcaagccttggatgacattttgcaaggcattgatgaaaccgatatttgtgtcgttggtgggcgttctggtaatggtaaaaccgaaacggcaattacgtttacgaaaaacattttagagcaaggtggttcggtgttgtttttctctcttgagatgagcagacaacaaattatggatcgtctgattgccagtgcaagcggtgttaattctgcaaaacttcgtaatcctgaatggttgagtgatgaagattttgctcgaatgagtgaggctacaagtgtgatgaaagatcaaaagctctttgtggtggataaaggagctttgtctgttgaagagattacggcgatcacagaaaggcatttggctgagcataaaaagttaaatgcagtggtggttgattatattggtttggttaatcatggggcgttagatgggcgagtgaaccgtacttatcagatcggagaaaccgtagagcgattaaaggcattttctaaacaagttcacgtcccgtttattttactttcgcagttaagccgagatgcagagggttctaccccaaataatgcaaacttgagtgattccaaggcgttagagaatgttgcaagccaaatcattatggttcacaaccagcgagataaggaaacaaatgaacctgcgagatatacgcattggattgtgacaaagaaccgtaacggcaaggttgggactgcttatgttgagttccaaaatggacgatttattgagtgtgatcaggcattagcttgggaatctttccagaagaaaaatgaacaacagagaagagcgaataaggggttttaggtgagtttggattttattaagaaggtaggtgggtattttagaaaagagcaggttggtaggtaaggaggttgataggtatggagcaaaggttggtaggtatggagcataaacaaaaatactttttacgcactgagaaaattaaaaacaatgcccttgaatttgtgaaagcgttgccaatagatgagaaaaagccgttagtggttgaagtgaagcctattactcgcaaccttgagcaaaatgccaaattccacgcaatgtgcggcgatattgctaaacaggtgcaatttaacggcgaatggctaccgcttgaagcgtggaaggttcttttaatttctgctcacgcagaagcaacgaaagaaggttcttgtttggtcacaggattggaaggcgaattagtgaatattcgtgagagtacggctcaaatgagcgtaaaacgaatggcaagtttaatcgaatatgcaacttcgtggggtgtttctaatggggtgcattttaatgacagatggaatttttgggggatgaaataacctacgcttagtggttaagcgtaggtgtaagcgttaagcggttaagattttatccgctgcgattttagctaagaagttgctacggtttttatactctttgtgaaccgcaacaaaatcatcaatgcgtttgatgagatagctagggagggtgatgttgatgcgttcggcttttccgagtaaatggctaatatcaacatcaacaaagccgaaaaagaagtcatattctgcaaaatcagggtttttgcggtggttatcaatggaggttggcatcggaatttcttctccatcttcaactaagccttcaaggtggaacacgatggcttctttgacattttgatatgcttcttcgagggtatcgccagcagagaagcaccctggaatatcaggcacgataacgccgtaagcgtgagtttcgtcacctggttcaattgcaattgggtataacatattttgtccttgtggttatagcagggctattttagccccgcttgtttaagtattgagagttcagttcctttttttaaatcctttttcggatgaggcactgttactcgcccttgtttagttggatgtttgaattgatggtggcttccacttgttgcaactaagtaccaaccgtccgcttcaatcattttaattatggttttgctatccacattattgtgctcctttgttgtttttcatgtgtgtattatacttatttttatgtttttatcaactgtttatatgtaagatgtgtattttaggtgaataaatgaaattttactgcccaaactgccaatcaattcttaaagactggcgtaggttttctgaaaagtcagagattaataaggagaagccgtttaagtgtactggcttgaagtgcggtaagcggtggagtgagaaagaattggaggcatttaatgataaagccgaaagtgaaaaagcgtaaatgcaaatgctgtggtggtgagtttaagtctgcggatagctttagaaaatggtgtagtgctgaatgtggtgtgaaacttgccaaaatagcccaagagaaagcacgtcagaaagccatagaaaagcgaaatcgagaagaaagggcaaagattaaagcaacgagagaacgcttaaaatctcgttctgaatggcttaaagacgctcaggctgtttttaatgaatacattcgtttacgagataaagacgacccttgtatttcgtgccggcgttttcatcaagggcagtatcacgctgggcattatcgcacggtaaaagcgatgccagagctgagatttaatgaggacaatgttcataaacaatgtagtgcttgtaacaatcatttgagcggaaatatcacagaataccgtatcaaccttgtgcgtaaaatcggggtagagcgagtagaagcattggaaggctatcaccctcctgtgaagtggtcggctgaggattgtaaggaaattattaaaacgtatagggcgaagattaaggggttgaagcgtggcggataaactgttggaagaaccaaagcaagtgtggattgagaacttgttaaacctttggggggagtgggcatttagtgggttggattttgaaagccgtatgaatatgttggcaagattgatgttacaagccgaacctagccgtatttctaaacctgttcgggagatgtgtgatgatgagttggggttagtgattagttctgtgattggttattgcattaaaaatccttgtccgcaggattataagtatcttgaggctaaatatgtgtatgggttatcggtgtatgcgattgcgaagtatcagtgggagaaagataagtctaaaacgttacgaacttggcagcgtaaagttggagaaagtatcaaagcttctgagtgggttgttgcaaagtttctcgatcttgctattaaaaatcataaaagtggagcctctcccacaatttgtgtaaatacctgtttctgagataatacattcagacacaggtattttattatgaacgaaaaacaacttcacgccttggcagcggaatttgccaaaaacctaaaaacaccagaagacctcaatcaattttcacggatgctcaagaaaatcaccgtcgaggctgcgttaaatggtgaactgaccgaccatcttggttatgaaaaacatcagcctagaaaaggtaaaaatgcacgtaacggttacacatctaagaccgtcatttgtgatgaaggtgagatagaaattgagacgcctcgtgaccgtgattggattgctgaaaatgaaggtgcgaagttctgggcaaatgtgctgacagagcttcaaaatcgaggcttaaaagacatttttattgcctgtgtagacggtttaaaaggcttcccagaagccatcaatgcagtctatcctaaaacgaagattcagctttgcattgtgcatttagtgcgtaacagctttgaaattcgtttcgtggaaagattacaaagccgtcaccgcagatttaaagcaggtttatcaggcctcgacggaagcacaggctcgcgaaaatctgaccgcactttcgcaaaaatggcaggcaaaatacccgcttgtggcgaaaggctgggaagataactgggcaaatattgccacattttttgattatccggctgacattcgtaaagcgatttataccacgaatgccgtggaatcgcttaatagcgtgattcgtcgcgtgattaaaaaacgaaatgtattcccgacggatgattcagttttcaaagtgatttggcttgcgattaaagatgcatcaaaaaaatggacaatgccgattcagaactggaaactggcgatgaatcgatttatgattgattttggtgatcgcctagacgatcaccattaagttgaaatgggtgtttacacagaatttgggatagggtcaacaacagttgtataaatttgggtattattttgtatacaatgtttctttatttgtctattataccacttttaaacaatattcgcttcggtttatttcaataaataaaggggcgacagcccctttaactttatgctcctagcaatttattcatccgtttaataaacgccgttgcattttccaatgtgccacgttcagcgagtaacgcttgttcaaacaagagttcaatccagtcgttaaattctgcttcgtcagcaatatcagctatacgttttaccattgaatgttcagggtttaactcgaaagtatatttcacttcaggggcttgttgtcccattgcggcgaacagttttgccatttgcgtggtcatttcatcgctgtcagttgaaacaacggccggcgtatcggtcaagcggtgagttaggaccacttttttgacacgctcgcctaaatagcctttggctctctctaagaagctcgcaaattcagcttcttgtactttttgggtttcttcttcctctttgtcagcaagatcacctaaatctaaatctgatttagtaatactttgtaatggcttgccgtcaaattcggttaaatggctgataaaccattcatcaatgcggtcagaaagtagtaagacttcaatgccttttttgttgaacagctctaagtgtgggctgtttttcgctgcttgatagctgtcggcagttaagaagtaaatcgctttctgaccttctttcattcttgcaatataatcgctcaaactgaccgcttgttcgctactgtcagtatgcgttgaagcaaagcgaactaaggctgccacttggtttttatttgcgaaatcttcccctacaccttctttcaagactaaaccgaacgcattccaaaattgttgatattgttcaatgttgtctttcgccagtttttccaacatttgtaaggaacgtttagttagagctgtgcggagtgattgggtgactttgttctcttgcaaaatttcacggctgacattcagtggtaagtcgttggtgtccaacaacccacgcataaagcgaagataattcggcataaagacttccacatcgtccataataaacacacgttgcacatagagttttaagccgtgtttttgttcacgctggaacagatcccaaggggctttacttggtacataaagtaggctggtatattcttgtttaccttcaactttattgtgcgaccaaattaacggatcggcaaaatcgtggctgatatgtttgtagaactctttgtattcttcatcagaaatctcatttttagagcgtgtccagagtgcttgagctttgttaattttttcccatttggtgccagtttctttgccttcatcgtcatactctttggtttgaatttccaccgctaaaccgatatggtcagagtatttaccgataatgtcacgcaaacgccactcgcttaaaaactctttttcatcatcacgcaagtgtaaaatcacgtccgtaccacgtcctgctttttcaatatcggcaacggtgtaatcgccttcgcctgccgattcccacaatacgccttgacttgcatcactgcctgcggctcgagtgcgaacggtcactttatcagcaacgataaaagaggagtagaagccaaccccgaattgcccgattaattggctgtctttcgcttggtctgaaccgagtgcatttaaaaactctttggtgcctgatttagcaatggtgccgagatgatcgatcacttgctcacggctcataccgataccgttatcgctgatagtgattgtgcctaaggcttcatcaatactgatacgcacacgcaattcaccgtcgccctcataaagttcgggttgagaaagagctttgaaacgcaatttatcagcagcgtccgacgcattggaaattaactcacgcaaaaagatctctttattagaatagagtgagtggatcattaattgaagcagttgtttgacttccgactgaaagccacgggtttcttggtttgtactcataattttccttttatgtttatcacaaaaaataacgccctactaaatagggcgttattcttaaatttcaagggaattatttggcattgtgtaacattataacgaaaattattcatcttccgtaaaacgttttgctttatatttcgggttcatcaagttttcgaccgataaaatatcgtctaactgttcttctgtcagcaagccacgctctaacaccacttcacgcacgcttctgcctgtggttgcacagattttaccaacaatatcgccttcgtggtgtccgataaacggattgagataggtcacaataccgatagagttaaatacataaccttcacaaatctctttgttcaccgtgataccgtcaatacatttatcacgcaagttcacacaagcatttgccaagatgtcgatagactcaaacatcgcttgtccgataacaggctccatcacatttaattgcaattgccctgcttccgcagcaaaggtaatacaagtatcgttaccgataattttgaagcatacttgattcaccacttctggcacaacagggtttactttcgctggcataatggaagaacctgcttgcaattcaggcaagttgatttcatttaagcctgcacgcgggcctgatgaaagcaaacgcaagtcgttacaaattttagacaatttcaccgccgtacgttttaacgccccgtgaaccatcacataagcaccacagtcagatgtcgcttcgattaagtgttcagataaggtgcaaggtaactgggtgacttccgcaaggtatttcactgcaagcggtgcgtaaccttctggcgtattcaaacctgtaccgattgccgttgctcctaagtttacttcaagcaacaactctgcggtacgttttaagtttttcacttcttcatctaacaatacagaaaatgctttgaactcttgtccaacggtcattggcacagcgtcttgcaactgggtgcgtcccatttttaagatatttgcaaactcatcagctttattttcaaagccgtgttgtaagtaaagtactttactaatcaattgcataatgctgttataaacggcaatacggaaccccgttgggtaagcgtcattggtcgattggcttgcattaacgtggtccattgggttgataatatggtattcaccttttttatgccccaataattccagtgctaagtttgccactacttcattggtattcatattcaccgaagtacccgctcccccttgatacacatcagatgggaactgatccatacaacgaccattcaccaaaatctcatcacaggcttgtacaatcgcttttgcaattttcttcggaattgcccctaactcgccattagcaagtgcagtcgcctttttcaccatcaccataccacgcacaaactcaggtacatcagaaatggtatttttagaaatattaaaattctctacggcacgtagagtatggataccccagtaaacatcattagaaacttcacgttcacctaatagatcgacttcaatacgcatattgctcattattgctttccttttatatgttacatatttgtgaagagatcataacgagaagctgacataaaaaatgtgatctagatcatattttcaaaatggattggggcgatataaattgccgtttcggattagtttttttatgataaaaagccctttgagagtaaagggctgaaatatgttctacagatagattaatcgtcaatcgcataaccctatggcgataacagttgattatccaaataggctttgccttcaataagttttaatctatcgtcacagaaccattgcaccacaagggaataatagcgatgttcttgttcataaacacgctcaatcacatcatctaattcatcatcaggataaatcggcacttttgcttgtaaaataatcgcaccgccatccacttcttcattgacaaagtgaatggtcgtaccgtgttcgctatcaccagcctccattgctcgttgatgtgggtttaaacctgcatatttaggtaaaagtgatggatgaatattaagaattttacctgtaaaacgagcggtaaattcaggggtaagaattttcatatagccagctaagacaattaaatcggcttgcagggcttcaatttgttctgcaatggcattatccattgccagattatctgaaaagtcttttttggtaaaaataaaggtagaaatccccgcttgtttggctctttctaaaccgtaagcggtggctttattagatataacagcacaaattctgccgttgatttttccagtatcaatagcatcaataatagcttgtaaatttgagccattgcccgaaatcattacgacaatatttttcataatatcgtctccgttatcacattttctttccatattactatagttatcctattacggtataaactaagttaaaatctaagctcttttcaaaaattctgatttcaataaaagttttccacaatctacattgtgatcaccagcgactagacgaatccctttatatttagttccttttttcagtacttctgaggatcctttcaattttaggtctttaattaagataacatcgtcaccgtcagcaagtaagtttccattgctatcctttacgatcaattgatcttcatcgacttcaacttcattaccagtccattcgtttccgcaatcagggcaaacaaattgaattgaatcgtggtaagtattttcgcttttacaagcagggcaaatagggtaatccataaatatcctcaatagatttaaaaaaacgctattctactacaagtggtaaaatttgagggattttttgtaaaaatgaataaaaaattggggtattaaatgaataccccaacaacgaaaaataatttactgcaacaccgcaatatatttcaacatcaccccagcggcaatcgctgaacctattaccccagcaacgtttggacccattgcgtgcattaataggaagttctgtttatctgcctcaagtcccaatttatttgatacacgagcagccataggcactgccgatacgccagctgaaccaatcaacggattaatcggggtcttgctaaaacggttcattatttttgccataatcacaccgcttgcggtaccaataccaaaggcgataatccctaatgctaaaatgcctaaggtttgtggttgtagaaatttatcggcaattaatttagaaccaacagataagccaaggaaaatcgtgaccgtattgattaacgcattttgagcaacatcgcttaatctttcgactacgccactcactcgcattaagttaccaaaacagaacatacctaacaacggagcagcgtcaggaagcaataatgcaaccaaaatcaacaacacaatcggaaacagtactttctcacgtgtgctaacatttcgtaactgcaccatcttaattttacgttcttgctctgtcgttaaggcacgcataatcggaggctgaattaatggcactaacgccatataagaataagctgctaccgcaatagctcccaacaactcaggggcgagcttactggcaagataaattgccgttggaccgtctgccccaccaataatcccgatagcagctgcttgtggtaaagtgaagtcaatcacacccaaccagtttaaacccaccgctcctaataccgttgcaaagataccaaattgagctgccgcacccaagagcaatgttttcgggttagcgagtaaaggcccaaaatccgtcattgccccaacgcccataaagatcacaagcggtgcaacgcccgaattaattgccacttggtagaactgagccaataccccagaggtggaatctatacaaaaatagaaaaaacagcatatctattcttaattcttgtacaacatctatttttctcttcttcactttgtgtgtgaaaaagttggttgcattagctgtaaaaaagctgcacacttatcaatgtatactccatacatcgcttacatttacagagttgtacatgtcactgagtgacagattttcatttcttgggcatcgcaaatcctctgtgtgtgatatggcatttgcttcatttatctgtctttatttccacaagaatgttgtaaataacatctttgggggtgaatgtagacgatgttatcaggttgtacaaggaactaaaccctcacaggaggaaaatactatgcacattttcaatcaaggtaaatacaaaagcctgcacgctcaagaagttggtgaactcgatgcagttcgtcaggcggttgaacaggatcaggatttccgcccaacctaccatctcgcaccgccaacgggattgctcaacgatccaaatggcttaatctttgacggtgaaaaatatcatattttttatcaatggtttccttacgatgcgttgcacggaatgaaacattggaaacatctgatgacaaaggatttccaaacatttactgaagctgatccgcttattcctgatgagatgtttgaatcccacggttgttattcgggtggggcgattttatggcaagataagattgttgcgttctatacgggcaatacgcgtcgagcgagcgataatcagcgtgtgccacatcaaaatattgctatttttgataaatcgggcaaattgcttgaaaagcgttgtattatcgatcaagcaccacaaggctatacggaacacgttcgtgatccaaaaccttttgttaccgcagaaggcaaaatccgttttgtattaggcgctcaacgtgaaaacctaacaggcacaggcttgctctatgaaatggataacctagaagctaccccacgtttactctctgaaattgcgattaatgattttgataatagcaacgtatttatgtgggaatgccccgatttgttcaaattggcggataaagatctgttcgtctggtcgccacagggtaaattgcgtgaagcgacacgtttccaaaataattaccacgccacttatgcgttaggtcaattcgctggctcaacgctgacagcagaacatattgaagagctagattatggctttgatttctatgcaccgcagactgtccagaatgcagaagggattttatacggctgggttggtttgccggatttgacttatccaacggataagtataaatggcactcaatgctgacaatgcctcgccagctttccgttaaacagagcaaaattttccaacagccagtcaaagagatttacgcacaattgcagaataaagtgtcgttgagtgtgaacgggattacggaagtagaaaacctagacaacgcatatttgcaatttaatgtggaaaatcaaccgcttgtaatccgtttctttgataacgagcaggggcaaaatctgactttccgttatgaaaatgggcgagttaccctagatcgttcagcaacagatcaaacagatctaatgaagcaatttggtgaacaacgctattgcgaagtcgaaaaattagagaatgtcgagatcttctttgaccgttctgtggttgagattttcctcaataatggtgaaaaagcgatgacttctcgtttctttattaaagggcgagagaattgtttggaaacatcaaggctgcttgaaattataagtgtaaatctattaaaagagttttaaatataccgtgtaattcaattcataatccactggtaatcagtggattatgtaatattggaaaaaatttataagggccttttatatttcttaagttaaaaagcatagtagacaaaattgttgctaatgtttattttctaaataggtttaatattattaagctctcgcagaattattttaatgtttcaagaaatgtaataaatgcttctttttgaatagaagacaagttatcccatttttggtttatttctatctcttttaattccttttcagtaaattctgctggaatacaatcttggaaaaaccaattaataggtgtttaaagaaaatagcgatatcaatcaagtgattaacgttgattttgcttgcaccacgttcatagcgtgaaagttgttgctgagataaattgatacactccgacaacttttctgccgaataaccaaattcctttctcttttgctgaatacgctgtccaattaatttatctgtcatttctgcaggaagctgtgccatgatttcgatcaaaaaaacagtagatgacaaagttgaatttagcctattaaccgatggacgtgtgcaagatattaccttgcacaaaacccaattaaacggtaccactttcagcggcaaagcaaccactctattacgagaaggtacttatgaaggtggcttatttggcaatggtgcaaaagaagcagcaggtattgcaactttcagtggcgataacagctacgatacttcattcggtggtattcgttactaattctttgagcagttaaacctagttcgcatttgcgtgctaggtttgaatataacttttaccattcttatgcgttctttctttttactcgccttatgttgttctaatattgtttttgcttccgcaacaacacttgaagagcaattgaaacaagctatttaccaaaataatagcggtcaaatccaatctttactttaccaatatcaacagcagcctcagcaagatttgacattaaagtcttatgcagaagccaaactatcagttttacagcagaactatggcgttgctattcgtatttaccgaaaaatattgagcgaacgacctgaactaaattcaattcgaatggaattggcaaaagtactctttgccgatcgacaagatagcgcagcaagagtgcagtttgataaagtgaaaaacgttggtatggtggagattcgtttcattggtccaatggagcggaaatcagttacagtttttggctttcacaaaattggcaaaatcaaaccgtacttgaatatgaaaaacgccgttttttcaaagataatcctcaagccaggcatattcggacggcatcaacaacgttaatttggtatcgaaaccccgaacagatttttttatgtcagtgccgccttttctcagcaacgcttacaagagcaacaatacagctcagatattcagaatttacgtttaggttggttgcaagaatacgcttttgggatttcaactaaattaaatttctcttttacgcatcgccaatttaaagatcaagcgatattgggcggcatcttgccactcggcaaaactcgccaagatcagatttattcagttttcgcacaagtttggaaacgagattggcatttatggggcattacacctaaattgaatttggaatggcggaaacagaaaagcaatttggatacgctttattcctataaaatgcataatattactcttgcttttgaaaagactttctaacgcccagcagatagcccaagcattcctcagctagaatatgttaaaatgtcgccaaaattaaaagaggaaaccttatgttatattcagtcctaaacgattatattacgctcggcacgccctatcgcaacagcacacattccattaaacacgaacatttagtggtaatgtttgaagatgatggcgaaacaggttatttctatgcaatggatttacatcaagaagcgcaacctgtggtcgatagcttatttgtctatcgtgtcagcgatgtcaaacccgaaaccctaaaagagcctcgccgttttcagatctgctggtcagaagatggctacgaggcatttttgctgttaaatgattatccacacgccgtatttgatttccgtgaatttgttggctataaccataccaaattccctgagccagaattaggcagtatgtggcgacacaaagaaacaacgccagaattagttgagaagtggttaattagttaattaataaagataaagtccctagatgatttgctatctagggacttaacatagattaaagaaaaatataactttaataaatttttttgcctattactttaaatttattgattcctaacgcccccaaaaatcccaccgcttgcaacaacacaatacaaggtcctgtggcgacatcgaaatggaaacttaaaaacacgccccagaaagcactatttactgcagtcaagatggcgattagcaacattcggtcaaagcgtttggcaagcgtgtagcctgtgatccctggggtaatcagcattgccaccactaaaatcacgccaaccacttgcattgcactaataatcactaatgccaatagcaccagtaagctgtaatgtaacactttgatattaaagccaacggtgcgagcgtggctggcatcgaagcagtatagtaggaaatctcggcgttttactaagataacgaataataccactaaggaaatggcgagagtttggtaaaattcattgtcggtaatcccaagcagatcgccaaataagatgtgcattagatgttgatcggtttcgactttggcaaacatcaccaaacctaacgcaaacattcccgaaaagacgatccccattaccgtatcttctttaatgcgactattttctttgagatagcccactgcaacggcacagaaaatgcccgaaacaaaagccccgattgctaatggaatggcaagcagataggcaatcacaatccctggtaatacggcgtgtgagatggcatcgcccattagcgaccaacctttgagcactaaatagcaggacaacacggcacagattagagcaaccacaacaccaatgagcaaagcttgttgtataaaaggaaaagctagcggttcagcaaaccattgatagagtgcgtccattattctcccccttgacaagcggtcagttttgctggattttttgcaaatttgcgtgagagtaaaccatatttaggagcgaagaaaaacgccagtaaaaacagtagagtttgtagtgtgacaataaatccgcccgttgccccatcagcaaaatagcttaaataagcaccaaaaaatccactaaaaccgcccagtgaaattgcgataatcaacaatttgccgaatttatccgttaataaataagccgttgctcctggggtgacaaccattgcgatcactaaaattgccccaacactttgtaatgcagcaacaatacaggcactgagtaagctgaaaaacagtactttaagtcgcatcggcgaaatgcctacggctttagcttgaatttcatcaaaaaagacgagtaataaatctttccagtaaatcactagaaaaaagagtgatacagataaaataatcaccacttgtagcatatcttcatcggcaatacctaagatattaccgagaatgatggattgcacattaacgaacgttggattgattgaaataatcaataaacctaaggcaaaaaaggtggtaaaaataaagcctattaccgcatcttctcgtaattttgtgacggatttaaccgctaagatagcaatagtggcaagaaatcccgaaaagaaagccccgacagcataaggtaaggacaaggcataagctaatgcaacaccagggacgacggcgtgcgataaggcatctccaatcagcgaccagcctttgagcattaaataggcagacaaaaaagcacaaacagccccgattgcaccgcttactacaatcgctttaaacatataatcgtaggaaaaaggttctagcagtaactcaagcattgattattccttatggtctccgagtaactgctgataacgcaagacaccgccaaatactcgtccaagattttcgggggtgaatgtcgtttcgatagatcctgttgctaacactgtgcgattaatcattaccgcttgatcgcaaaaacttggtacagcggctaaattatgggtagaaacaaggattaagtgaccgctatcccgaagctgtttgagtagatcgatgatcgcattttcggtatttacgtccacgccagtgaaaggttcgtcaagtaagataattttgctctcttgtgcaagcgaacgagccaaaaatactcgttttttctgtccccctgaaagctcaccgatttgacgatccgcaagatgagcaatattgacccgctccattgcttcagcaactttttgcttatccacagcagaagggatacgcagaaaattcatatagccataacgccccatcattaccacatcataaacggatacgggaaattgccagtccacttcttcactttgtggcacataagcaacaagattgcgttttaaggcttgattgacaggcagtccgcatagctcaatatttccctttggctgaactaagcccataatgcttttaaataaggttgatttgccactgccgttcaccccaagtaatgcacagattgtgccaccgtcaaggcgaaaagtaacatcgtgaattgccgtgtgtccgttgctataacgaacggtgacatcggaaacagaaagagaactcaggggaatgttcatatttgttaggtaatcctattttgtaaatgcagggcgaaccaaagcagttcgcccaaatcgttttatttttcaaatccagcaacaattgtacttaccgtcacattgagtaaatcaacataggttggtactttgccatcttttgttgagagagagtccacatataacacaccgccatagcgtgctttactctctttcgccacttgtttagctggtttatctgaaatggtactttcgctaaataccactggaatttgatgtttacgcacttggtcgatcactttgcggatctgttttggcgtgccttgttcatcttggttaatcgcccaaagatataactctttgaagccataatctctagcaagatagctaaacgccccttcgcttgtcactaaccaacgttgtgcttcaggcacttttgccaaacgctcacgcaacggctgatctaaggcaacgatcttatcggcataggcctttgcattcgcattataggcttctgcatttgccggatcgtatttcaccaaggcttggcgaatgttttcaatataaatcaacgcatttttcgtggacatccaagcgtgtgggtttggtttatctttgtaaggcccttcatagattgaaatcggttcaataccttccgttactacaaccgcaggtttatctttcacttgagcaaagaaacgctcaaaccagctttcaaggttcataccgttccacaacaccaaatccgcagattgtgcttttacaatatcctgtggcgttggttgataatcgtggatttccgcacctggtttggtgatcgactcgaccacagccttatcccctgcgacattttgagcaatgtcttgaatcacagtgaatgtggtgaccactttaaactgctgggcagcaagtggattacttaccaaaaaaagcatactaagtagtgctgctaattttttcatcgttagtctccttatataaattatggggttttcaggcagcattttatagataaaatttaacctgtcaacaaataaaaatgattctcaataactcggctagatgataatcaacaagctgataaatatgagaatcaataagtattacaaatgagaaagggttgctatttttatctagcaacccgttgattttattattcttttctaaaataccgctgacttttactttcttggcgactttctaagagcctgtgatagttatcaaaacgtatcggatcgattttcccctgctctactgcttcttttaatgcacagcctgggtcatctttatgtttacaatcacggaatttgcaagtacctaataccgaagcaaaatcccgataaccttgtgtaatctgctcggcttctaaatgccataagccaaattcgcgaatccccggcgagtcgattaaatttccaccttgagataagtggtataaacgtgaagccgttgtggtatgttgccctaagcctgaaatatcgctgaccgcccccgtttgagcatttacatcgggcaataattgattgattagacttgattttccaacacctgactgcccgacgaaaatagatgtacctttcgctaaataagcattcaacgcctgcatattctcgcctgtgtctgcggataaacagagtgtctggtagccaatcttttcatagatcgccagctgttgttgcacttcttttcgctcttgttcactcaataaatcaattttattcaacacaattaaggcaggaatgctggcattctcacaaatcactaaatagcggtcgataatattcagtgaaagctgtggcaacacagcggacacaatgataatttgatcgatatttgacgccattactttaataccgtcgtaatagtcaggacgagttagctcattttggcgtgggtgaacagcttcaatcacaccgctaatcccttgcaattgctcacttcccaaacgccacgacactacatcgcctaccaccacattttttaatgttcggcgtaaattacaacggaaaatctcaccacttgcggtttctacatctgcgtgtttagcgtggcgagtaaccacaagaccttgctggacttcccccaacatttcatcttgccattcaaattcagctttgttgatctttttgtgatggttagtttgaatccgacgttgttgattctgagttaagcgacgtttgctcaaaagattgacctgactttactaaaaaataaccgagagctgaccataaaaatgggagctagacgcttccatttttatgtatacctcaattatcttgcacggaaaataattcgccccttacttaaatcgtatggggtcatttcaacggtgactttatctccagttagaatccgaatatagtttttacgcatttttcctgaaatatgggctgttacaacatgcccattttctagttctactcgaaacatagtattaggtaaggtttctaaaattgtaccttgcatttcaatgcaatcttctttagccatttattcctcttcaaattaaatttaagttgtgtcattataaatatgccatattggcaaaatgcgaggtattatactctcccttacctgaattacaatcatttacggcgaaaagctcttcttcgagagtgaaaacgttgagtttgacgttttaattcaataggtataaagtttgacgaaactgtttttgttgtatttagctgtaaaaaataatagaaacaactaacaaatagccctccagacataaataaaataatcaactgaccataaagcaaatgaaataattcatttactttatgttgtgttgtttgcccatattgagagtcaaaagttactcgtaaaaacccaattaagtcatcctgtgcaaaaataggctctacaatttgttgggtaagtgccggctcttgttgtatcttgtcgtttactctcgggttaaattcaatcgcattgctactatgtgcaactaaatttcctgatggcgaatacaaattagcatcaatgacaaacgcttctttagcaaaaacatctaatgcttcaactaattcatcattttttgcgttttttactaacatcaaggaaaacaattttgcctgttgtcgtacaagtaaatgagaaagatttgttacttggttaatcccagccagctgtgaacctactttgaaatggtttataccagtcagtattatccacacaatcattaaacaaattgccatgatcacagcaataatgctactctttattagttgctcacgagaaatatacataattgtccccataaaattagaagatgattctaacacggaattttgctaaagttagtaaaactcactataaaggtttgaaagaatcatgtcacatatcttttttatttacagtaagcagcttacagctgaacagattgcccacttcacacacataagttctactatttttgtaaaacaagtggagtatttggattaccatgttgctttttttagaggagatttgacagattctctacgagagaaggctcaaaccatacaagctgattttagtaggttagatattcttccttgcattaaaaaagaaggtttacttttaatggatatggattctactgcgattaaaattgagtgtattgatgagattgctaaattagcaggaaaaggagagattgtttcatctattacagcaagagctatgtgtggagaacttgattttgaagaaagtttacgtcagcgtgttgcagcacttgaaaatgcaccagaaagtatcttacaacaagttcgtgaacagttaccacttatggatggttttgaattattaattaaaagtctgaaacaatatggctggaagatagctattgcttcaggaggatttgactattttgcagactacctcagacagtcttttgatctagattattctgtgtcaaataggcttgaagttattgatggcaaactaacaggtcaaatacttggcaaagtagtagatgctcaatgtaaagcagatacgttaatggctctagctcacaagtttggtattccacaagagcaatggattacagtaggagatggagccaatgatctactgatgcttaaacatgccagtttaggcgttgcactacatgccaaacccaaagtacaagaacaatcggcattcgtagtaaactttggagatttaactgccctactgttactattaaaagcaaaggaattgtttgattccccataatgtctttagatatatatctatatttcttttgtctatcacaccccaataatcaattgagacaccaatatggcatagtaacttttgtttactatgcctcttaatatcagattacttcaataaatcttcatttttagcgtgattccatttaccacgctttttatccatatactgaaaatattcgttagtaaaagtcccctgcacgcaagtgattttatctcggcgacgattaaccgtttttccttccaatgccatatttaaggtgactggtccagttaaagaaaatacgccaccatcaacccgacgttgctcaatattatcgacaataatctctaacgtttctttcaaaaacgcatttcccttttcactggctaaaaagaaattggtgtatttgtctcggcgagtgataacaacttcactatcattttcaccaataattgaagcgagattccaaactaaatgcccatcaatatccatatagatgccaccttcattatataaggtgaaaatacgccagaaatctgcctgcgcagccccatccgtaagtttactatacgcattaaaagtacgctcatctgcattagctttgatatattccgcccgttcttcagtgctaacataacggtagtcataatctcgtgacaacatacgattaactaaataattacaatacactggtaaggttactttgttgctgtaattagtctgccaaatgaccttagtaatttttgttgatttagctgatacgcttttagctggactaaattctggaatggtaaaacgctttttcggaaataaggcgtgaaacggatagcttaacgttttgacgatattccctaataaacgccataaaccattagcaatcacaataagcatttcatttttgactggtttgttcatattagctccttttggataggaacgcatattaacattttatcgatattgaaaaaagcaagcgggcagattttgcgataaatttgcaagatctgcccgcttgtgaggagattaagcaatcgtcatttgccctgcataaagaacaaagtaacgtaaacagagaacaccgattaaacctaaaacagcaaggaaaaggataaagcctttttggtgtttcacttttgctggtgaaacaatgttaagtaacattggaataactaaaccgatagctacaacgcctacccagaacattttgccccagtagcctgaaaaggttaaagcgttatccgctgctactgcactttgtccacctttagcataaaggtaagcaaagaagcctgctaaaagtaacatttcaataagggcaactggcttttcaaacttgtgcaagaaatgtacttcgtgactatccgctgcgactttgccaaccaccaagatcgccacaagaagtgccgcaataccagatgaagttcctgaagccaagaataagactggcaagacagggttatttaacattggatagctgattaattcagataataagaaacccgtataagccccaagtgcaagggatagtaagatcaacaggatttcaatcaacgaggtgaatttcgctgcaatatcaattaatccaaaagcaaatttcggaataaacccaaagccacttaaccagttcttaaagatgatcgccagccaaacgactaataccgccataaagacttggaatagcattactcccatcgacattaccgaatcaaactggtagttgaacatcagataccagaatgtccacggacgagccaagtggaaaatcaataaggttaaaccgatgatggttgcaagcggtgacattattgccattgtgcgaataatccaactttggcttggatcagctaaattcgctttacgcttatatagcactgctaacaaggttgaacccgcagatatcccaagtaaaaagagatagatcgcaatggttgaatcccatacaagatttggggtttggaatggaacatagtcgttcattattttgcctcccctttcttaatatggtaaagatttggttctgtgcctaattccatttttgtgcgataagttggtttttctttgattaaacgagaaatatcgctattcggatcgtttaagtcaccgaatgttaatgctttggttggacagctttctacacaagcaggctgtttaccttgtgcaagatttgtatctcgacagaagttacatttatcggcagttttcttcactggctcaatatagcgaacacgatatgggcagaccgcaatgcagtaagcacaaccaacacagagatctggattaacatcaacgatgcctgttgctttatcaatgaaagacgcacctgttgggcaaacactcacacaaggagcattgctacaatgttggcaagattgacggaaaaattcatattttacgtttggaaattcgccataaggttggctacgaataatttctaaacgggataccccttctggcactttgtttgtttcacgacaagcatccatacacgcagtacaaccgatacaggcttgctcatcgtgcaacatcgcatagcgaatggttttactttctttctcagtcgcaagggagagctgacttgtggcaagccccgttgtgcctgccacggcaatcactgctcccgcccctgagatgaaatctcgacgggaacaactcatttttgatccttagcttccgcttttttaaacgtacctttgtgtacttctgtgtgacaatccacacagagttttacacgctgtttagactcaattcctttcattggttctttttctgggtgtagtttgtggcagtttacacacgcaattttattagcgtgagtgtcgtgcgcccagaatttttcacgcaatttgtcagggctatggcaagcaaaacagacttgattttgctcttcgactgaacgctctaaggctggatttctcgctttaccatgagcattgaaacgcattacgtctttcacacccttacggtgattttcagaaatattgccgtgacaacttacacagttaagcggtttgccgttattcggactaaccgtatctttttgaaagtgcttacctgtgtgtttgaaggtagataaatgtccgtggcaattcacacaataagtattcggatcacgacgagagtctttagcaatagttgcaccatctacattatccaacggattggtccaaattggctgtggttgtgctggcatttctgccaacacagtagaagatattgcaaagaaactcagtaatgcaaccgcttgtagcttaatcattgagaaaatatgtttcatagtagcctcgacttagcaaattattttgcgtccgcaggtaataagcctttctctttcgcttctttttcccattgtggtactacggtgcgtaagaattcttctttcgctgctttctctttatcaaagtcgatacctacaactttttgtgctttcactttcgttgaaatatcagggaactcaatcggagtttgtacgccgtgtttcgttaagataactgcaagtttagtacgagcatcagctgcacgatctaagcctgttccgataacgtgaagaattacatcaggtgcgtgcatatgaccgccgtggcctgcagctgagtagtcccaacgccattgtgcgtgacgaattgcttgcaacgcgtctttcatttcttcttcagttgcacccgcttcccaagctcttttcgcttcaaagtgtgctttaacaagctgatcttctaaacggatcattacgtctttgatctgttttttatgctctttcacgcgagcttgtaagctctctttgctttgttcgtgacaggttttacaagtatgctcaaagttatcaaacggattgccgattttgtgatcggtatagactttaccatctttagtttctacttttggcatatggcagtcaatacaggttacgccatttttaccgtgtgtgcctaacgcccaagtttcgaagtctgggtgttgtgcttttaacattggagcttttgataagccgtgaacccagtcagtaaatttgatttcatcaaagtatttttcaatgctatcaacatctacacctttatcccaagggaacgtcaccgctttttctttgcctgcaaaatagtattcaacgtgacagttagaacatactgctgcacgttttccgtgtttatccagtgtatcgaatttccaaccgataacttctaacgcacgcaaaacgtgtgggcgagcaacacgcagtgccgctttgccatctttaaattcttgtgaagtggtatcgtggcagtccgcacaaccaataggattgacaatttctgaaccatatttagcccattttgcatcaaaataaccaacttcgcctttttctgcgatcatacgtggcacatctggacttttacacgcccagcacgccataggctgaggaccagaattttcgtccattggcgcaccagtacgcaaaatattacgcacatcagtaaccgcatagaagtgaccacgaggtttattgtaatcttttgagaacgcataacctgtccacaaaaccactaaacgaggatcttcttctaaagcacttgttacttctttagattcggctgttgcagcccaagattggtactgtaaaggataaagttcagcaaatttatggttagctgattcaattttcacatcaggttttgggccttcaaactctttggcttcccctgcccacgcagcttggaaacaccccaacatagccattgtcgcaacaaggctgttttttaacattttactgacttttttcacgcgagcctcctcacacataactcactgcaaatgataatttttcttattaaaacaataagatagatataaataaaagatgtatgtgaaatgtataaaaagaatgaatgttttactagaggattctgcaatttgtttgaaaaaaatcaaattgcaaaaattgaatggtgattaaatgagctttgttaggcaatctttctctcttatattttctaactgattgattatcttctagttaagaaaaattttattcatgttaaaatagcctgcctacttatatgacagcagaatattatcaacgagatataaatgtcccgaaaactcacccaattttccgcttgggcaagctatgttggcttgctctcactctatgtgttcagtttctgggcattatttgaacatagtgccgatgaaaccttttggtcgtggcaagaaacgtggcaaattttaaaatacagcaccttgcaagcaacgctgtcggcgagtttatctttgctgtttggtgttttgttggctcgtagctttttctacctacgttttcggagcaaaaccttgctctataagctgatttcctttgcgtgggctctgccttcgttagtggtgatttttgcattaatcggggtttggggaaattcaggttggatagcccatctcgttcaagcggtgggattgtcgtgggatttttccttgtacggtttacaagggattgtgttagctcatctgtttttgaacattccccttgtcgcaaagtattgccttgaagggctacatcttattccaacacatcagcaccaactggcgaaccagctcaatctgtctgggtggcactattttaggattgttgaattgccgatattaaaaggcattttgccctatgcctatgcgacggttttcctgctctgttttaccagcttcccaattgtattaatgttagggggggggcctaaatacagtacgcttgaagtggcgatttaccaagcggtgacttttgagtttgattttgcgaaagcggtgatgttaattatggtgcaaatccttgtagggattggcttacaactgataatggattgggtgacacgctttaattttcagcgagtgaaaacacagtctgtatcgattgacatctggacggcacagcctaaaggtaaggaaaaatggctactacaagcggtgcttttcggggcaatttttaccattttattaccgcttgcaaatgtagtttggaccgccatttcagtatcaaacttttggcaacggctcttttcgccaacactttggcaatcggcaagctattcgctgttattaagtcttatcgcatcttgctttgtggtaggcattgcttatctgctcgcccttgaaactcgccagcttgcttatcataaacagaaaatcaagcaaagcattctcgcaggtgtgagtacttatcccctgattttaccgatatttatgttagccgttgggctatttttactgctgttcaatgtgcaattaaccacttggcaactgctattgttagtgggaatttgtaacggtttgatgttactgccttacatctatcgcttgttgttttcagcaatgtgggaagcattggtttctcacgataaattggctcgtagtttgggattaacagggcttcgccgttggtggattgtggaaaaaaattatcttatccgaccgcttatcaatgcttttgccctgtcaatgtcggcaagtttaggcaatttttccgtgattgccttttttggtagccctgactttagcaccttaccttatttgctttaccaacaattaggcagttaccgtactgaagatgcgactgttaccgcatttcttttaatgctattttcagcttttccatttttctttatagaccagaataatcgctaaagacaaggcaaaacctcatacttctgtaaaataatttgtttgaaattttcactacaactcgcccagtcaattaaatctactttaaatggcaggtctgagtcagagaatgctaactcaagctgagcctgctgacgaatggttaaaggggtgtcggtaatcaatgcaaggtcaagatcagaaaatcgctttgccgttcctttaattcttgagccaaatacccatacgggaatattcggcaaatgtgtcgctaaaatgcgttgaacaaggtgtaactgttgttcggtcaaatctatcattggctacgtttttgaagttgagagagaagatagtggctactcgctaggaaatggctaatgccttgatatacttgcagagccttattttcatcataagtatgtgatgtaatatttcgcattttacggaaatctaaccattcttcaggattatcaattaaaccaaattgagctgatagacgtaaaatatctctaaattctgtgctgtctatatcggtatcattagaagcaatacttttcagctgacgcttcatcattttaattgataattcataaacaaactcgaatttttgaattactcctgcaataagtgtatcttggataattggatcttgagcattaaaccattcttgattatctagatgaataattgttttttgcagggaagcaaaggctttttcaaatgctgaaatatctaatatttccatctttttgttactttcctataaatcttaagcggtcagatccgcatatttttttgcaaatccgaccgcttgattatagctgattagccaccgaaatcatctaataagatgttttcatcttctacaccaagatcttttaacatcttgatcacagaagcattcataattggtggaccacacatatagtattcacaatcttctggtgcttcgtgatcttttaagtagttttcataaagcacgttgtgaataaagccagtgtaaccatcccagttatcgcctggttgtggatcagaaagcgccacataccatttgaagttgtcgttctctgcttgtaagctgtcgaaatcttctacatagaacatttcacgtttagaacgagcaccataccagaaggtcattttacgtttagacttcagacgttttaactggtcaaaaatgtgtgaacgcattggggccatacctgcaccaccaccgatgaagaccatttctgcatcagtatctttagcgaagaactcaccaaatgggccagaaattgtgactttatcacctggtttgagtgaccaaatatatgaagacatttgacctggcggtacatctgggttatttggtggcggagttgcaatacgcacgttaagcataataatgcctttctcttctgggtatgaagccattgagtacgcacggataattggctcgtccactttagacacataacgccataggttaaatttgttccagtcttcgtgatattcttcgtcgattaacgctttgtaatcttcatatctcacagtgtgagcaggtgcttcgatctgaatatagccacctgcacggaatggtacttcttcgccttctggaatttgaagtttaagctctttgatgaaggttgctttgttatcattagagataacagtacattcccattttttcacaccaaagatctcttctggaagctccacttccatactgcttttcacattaacttgacacgctagacgataaccttcttttgcttcacgttttgtgatgtgtgaaagctcagttggaagaatctcgccaccaccgctttttactttaacgatacactgaccacaagagccaccaccgccacacgcggatgaaacgaagatacctttacttgctaaagcaccaagtaatttaccgccagctggcaaggtaattgctttttctggatcatcattgatagaaatcgtgatgtcacctgagtccactaattttgacttagctacaaggataagtactgcaagcattaatacaagggcagtaaataccacgataccgaaaataaaattatccattcgatacgctccttataatttaatgcctgagaaagacataaagccaagtgccattaagcctgcagaaataaaggtaatacctaaaccttttaatcctgctggtacatcagagtatttcattttctctgtgatacctgctaatgccacaattgccaacatccagcctgtacctgcaccgataccatataccacagattcagcgaagttatattcgcgttgaaccataaatgatacagcaccgaagatcgcacagtttacggtaataagtggtaagaagatacctaatgcactatacagtgcagggaaaaacttgtccaaaatcatttcgagaatttgcactagtgcagctataacaccgataaaggtgataaagttaaggaaagttaaatcaaccccttccactaatgcaccatcttttaagatgttctcgtaaacaatttggttagctggaactgcaatacctagtacaacgattaccgcaatacctaaaccaaatgctgttgaaactttcttagataccgcaaggaatgtacacataccaaggaagaaagaaagtgccatattttcaataaatatggacttaacaaatagacttaaataatgttccatcttatttctccacttgctctggtttccaagttcttaagccccaaattaagaagccgatgatgaagaacgcacttggtgcaagtaggaataaaccatttgcttgataccaaccgccatcttgaacagtttggaataccgtcataccaaagagtttacctgaaccgattaactcacgaatgaaggcaacaatcacaaggattgcaccgtagcctaaaccgttaccgataccatcaacaaaactttctactgggccagatttcattgcaaaggcttccgcacgtcccattacgatacagttagtaataattaaaccaacaaataccgagagctgtttagaaagatcgtaagcataagcacgcaataactgatccacgagaattacaagcgatgcgataatcgccatttgtacaatgatacgaatactatttgggatatagttacgaatcatcgcaatgaacatacttgaaaagcctattacaaagcttactgcaatacccattaccaccgcagtttctagttttgttgttaccgcaagtgcagaacagatacctagaatttgcaatgcaatcgggttgttattcacaacaggtgataacaagagatctttaagtttattgcttgccattagttagtccccgcttttaatttcgctaaatatggaccaaagccgttcgcaccaaaccagtatttgaatgaaccatcaacaccgttagaggtgagtgttgcacctgataagccatcaatgccgtgatctttatcagctgaagcaccttttgcaatacgaattgcggattcaccctgagcattttgtaattttttgcccacgaaattttgttgccaacgtttgttttcaatttcaccaccaagtcctggtgtttcaccgttttcgtagtaagtgatacctttgattgtattgccatctggctcaacagagacaaagccatacattacagaccataaacctgttccgtagaatggaagcacgatttgatttacttgtccgtttgcatcttttacaaggtaaatttccgcatattttgcacgaactctaatacctgctttatcgtctgctggattgatagcgatactttgagctggatcttttgcagctgcttttgcatcaaaattcgctacaccttcaacataatcacctgtcgcaagatcaacgattttagattcgatatttttcacataaatatctttaatttcgcttttcttcgtgccttcaggtaataaaccagcaacacttaaaatgtttttctgtttatcaagggctttttgttcttcctgtgccgattttaacaacaccgcagaacctgccacgataagagaacagattaaacttaataaaatcacgacggtaagtgttccgccaatgctatctttattaaacttagccattgcgtgccttcctacgtttgatgttagcctgaaccacgaagtagtcgaagattggagcaaacaagttagcaaataagatcgctaacatcataccttctgggtacgcagggtttgctacacgaatcaacacacacattactccaattaagataccgtaccaccatttacctttattagtaaatgctgctgatactgggtcggtagccataaagaacataccgattgcaaaaccacctaacactaagtgccaatgccacggcatcgcaaataatgggtttgtatctgaaccaatcatattgaagagggttgcagttgcagccataccaatcattacacctgcgataattcgccaagatgcaatgcgagcaaatacaataatagcagcacccatcattaatgcgacagttgatacttcaccgatagagcctgggatattccctaagaatgcatccatccaagtaatggtttcacccgttgcaacgtgtttaagtgcagcttggccaccgactgcccattgagaaagtgctgttgcacctgagaatccatctgctgcagtccaaactaaatcacccgaaatttgtgctgggtatgcgaagaataagaacgcacgacctgctaacgctgggttcataaagtttttacctacaccaccaaagacttcttttgcaaccacaacaccaaaggttgttgctaacgctgcttgccataatggtaatgttggtggaacgattaatgctaaaaggatagaagtaacaaagaaaccttcattgatttcgtgtttacgcaccattgcgaatagcacttcccagaaaccacctactgcaaaaatggttaagtagattggtaggaagaagatcgcaccgattaacattttgccaaatacgccagcatcttgtgataacacgccaaatgcatttgctaaggcaaagtgccagtcatttgccacgttttgagttacgttttgggtaaagtcacccacgcctaatgcaaggattgattgagcacccacgttatacataccgtagaacattgctgggaacaatgccaaccacacgattaacatcatacgtttagagtcaatcccatcacgaacgtgagcatctttttgagttactgtacccggtgtatagaaaatcgtataagctgcttcaaacagaatatagaatttctcatactttccacctttttggaaagctggttccattttatggaaaagatcttttaaagccatttgattaaccttccttctcgatcttatctaacgctgcacgcaacattggtgcgtagttatttttacctgggcagacaaaggtacataacgctaaatcttcttcatctaactctaagcaacctaatgcttgagcagaatccgtatcgccagatgctaaatcgcgcaacaacaatgttggtaaaatatctaacggcatgacacgctcataagagccgattggcaccattgcacgctcactaccattaacagcggtggtaaagttaaacaatttcttgctaaacgcacctaacacagtacgagtaatagagaatttgtgtgaatatggagcaatcatacctaagaactcttgctcacgaccttcagcaatcacagacacctgtaatgcataacgacctaaatagtcgtgtacgccgctcgctttcgcaccacttaacacagaacctgaaatcacacggttttcaccttcagctaattcatttgctgttaattgagaaaggttggcgccaagttgtgtacgcactaagcgaggttttttcacttgaggaccagctaacgaaaccacacgatctgtatataattcccctgtcgtaaataatttaccgatagcaatcacatcttgatagttcaaataccacacacttttcgtcgcagaaacaggatcgataaagtgaatatgcgtaccacttaaacctgctgggtgtggaccagcgaaagaagttactttcacattagccacttcagccgttgggatattactatctggtgcacgacataagtggattattttttgtccatcaaataaacggcttaacaccgttaaaccatcaacaaaatcttgtttatgttcatttaataccacttcaggatcagtcgctaatggatttgtatccatcgcattaacgaaaatagaagatggcactgcatctaacgcaggaactttactgaatggacgagtacggaacgcagtccataaacccgaattaactaaattttgcttcacttggtcagctgttaatgaacttaactcagaagcgttataacgctcgaaagttacctgttcatcaccttcaactttaatcacaacggattgaagaacacgtttctcaccgcgattgattgcaacaatcgtaccgcttgcaggagcggtgaaaaccacgccagcattcttcttatcttcaaaaagaacctgaccttttttcaccacatcaccttcacgcaccttcatagaagggcgcatacccacatattcttcgccaagcacagcaacttcattaacggtattaccgttatggattacttgctcaggtttccccgcaataggaagatctaagccttgtttaattgtaatcatattgtttgcactacttttagttgggttaaaaagaatgattgcagaaactgcaatcgctacattgagcgtagctaaaagcaaacataaacgttgattcccccacttatatttgttcgctacattaagttctcaaattgggctttaccttgtttttccaagataaaaataaacaaggtattctacctgaaaacacacttttattgctagttttaccacatttttttaacatttagcctaagaaactttgaaatacatcaaattttactctttattccctgacaaaatgaatgaaaaacagacacttcctaaattcatttttaataaatttgatgctagtcaaaaaatcaggatagggataaaatagcaaacagtttagttttcataaatggataaaatgatgaacattacaatctcagacgttgcacaaaaccacttccgcaaattacttgatcaacaagaagaaggcacaaatatccgcatttttgtggttaatcctggcacaccaagtgctgaatgtggtgtatcttactgccctgttaatgccgtagaagaaacggatactgaaatcaaatttgaacaattttctgcatttattgacgaaatcagccttcctttccttgaagatgccgaaattgactatgttaccgatccaatgggttcacagctcactttaaaagccccaaatgccaaaatgaaaaaagtggcagatgatgcgcctttcattgaacgtctagactatgtgatccaaacccaagtcaatccacagttggcaagccacggcggacgtgtaaccttaattgaagtcactgaagataaatatgcagtattgcaatttggtggtggttgtaacggctgttcaatggtagacgttaccttaaaagaaggtattgaaaaacagttacttgctctgttccctgaagaattagttggcgtgaaagatgtgactgaacaccaacatggtgaacactcttattattagcaaaacaaccgaactcaagcggtaaaattaatgtttctatgaacgccaagcgtggcgttcctatgattattttcgggcacttatagtgtgctctttgtagtgccaataccatatcacgaaaaataacacgactatttcgttcacattttgaaatttcctccagggcaaccgcatatgttgtccatttttcaacctacacgacgagcaacagctcatctcgaaattcatctgaccaaccagcagcggtcaatttccctttcatactctgctttttcgggtgtaatcgtgccaagttcaacgctaatcgatgcaaaattgccagattttccgcaccccattcatcggtcacagcacattcgtcttctttatagaccacatctagcacccaatgggctttgttttccacttcccaatgccttagcacgcacttcgtcaatatttgaatatcaacatccaagctactgatataaaagactttttcttgcgattctttgtcattatctgaccgcttgcgacacacctccaacaccgattttatccccttccattcctccgctttgctcagccaatcactcactttcagcttgcggtagtaacgctcatcaattcgacgacgttccgcatttacctcctcaaacgtctcaagcatttgatgcgttttattacacgagcgatagtatcatcgacaggaataccacactcaaaaggacgatattttcgcaaccaatccaaatgtaattcgccaaaaagtttgatttcagtccagctgtttgcccccgacatcacggcactgacgacgagaaaaacgatgtctaaaaagtggtgtttttgattataggctcgtgggtcggataaattttcaaaaaaacgaaaaacgctcattttacaacctgatttgatatggataattaaggtgtattagatcataaatttgagaaagatgtgatcttgccctgtattacattgaagaatctgaatgattggactttacaagagatagaaaatactatttctattatttacaattagttattttcatttttatagactaacatacttgataatctaatacagcccctaaatgaaataaaagcggtcaaatttgcagaaatttttgcaaattgctcaaaaaagttagacaatcctaccgcttacaacactgatataaggaaacattatgctaaccaactacgaagaaactattttcagcaaaatcatccgtaaagaaatccctgcggcaatcgtgtatcaagatgagcttgtcactgcattccgtgatattgccccacaggcgaaaacccacattttaattattccaaacaaatttattccaacggttaatcacgttactgcggaagatgaacaagcacttgggcgtttatttaccgttgctgcgaaaattgccaaagaagaaggcattgcggaagacggctatcgcttgatcatgaactgtaataaacacggtggacaagaagtattccatatccatatgcaccttgttggcggtgagccgttaggtaaaatgttggcgaaataagatgaagcacactttttctcttgttgcactattgagcgtatttctgaccgcttgtgggtcaaatccgcctagctatctgccatcaggcacaacgccgattgttaatatcgaagccaatgtcgcagagataacggacgttgtggcaaaatcggatgaacttgtggtgtttaataaaagtgaacaccctctgcatttaagctataaactgttttggtacgacaaaacaggggtgacgcaaaccttaaagggtgaagcaacatcgtcttggcaacatttgttccttgaacctaaacaacgccaagagattgctttagacaagccaacccctgaaagtgaaaactaccgtttttacttacgttttcagcgataatggcacttcaatggcttgaacaacagcaacaacaagcggtcagttctgtcacaaaattagcagggctgaccgcctgtagccatttggtcgaattagccaatggcgaacgttatgttttacgttcccagacccaacaagccactgattatggcattgattaccaacaagaagtggcttttttgcgtttgattgagccactcggtttcgctcctaagatcatttatgctaatgaaacctctgctttattagcgtggattaatgggcaaacccctagccattttagccaacctttactcgctaaattagctgaccaattagccagcttacatcgctttgattggcaagcggtacgttctacgcaaaatttaacaagattaaatcttgccgaacgttgtcaatttttatggcaaaacttaccgcttaaaacgcaaaacagtctcaatttcacgcctccgtttaaacagattagtccttataaacaaactatttgccatcacgacattcatcttgcaaatttagtcgaacaagatgaaaaactctttttgattgattgggaatatgcggcgatctccgatcctgctttagaattagccttgctgtttcattacaatccgctgtctgcggaacaaaaggcgtttttcttggctcgctattttgcaaaatcaggcttcgaccccaccgcttgtgtcgccaaaatggtggaatatcagcctgaaatagagaaattgaataggttatggtttagattaagccactttttggatactatttttcaaacttaaaaatgaacttacaattcgtagcatttacacttcagtcaaatccaaattcttcgtttcttttgacgcaaagagtgcaatcaatgtgataactgcattaattgcaaggtaaatccccacgccgattaagccataagctgcattaattttaattgcaaaagttgcagcaaccgttgcccccacaatagatgctaagttataggcaagtgatgcgccagagtaacgtacttcagttgggaataattctggtaataatgccgccattgggccgaatgtcatacccataaagaccatacctacgattaagaacgcaaagactgtcattggtgtaccgtttcctaagaagaaaggcattaataaaccgaaaatgccgatacctgttgtcacataaattaaccatttacggcgaccgattttgtcagcaaaaatccctgacaggctaacgaagataccaaatacaattgcacttaataagagtaatcctgtaaatgtgttagctggaatacctaggcccattgggtgtcctgctggtgatagcgttggtgcactttttgagtaaatttgagcaaaggcagtcataatgtagaacaacacataggtcgctgtcataatgaatgtaccaatgatcaacggttttaagtggtctttaaatacttcgcttacaggtgctgcgtgttttttgccttgagcttcagcttctctgaaaacgtggctttcgtgtaagctaagacgtacatataaacctactgcaacaagcacgatagatgaaacaaacggaatacgccacgcccattccactaaggcttcagcaccgaaaatgtagctgactaagaagaaggaggcgtttgctaagaataagccaattggcgcacctaattgtgggaatgtaccgaaccaagcacgtttaccatctggtgcattttcagtcgccactaatgctgcaccaccccattcaccgcctaaaccgataccttgtccgatacgacataagcagagcaaaatagttgcccagataccaatgctttcatagtttggtaataagccgatagtaaccgttgaaccgcccattaataataatgaagcaacaagggttttcttacgtccgattttgtccccaaagtgtccgaaaagtgccgaaccgattgggcgagcgaagaatgctagtgctaatgtagaaagggaaagtaattcatttgaaacagggtcatcgctgttaaagaattgtgtgttaaatactaatacagctgctgccgcataaatgtagtagtcaaaaaattcaattgcagtcccgatcattgctgcaatcgccactttgcgtggattatttcttagagtatgagttgtcattgtcaaaaatccaaaggtttccgaaaaaaaagagagtgtaaattaacacgccaaaaccaataaaacaaccctatttttagtattaaaatctatacaatcacttataaacgccaattaaagcactataacaagaatattattcttatattttagataaattagttttttattctatttttatcacgctaaaaaaggataaaaattttttaacatctaatgctaaaaaccaccataagcggatagatttatgcctaattttgctatgcagattaacttttacttgtacgaattttatttatccgtataatgcacagcttcagtcacacctgtttttaatccttgcttccaacgctggtgactggcaaccttggaggctgttaacccgtaaggatcgacaatgcgtcactacgaaatcgtttttatggttcacccggaccaaagcgaacaagtacctggtatgatcgagcgttataccgcttctgttaaagaagcaggcggtcaagttcatcgcttagaagattggggtcgtcgtcaattagcatacccaatcaacaaacttcacaaagcacactatgtgctaatgaatgtagaagctccacaaaacgtaatcgatgagttagaaactaacttccgttacaacgatgcagttcttcgtagcttagtgttacacactaaagcagcggtaacagaagcatcaccaatgcttaaagcaaaagatgagcgtaaagctcctgaagctttagtagaagttgaagctgaggatgcagacgagtaattcgtctattgataactgtttaatcttaagtggcactatcgcaacaacgattaaacaaagcctaagcccgataggtattccaacttactctttttacctagaacatcgttcagtgcaaaaagaagtcaatttagaacgccaagcgtggtgcaaaatccaagtgattttggcaggcaatcaatttagtttaataacccaacaaatgaaggtcggtggaaaagttcgagtaaaaggatttatccatactcacaaagactacaatgatttaaatcagttagtcttacacaccgaacagattgaatttatagattaggagaagccaaaatggcacgttatttccgtcgtcgtaagttctgccgtttcacagcggaaaatgttgttgaaatcgattacaaagatatcgctacattaaagaactatatttcagaaagcggcaaaattgttccaagccgtatcacaggtactcgtgcgaagtatcaacgtcaattagctcgtgcaatcaaacgcgctcgctaccttgcgttacttccatacactgacaaccatcagtaataagagaggaagagtacaatgcaagttattttattagacaaagttgctcaacttggtaccgttggtgaccaagtaactgttaaagcaggttttgctcgtaactacttaatcccacaaggtaaagcagttatggcaactgcagcaaacattgctcactttgaagcacgccgtgcagaattagaagcgaaagcagcagaagcattatctgcagcacaagctcgtgcagcagcaatcgctaacttagcagcaatcgtaatcacttctaaagcaggtgatgacggccgtttattcggttctgttggtgcgcgtgatatcgctgaagcagtatcagcagcaggcgtagcagtaactaaatcagaagttcgtttaccagaaggtgcattacgtactatcggcgaacacgaagtgaaattacacttacacgctgaagtaaatgcagtagtaactatcaacgtagtttctgagtaatttacgattaaagtaaaaaatccccagccatttggttggggattttttttacatcttttccaacttcgccactttggcaattaaccacttaatcccttgttgtacaaaggcaatttgcaggcgagtatgatcaccgctgccttccacattgatgattgttccttgcccaaatttctcgtggcgaactttctgccccattttccaaccactatcttcttgtaaacgagcggtcggattagcttgtggttttgcaaaagtagcagggcgattgatacttccacgcaggcggacttctcggatatgctcttcaggcagctcgccaataaaacgtgacggtaaatggcgttcttctttgccgtacaagcggcgactttcggcatagctgatcgtgagttttttcttcgctcgtgtaataccgacataagccaagcgacgttcttcttgcaagcgaccttcgtcgaagctcattccacttgggaaaatcccttcttcaaccccaacgataaacacccgtggaaattctaagcctttggctgaatgtaatgtcattaattccacataatcttgatgtagtgaagcctgtgtttcgccagcttcaagggaggcgtgagttaagaaagcggtgagatcggtcatctcttctgcttcatctggttttacaaattggcgtgttgcagtcactaactcctctaagttctcaatacgaacttcgcctttttcccctttttcttgcttatacatttcataaagcccagattttttaatcacaaaatccgtctgttcaaacagtggcatttcttcggtttcttgttcaagtgcgttaatcagttcgacaaagcgaagcaaggctgaggcggaacgccccgaaagatgttcttcttgaacagccacttggattgcttgccacaaggtgatttggcgagttcgagtaagctgacgcaaaatatctaaggtgcgatcccctattgctcttgggggtgtattgaccacacgttcaaaggcagcatcatcttggcggttagcgattaaacgtaaataggctagggcatctttgatctcttggcgttcaaagaaccgcattccgccataaattcggtaaggaatgttggcttgaattagggcttcttcaataacacgggactgggcattaccacgataaagcacagcacattgattaaaatcgccttcatcttctttccattgcttgatctgtgaagcgacaaagcgagcttcatctaattcattgaatgcacaataaatatcaacgggatcaccgtcgcctttatctgtccaaagatttttccctaagcggttgtcattgtttgcaattaacgtatttgccgaatttaaaatatgtcctgtggagcggtaattttgttcaaggcgaatagtttgtgcgttgtcataatcattcaagaagcgttgaatgttttccacttgagcaccacgccagccgtaaatagattggtcgtcatcgcccacaatcattactttgcccgtttttcctgccaataaatgaataagatcgtattgaatgttattggtatcctgaaattcatcgatcagaatatgctgaaaacgttgctgataacgttgtaaaatcaatgggttatatttgaataattcataagcacggattaagagttctgcaaagtccaacaaccctgcacgatcacaagcctcttgatagatttgatagaatttaacgagctgttgtgaatggggatcatcgtgagattgtttgagatcttttgctcttagcccctgatctttttgagcattgataaaccacgccacttgtttcggtggaaactgcttttcatctaaattatgcaatttgagtaagcgtttaatcaaacgttgctgatcttccgtatccataatctgaaaatcttgcggcagattggcatcaagataatgagagcgaagtaagcggtttgcaatgctatggaatgtaccgacccacataccgaataagcggtgatcgctagattgcgatagggtatattcaatacgatgacgcatttccgctgcggctttattggtgaaggtcacagcaagaatattggactcagcgatattttcaacgccaattaaccacgcaatacggtgggtaagcacacgggttttcccactacctgcacctgctaacactaaatagttgccaataggggctgctaccgcttctcgttgtttatcgtttaagccgtcaagtaataaagaaaaatccatctccgcctctttatgtgattttatacagtgtgattattataacctacaattacagatatgtattttaattttttcatcaaaatttttacctcaaatttacaaaaatcacttgcatagttatgcaataaaatttaatatctattcagttttaaaactttgataggaagtagttaatggcaattcgcattagtaatgtcaatttcttttacggttcgagccaagccttgtttgatattaatttaaacattgaaaaaggcgataccgttgtgttactcggacctagtggagcagggaaaagtactttaatccgtactttaaatttaatggaagtaccgcaatcaggtcagcttgagattacaaatcataagtttgatctgaccgctaaaaccaatgcgaaacaggttgcattattacgtaaagaagtgggaatggtgttccagcaatatcatttatggccacatctaacagtaatgcaaaacttgattgaagcaccaatgaaagtattaggtttaacgaaagagcaagcggtagaaagagccaaaggtttgttagcacgtttgcaacttactgcatttgcagagcgttttccgttacagctttcaggcggtcagcagcaacgtgtggcgattgcaagggctttaatgatgcaaccagaagtattactgtttgatgaaccaacggcggccttagaccctgaaattaccgctcaagtggttgatattattaaagagttacaacaaacagggatcacccaagtgattgtgacacacgaagtttctgttgctcgtaaagttgccactaaagtggtgtatatggaacaaggcaaaattattgaaatgggcgatgcaagctgttttgaacaaccaaaaacaacgcaatttgctcaatatctttcacattcagattaatcacaacatcatacaattaataggagttactatgaaaaaattacttttagcaaccgttttagccgcaactgcagtttcagcttatgcgaatgataaaattacttttgcaatggagccaagctatccgccatttgagcaaactaatgagaaaggtgaaatcgttggttttgatgtggatattgccaatgcaatctgtaaagaagtccaagcgacttgtgaatttaaatctcaatcgtttgattcgttaatccctagcttaattaaaggtcgtggcggttttgatgcggcaatttctgcgattgatattacagaagctcgtgcaaaacaagtggctttctcagcaccatactacgaaagttcagcaagctatattgctttacaaggtaaagatttagcatctgctaaaacagtaggtgtacaaaacggtacaacttaccaacaatacgcaacggcagaagctaaacaatatcaagcaaaatcttatgcgagtttacaggatgcaatcttagacttaaaaaatggtcgtattgatttaatctttggtgacactgatgtgttaagagatatgttaggcaaaatccctgaagcacaatttgttggcgagaaagtgacagataaacgttatttcaacaatggcttaggcattgcagtgaaaaaatctaacactgagttagttgaaaaattaaacaaaggtatcgcagcgattaaagcaagcggtgagtaccaaaaaatttatgataaatggatgactaaataatcattatgtttttggattatcttcctctattgtattctgcagccctaatgaccttagggttggcagtttgctctttattgctcgggttactattgtccattctttttgtggtgcttgaaacgcataaatggacaatggtgcgtaaaccaaccacagttgttgttgcgttattgcgtggtttgcctgaaattttagtggtctttttaatctattttggtgcgcctgaagtgcttgaaatgatcacaggggaatatgtcgaactcggtgcatttggctgtggtgtcgtggcactatctattatttttgcttcctacgcttctcaatcattgcgtggagctattcaagctattccgcttgggcagtgggagtctggggcagctcttggattaagtcgtggctatacttttgtaaacattgtgatgccacaggtttggcgacacgccttaccagggttaagcaatcagtggttagtgttattaaaagataccgctttggtttctttaatcggtgtacacgatattatgcgacaaacggagttaattaacaccagtacccatcagccatttacttggtacggtacagcagcattaatttaccttggtgtaacattagtcagccaagtgattattcgtaaattagagctacgcttcactcgttttgaaagagggggtaaataatgttgcaagaatactttatggtgatagctcagggtatcccgactagtttattgctgacgtttgtttctttaattgtggcatttttccttgccgttggaatgacattcttactttcaatggaaaatcgtctagtaaaaggaatagtaaatggctttttaaccctatttactggaacgccattgttagtacagtttttcttgatttatgcaggtcctgggcagtttccttggattgtcgcaagtccattttggtctttgttatcggatgcgtggttctgtgcaatgctaacccttgctttaaatagtgccgcttataccaccttactatttcacggtgcagtcaaagcgataccaaaagggcaatgggaaacctgtgcggcattaggattaagtcgattacagacattgaaaatccttgttccttatgcgttaaaacgggcattaccgtcttacagcaatgagattatcttggtgttcaaaggaacatcactggcttcaaccattaccattatggatattatgggctatgctcgccagctttatggaactgagtatgacgcattaaccatctatggtttagcaggtgcggtttatttggttattacagggattatgaccgtaatcttacgcagagttgaacgcaaagtgctttcttttgaaagattagaggcggaaaaggcgtaagaattgaaagatatggcagagtagatgaaaattaatgaccctttgcccgtaatttttgtctactatgccgttcttaatctattcctctaatggttcttcctcaatcggagcttgtccttctgcttcgtcggctttatttggttgggtttgaggcgtgtctttgcctagtgacaatgcgtcccacacacttggttttgcttcaaccatagaaccgccacccgtacaatagcgttgtcctttatctttccaaacaggaatttgacgagggctggagcagtcccaagagccgtagctgttgatacctacccattgaatagttggtatgcttggtagcttgaacgccaagggttcggcacgtttaaggtactctttatatatttgcaacgcaccgcttgaactggtgagataggtatcgctattgttatctttacctaaccaaacggtcgtgacattttcaccgtctatgccgacaaaccaagtatctcgtgcattgttggtggtgccggttttgcctgcgatatgcagttgtgcaaaatctgcctgtaggctacgagctgtacctcgctccgtcacttgttgcattgcataaagtgtttgaattgtggcttctgcaggcaaaacgcgtttacttgtctgcgtgagaacaggctgataaattatttcacctgttggggatatgatcgcttcaattgttgtaagcggtacttttaagccagcatttgcaataacctgataagacttcgtgacatcataaggtgaaatagaataagagccgagcaatgtcgcaggataaggcggaatttcggcattatcccagcccatttctttctgcttggcaatcacatttttcagcccaagtttcattccaatgtttaccgtaggaatgttaagggaacgaactaaagcgtccattaacatcacagaaccgctaaaacgacgatcatagttacgaggtgtccaagtattacttccaacggtaatggtaatcggttggttagctatcggcgtgttaagacggaaatactgcggatttgccaaagcaatggcataaatagacggtttaaccaatgaaccgatttgacgtttggtttgaatagcacggttaaaaccagcatattgtgtctgaactcccccaacaatcgcccgtactttacccgttttatattccgccaccacaatagcagattgcaactctttgattttcttactgctattttctaattcggataccccattgataaccgccatttccgcagaacgctgttgttttctatctaaagtcgtgaaaatttttgcccctgacagcagagcagatttgttctcacccaactgacttttaatatctaaatttaaggcgtgcataaacgcaggttgctgacgatagatattccctttctctttcacgccaagcggttgtttactaagtaaattatacaattcttgattaatcaccttatgttctagcaatacacgcaacacaacattacggcgttctaatgccccttctggatttttccacggattatagagggacggacctttcaccattcccactagcagagcgatttgatttagattaatttcttgaataggacgaccaaaatagaattgacttgccagagcaaaaccgtgaatttgataactaccattttgaccaagataaatttcatttagataggtttcgagaatgcggtttttatcgtaacgaaaatctaaaatcagcgacattaacgcttcatttactttacgcactaaggttttttcattacttagaaagaggtttttaactaattgctgagttaaagtactgcccccttgcactgttctgcctgcttgatagtttgtcaaaaaggctcgagcaatccccagtggactaattccttcgtgttgatagaaacgcttatcttcggtaagtagcaacgcatcaataagcagacgaggataattctgcaaacgtaacgcttgacgttcttcatcgttatccgaatgcaacattgcaatcattttagggtcaagacgaaattccttgacctctttaagttgcactaaatcttcaatacgagcgagtttatcactgacaaagcgtaaacgcagtacacgttgagcttcaggattttcagggaaaggaaaagcacggcgaagcaaaacaagattgtcaccttcgattttgaaatcacctggtgttgcaattaatgaaacttcacgatagtcattgtctaacaaggtgagtttgacttgctcaagggtaagattgtcatcaaggcgaacactttcgatacgactatagacctcggcaggcaattgccaaatttgcccgtccattttagaacgaatttttccatctaaatagatgccgtatatcccaacatagcaagtggctaagagagctagttttaagcaagttgggataaagtagggctttttcgctatgggttctttctgtttttcttttgtatttaacattatggctggctataattattcaacttatgaggtaaaattttacaggaaaattttcaaatctcacgtatatttctctattattgctcaatatatttaccaaaaattatagataatgtcattaatgtgaaaggaatattaaagcatgggtcaaaggattaaatatcataggaacacttggcaacatttaaatagtgatttatatgtcacatcaagactattctttttaatatggtatagatggaatatggcaaatataatccatgttttaggggctaatattccccatcacaatcacacaatactaaatttcttccaaaatgaattattggatgaactaccgaatgcttttcatttttatgttgttagtcgtagtgatttgtctgaaacttttacattattagatattaattcatatccagatgaatatttactcactcaagaagttatcaaaattgcaagaaaggaaccaaccgcttggtttgtgctacatgggcaattcaatacatcgttgtggttagctatcttgttaggattagtcccagcaaatcgttgtgtttggcatatttggggagcagatctttatgagatctcttcttctttaaagtttagattgttttatccattgcgaagacttgcacaacgtaaaatagcacgcttgtggggaactttaggagatttaaatcacgcttatcaacaattaaaacgtaagagctctcttgatcaacggctttattttccaactagaatgcctacgaattttccgactaaaaaatgttcatatcaacgggcaattttgttaggaaattctggcgatccgagcaatcaacatttacttggattaaagcaaattcgagagatatttggcgaaaatgtacgaatagtcgtgccgatggggtatcccgtaggtaattcaaaatatattgctcaagttcgccaacaagcagaacaatacttccaacaagggcaggtggacattcttactcaggaattagaatttgaggcttatctggatctactgtctcaatgtgatcttggttactttccttttgagcgtcagcaagggatcggaacgatgtgtttactcatacagatgaacatcccgatagccattcatagagcaaatccttttcaacaagatttacaagcggagggaattagctttcttttcgcagatgaaatcagtgactcagagattatacgagttaaatcccagttggctttacttgataaaagtaaaattacttttttccccctaagttataagcaagaatggctgaactgtttacattctcttggtttacaagcggtataatttcagtaaaaattacccaccttgtttaaggaacattaacatgttagcgggattaatccttttttatgtaatcgctataagtgtgttggtttggataattcaacgagattatcgccagcaaggcttttcattccatttgctgtttagtggcatctatcttattacctttttcggtgggtttcctttttcgatgacgatggcagggctatttgaatatcgccttccagtcgtctcaatgttgtggaacgtactagcaatagctttaggcggctatcttatctattacgtgagttatctttatatagggagaaataagcaaataccaaggtatgcggtggaggtaaaatcgctagctgatctgaccgcttggattttaatgatgattgcaatactgagcctattaggatttatgttgttaaatcaagggctattgttattcaaattagaaaaatatagccacattttttctgctcaagttagtggtgtggctttaaaacgtttcttttatttctttttacccgccttgttaatttggtttttcttaaagcctactaaagaaagttggtggctatttttggtagctggaatgacatttggggtgttgagttacctagctgttgggggcacacgagctaaccttgcattagcctttgttatgtttatgctgttggggtatttgcggaggtttttatcatttaaatggctggtgagggcagggcttttgacagttattgcaatgtttttgttggcattatggcggtatcggcttaatgtacaaggttcggaagcattttacacttttctttatttgacacgtgataccttttcgccttgggaaaatgtagcaaaaataatggatgcagagattgagtttcaaggattaatgcctatcgtgcgtgatttttatgtgtatattcctcaatcattatgggaggaacgcccagacatcgtgtggaatacagcaaactatttcacgaaaagtgtattaggtaacttttctggtttagctatgtcgccaacgttattaggctctttttatattatgggggggataccaatgattgctataggaatggcggtggttggtggtttaatacgtatctttgataatttttttgcctatggaaaaaattctgcagttattcaaagttattgtttggcaaatttgttcaatttgattgtattgatacgagaaggcatagatgcttttatttcacggttctgcttctttagtgtgatttttgtatttgcttatatagtagcctatttgataaatagggtgagagagtggtatgaataaagtatcagttggtggagttgagttattagccgttgaaaatcagcaaactttggtagcctatttattgaataatggagttcttctaacaggtaaattgatagcaataaatgctgaaaaaattatgatttatcaagaagataatgaaatgaaaaggctattagaggaggctgaatataaatatgccgatggaataagtgtagtttgtactattagatctaaatatccgaagtattcgagaattgaacgcattgcaggcgctgatttgtgggagaggttgatggctgagttgggagaatgccgtttacctgttttcttagtcggaagctcagaggataccttacaagcaacagcaatgaaattgcaggaatggcaagtaaaagtggtaggaacacaaaatggttattttgctaaagagcaggaagaagaaattatccagagaataaaagcgagtggtgcgaaatttatttccgtggcgatgggctcgccaaaacaagaaaaatttatgcaaaaagctcagcaactttatcctgatgcactatatatgggggtaggaggcacttatgatgtctttgtcggtaaggttaagcgagctcctaaatgttggcaaaatttaggtttggagtggttgtttcgtattttgcatcagcctactcgctggaaacgacagttgagattaatgaaatatgcttatttttatctaacaaaacggctataaagtttgtaacgtatttgggatacatattaacatttcacaaaaatcactttcttttttaaaaaaattgtgagcaatttcacaaatttttatttaattgtttgcgtaaagtgttctttttatatctcaccctcaaaaactttcgctttcaaacatttttactttctaatttaatttccttagggggaatttatggacaaatcattaaaagctgcttgtattggtgaatttattggtacaggtttgattatcttttttggggcaggctgtgttgccgcagcacaggttgctggagccacattcggcttgtgggaaatttcaatcgtgtggggacttgcggtcgcaatggctgtttatgcttctgcggggttatctggtgctcacttaaaccctgctgttactattgcgttatggaaattcgcttgttttgatggcaaaaagattctgccttacattctttctcaaatgctcggtgctttctgtgcagcagcattagtgtacttcttatataaagatctttttgctgccagtgaagcggcacaaaatattgtgcgtggtgaaggtgtcggctttgcaggtgttttctcgacctatcctaatccacatatcagcgtattacaagccttctttgttgaagtggtgattaccgccgtattaatggcattaatttttgctttaacggatgatggtaacggtttaccaagaggtgcaatggctcctttacttatcggtttactcattgcgactattggtggtgcaatggggccattaactggctttgcgatgaaccctgctcgtgattttggctcaaaactctttgcattcttagctggttggggcgatatagcactcaccggcggacgtgatattccttatttcctagtacctatttttggtctttattaggtggctttatctatactcgttttattggtaagaatttaccgtgcaactgtaaataattttcagaggtgatcctatgactaaagaatacatcattgccttagaccaaggtacaacaagctctcgtgcggtgttattagacaaaaatgcaaacattgttgaagtggctcaacgtgaatttactcaaatttatccgcaagcgggttgggttgaacataacccgatggaaatttgggcaagtcagagttcaactttaaatgaagttgttgcaaaagctggggtaaaagccgatcaaattgcggcgattggtattaccaaccaacgtgaaaccacgattgtttgggaaaaagaaacaggtaaaccgatttacaatgcgattgtatggcaatgtcgccgtacatctgatttctgcgaaaaattaaaagcagaaggtcacgccgactatattcgtaaaacaacaggtttagtggttgacccttacttctcaggcacaaaagtgaaatggattttggataatgtagaaggtgcaagagaacgtgcgaaaaaaggcgaattgttattcggtacggtcgatacttggttagtctggaaattgactcaaggaagaagccacgtcactgactacaccaacgcttctcgtacaatgttgttcaacattcacacaaaacagtgggacgacaaaatgttggaattattagatgttccgcgtgaaatgttgcctgaagtgaaaaattcttctgaaatttacggacaaaccaacattggcggtatgggcggcgtgcgtattcctgttgcagggattgctggtgaccaacaagcggcactttacggacatctttgtgtcgaatctggtcaagcaaaaaatacttacggcacaggctgctttatgttgatgaacactggcgatcaagcggttgaatcgaaaaacggcttattaaccaccattgcgtgtaacgccaaaggtgaaccttgctatgccttagaaggttcaatctttatggctggtgcctcaattcaatggttgcgtgatgaactcaaaattatccacgacgctcgtgactcagagtactttgcaacgaaagtaagcagtacaaatggcgtatatgttgttcctgcgtttacaggcttaggtgcgccatattgggatccttatgcgcgtggtgctatcgtgggcttatctcgtggtgcaaaccgtaaccacattgtgcgtgcaacattagaatctatcgcttaccaaacccgtgaagtgttagacgcaatgcaagcggatagcggtgcgaaattagcaactttacgtgtagatggcggtgcagttgcgaacaacttcttaatgcagttccaagcagatattctcaatgctaaagtagaacgtccgagagtgctagaagtgaccgctcttggtgcggcttaccttgcaggtttggcaacaggtttctggagcagcttggaagaattacgcggtaaagcggaaatcgaaaaaaccttctctccagataatgacgaagaaaaacgtgcaagacgttacaaaggttggaaacgcgcggtgaaacgttcattagaatgggcgaaagaagacgctgaatagtttaccataaatagacaagcggtcagtttctgcaaattttttgcgaaaactgaccgcttatattttatgcctctttcttgtgcggaccgatttctttattatgcccttcatcaagatgaacaaaattcactaattcatcagcacttacttggaacgctttaccaaacccttttacaaataatccttgttgtggtttaaagcagaacagtttgaagtcttgcaaggttgctaactcatcgactaaatcgccgtgacgggcttttaatttggcaatgccatcattccactcatcactatagcgttcgacaatgcgagcggttgcgtcgaaggtcaaacggcgacgagcaaaaatttcacggctctgactttcatcttccagcaacattaacgacactttcggcacttcctgtaggttgcatgcgtggcgggcaatggtggaaatcaatacttgatattcaccattgttgatcacaaatggtgcataacttacattaggggttccctctttatccacagtggcaagcaccaatgttttcatttttgctttaaattcttgaatttctggccctaaacggttttgtaatacttcttgacgatttgacatttatcgctcctttttattgaaatgtcttaaatttttcaacttgtgttgggaagagttgccgctgctcatctcgaccgagatacactttaaaaatggtttgcccgttatgtgcaataaaagcaatgttgtagctttctttccctctaaacggcaagctaacaaaggcaattcgagcaatattatcaagctttaaatgcccgtgaagtgtgccttcttgatccttcatattcaaattgtaataacctcgagcaaagatcccgcttggaaaacggtctttaatttcaaaaatggagccttctttttcgatgatagttgtaaatgttccccattgactgatcgcttgtagaatctcttctgctctatccgcagagaacaagcggacaaattcacttggtaaattgcaaagcacttgcccttctgggagagctaatttttccgcaatttcaagggtaatcatattcgggttttcagcaagaagctgggtgatttgttgtctataagagttcatgttgttatgcacaagttaataatgattattatttattttatagtcatgctatgctggaatcaactacttttaccaatcgcttgcagattttgaccgcttgtgcctgttgaatgctggtgagccttgatgacactgctatcaataaaaatccattcagaatcaatatattgtctaaatgattttagcacttcttgccaaacaccctttttagaccaaagattgaaccgacgctaaatcgtgtttcacaagccaaattcagcaggtaaatcacgccaagggcatcccttacgaatgcgatataaaatcccttccactgtattacgatgttcaggtttattataaacacgtcctgtacggtcgagtaaataagctaggcgtttccaaagattatctgttaaaatagttctaagcgacatagtttgtatgggatggttaggttttggcgaactaaattataccaaatttctatgtcgtttgttttttgtacttaaaagatcaacacgccctatgcttacaaaaataatttattttttagacattacttatttgatgccatagaatggacagtacatcatagaaacatataaatgactttacgtataacaactatgaacatctggcaaacaaaatccctcatcacttggctactagccccactctctctgcttttttggttgattagccaaattcgagtgatgctatatcgcaaaaaaatcctaacatcttaccgctcgcctgtgccagtcttagtggtgggaaatatttctgttggcggaaatggcaaaacacctgtggtcgtatggttggtcgaacagcttcaacagtgtggcgtgaaagttggggttatctcccgtggttatggtggaaaaaacaagcaatatccacagttagtcacagccgatagcaatcccgaattaatgggtgatgagcctgtactcattgcgcaacgaacactcgctccagtcgccatttcgccgaaccgccgacaaagtattgagctattattaagccaatttgagttagatttaatcatcactgatgatggcttacaacattacgcccttgaacgagatatggagtgggttgttgtcgatggcgagcgtcgttttggcaacggttttgtcttgccagcagggggcttaagagagcttccaagccgtttaaaatcagtgcaagcggtgatttgcaacggaaaatctgcacaagcaggcgaacatctaatgcagttagaacctgagtgggtgatcaatctaaaaacaggggagaaaaaaccgatagccgatttttgtcatcagccagtgattgcccttgctggcattggctatccacctcgtttttttatgatgttgcaagatcttggtattcaacttaaagaaagctatggcttcgctgatcatcagccctacgcattagaaatcatcgaacctttgcagaaagacggtttaccgctattaatgaccgaaaaagatgcagtaaaatgccgtaactttgctcaaccgaattggtggtatgtgcctgtttctgcaaaattttcagcacaagatcccgcttgtttattagaacccgtccttgaattagtgagaaaacagaatgaacgaaaaactgcttaatactatcgcttgcccaatcactcaaacaaaattagagtgggataaagaaaacaaccgtttaattagccgttcggcgaatgtcgcttacccaattgaaaatggcattcctgtgttactgccagagaaagcggagaagctataaagatatataaactgtaagccagttaatcccatatttataacatgatgctcaacccaaacagcaaatttgttatcaatgccaatcctgccatttgcccaagaatagggcgaagttctgttgggtgtttgtgtcggtaaacaaataaaccgtgtttgactagcaaagggattgccaataagtataggaaattgtaccaatgagcaaaattcattagggtgaataaaagataggatagtacagctaagctgagtaaaagaagatggtaacggcgtccattctggctaccgatatggacaatgagggtatttttacccgcttgtttatcctgctcaatatcgcgtaagttattgatatttaatacagctacagataatagaccacagccaaaagcagggagtaatagatcaaactgcagagtatgggcttgtaagtagaatgtgcctaaaacggctaagaaaccaaagaaaatgagtacggaaatatcgcctaagcctaaataaccatacggtttttttcctacggtgtaggtgatggctgcaacaatcgctaaaatgccaagtagtgcaaaaactacaagatcttgccaactttgataagcataaccaattaatccacagcctgagatgaaagagagtatcgcaacaaagattaaggcctttttaagctgttcacccgtaattgccccgtgttgaattgcacgtaaaggccctattcgttctgaagtatctgaacctttgatgtgatcgccgtaatcattggcaaagttagataaaatttgtaacaaaatcgttgtgataaaagcaagtaaggtagttagccaatcaaattttccttgccaagccgctaaagccgagccgattagaatagacgctaatgcaagcggtaaggtttttgggcgagccgttgaaaaccaaatagagaacatagaacctttattcatatcaataaattagtcactttaatgaagtttttcttttaaaactgtgtatattattacaaaatgttcttatatgttttgatttttaacagaaaatttgcctttttatgacaaatccgtcctctttaactctttctcctattggaacgatacagacaccttatggggaaaaattttccgttcctcgtcagcctaatttagtccgtgaagggcgaggcattttgcgtttgttgccaccttataatacacctgatgcagtacggggtcttgagcaatttagtcatctttggcttatttttcaatttcatcaaattcccgaaagggaatggcacgctactgttcgccctcctcgtttaggtgggaatgaacgtatcggtgtatttgccagccgtgcgacacatcgcccaaatccgttaggtttgtcgaaagtagcattagatcgtattgaggttaaagagggcgaagtttatttacatttaggcagtgttgatttagttgatggcacgcctattttggatattaaaccttacgttgcttatgctgatagtgaaccgaatgcgttatcggggtttgctcaagataaacctgaggcgaaattgcaagtgcttttgactgagcaagcattacaagcggtcaaatcttgtcagaactttgcgaaatttggtattgaagatcctgtgcaatttttatgtgatgtggttgcacaagaccctcgacctgcctatcagcaaggtaaaccaagtgagcgaatttatggtatgcacttggctggctataacgtgacttggcagatagataaggtgcgacaggatcttgcccatattttaaacattgaactaatctagagaaatacgttctaagtagtgttttacgccctgatataaaaggaatagagaatgacattgaaaaaatatttagccattttaccgcttgcatttacttcattggctgtatcggcagagccaaatacctttgataccaactcgactttccagttttcaacgcaagtaagtcgtgcggtggataaagatctgatgaaagctgaggtatatagcagaatgtcaggtaaaaacctgaatgaactgaaaaagcaagtttctgcccatctcaatcaagtgatcgaattagcgaagcaagataaaagcgttgagttatcggcagatggcattagtaattatccagagtacgataataaaggtaaggtgactggctggtttgcagaaggtcgtctgcaactgaaaagtaaaaattttgacgctatggcgaaggtgcttgagaatttaggcgaggacgtggctattgggcaaattcattttagtgtatcgcctgaaaaattagcttctcttgaagatgaaatgacgttagacatcattgctcaatttcagcgtaaagcggaagttattcaaaaagggctaaatgcgaaacgttatattatcagcaatgttcagttagaaaccccgaatggacaagagcattataaccgtccagttgcattaagatctgcaagttatgcgaaagaggcagatatggacattccacttgaagcaggcaaagccactatttctgcttttgcctcggggcaggtgaaatttgaaagataaggattaaaatgaaaaagtggattaagttgctcggtcttaccttactttgcacttcggtaagtggctgtttagtcacttctgttgttggtggtgttgttggaactgccgttgatgtggttgatgcggtgacacctgatattgtggattaatttcaaaatttgaccgcttgtaagaataagcggtcattttgttactaacatttgcaaatcctctataacaagctacaatgcctagaactttttacccaataaaataaggatacttaaatgaaaattaccaaaaatgttgtgcctagcattgcataccaagttcgtactcaagatggcgtattagttgatgaagcaccagttgagcaaccattagaatatttacacggtcacaataaccttgttattggtttagaaaatgcgttagaaggtaaagcggttggcgatacttttgaagtgcgtgttaaaccagaagaagcgtacggcgaatataatgaaaatatggtgcaacgtgtgccaaaagatgtgtttatgggcgttgatgaattagaagtgggtatgcgttttatcgcagatacggatttaggtccattacctgtggtgatcactgaagttgatggcgacgaagtcgttgttgatggtaaccatatgttagcaggtcaagaattattattctctgtggaagtggttgcaactcgtgaagcgacattagaagaaattgctcacggtcacgttcatcaagaaggtggttgctgtggtcacgatcacgatgaagaagatcacggttgctgtggtcacgatcatcaccaccatcacggacacggcggttgcggctgcaatcactaattaaaggttggttgaacgatgagtgataccccattacaatcaggcacggattacctccgtgccattttaagttctaaaatctacgatcttgcccaagttacaccattgcaaaaaatggaaaagctctcagagcgtttgggtaatcatatttccattaaacgtgaagatcgccagccagtgcatagttttaaactgcgtggggcttatgcgatgatttctaatctctctccagctcagaaaaatgcaggagtgattgcggcttctgctggtaatcacgctcaaggggttgctttgtctgcaaaacatctcggtttgcgagcgttaattgtgatgccacaaaatacgccgtcaatcaaagtcgatgcggtgcgtggttttggtggggaagtgttgctctatggggcaaattttgatgaagccaaagccaaagcgattgagctttcccaagagctgaatatgacctttgttcacccgttcgatcacccgttagtgattgcaggacaaggctctattggtatggaattattgcaacaaaatgccgatctgaactatatttttgtgcctgtcggtggcggtggtttgattgcgggcattgccgtgctgattaagcaattaatgcctgaaattaaagtaattggggttgagtctaaagattccgcttgtctattttatgctttgcaagcagggcaacctgttgatttagaacgtgtcggtttatttgctgatggtgttgcggttaaacgtgttggcgatgaaacattccgtttatgtcagaagtatgttgatgatgtcgtgttagtcgataacgatgaaatctgtgcggcattgaaagatgtgtttgagaatgtgcgtgcggtagcagagccgtcgggggcattgtctttagctggactgaaaaaatatgtggctcaacacaatcttgaaggtagaaatctcgcctgtatcttatcgggagcaaatcttaatttccatacactacgttatgtgtcagagcgttgtgaaatcggtgaaaaacacgaagcactcctagccgtttctattcctgaacaaaaaggtgcatttctcaagttctgtcaaattattggtaatcgtgctgtcacggaatttaactaccgtcacgcagacgatcagcaagcctgtatcttcgttggtgtgcgtattagtgggaatgctgaaaaattagagatcattaaagatttacaacaaaatggctatccagttaccgatttatccgatgatgacatcgcgaaaacccacattcgttatatggtcggcggtcgcccaagttctattcagcaagaagaattatacagttttgagttccctgagcagaaaggggcgttgttgaagttcttacaaacgttaattgattgggatatttcactgttccactaccgagctcacggtgcagattatggtgacatcttggcagcatttgttgtgaacggcagtgaaaaagaggcatttaaacaagatttagaccggttaggttatcgctatcaagatgttaatgatagcccagcatatcaatattttttaaggtaattatttatggcagaacgtaaatattttggcaccgatggagtgcgtggcaaagtggggcaatttccgattacgcctgattttgcattgaaattggggtgggcagcaggtaaagtgcttgctactcaaggctctaaacaggtattaattggtaaagatacccgtatttcaggttatatgcttgagtctgcacttgaatctggcttggcagcggcaggtttatccgccgcctttacaggcccgatgccaacccctgcgattgcctacttaactcgtacatttcgtgcagaagcagggattgtaatttcagcatctcacaacccttatgatgataatgggatcaaatttttctctgcaatcggtgaaaaattaccagatgaagtcgaagaagcgattgaagcaatgcttgatcagccgatggattgcgtggcttcagctgaattaggtcgtgcaagtcgtattaatgatgcagcaggacgttatatcgaattttgtaaaagtactttcccatcacatttaagcctagatggttataagatcgtggtggattgtgcaaatggtgcaacttaccatattgctccaaacgtaatgcgtgagttaggtgcagaagtgatcgaaattggcacacacccaaatggtttgaacatcaatgagaaatgcggtgcaacggacattaaagccttgcaacaagtggtagtcgaagctggtgcagatgtcggtttagcttacgatggcgacggtgaccgcttaattatggtcgatcatttaggcaacaaggttgatggtgaccaaattctctttattattgctcgtgaagcattacgttcaggcaaattacacggcggtgtcgttggtacattaatgagcaatatgagccttgaacttgccttaaaagagttagctattccgtttgcacgagcaaatgtaggcgaccgctatgtacttgaagtcttaaaagaaaaaggctggaagctcggtggtgaaaactcagggcatattatcgtgttagacaaaaatactactggtgacggtattgtcgcctcactcgaagtattggctgcaatggtatcacataaattaagcctaaatgatctggctaaatctgtgccgttattcccacaagtgttgatcaatgttcgttttgcaggtggtgcaaatccattagacagtgatgaagttaaagctgttgcaaaagatgttgaacaacgtttagctggcaaaggtcgtatcttactgcgtaaatcaggtacagaaccgctaattcgtgtgatggtggagtgcgaagatggggctttagcacaaagttgtgcggaagagatttcagaagcggtgaaacgtaactaatcgcaagcggtaagatttcaacaaaattttgtaaggatcttaccgcttgttcttttttaaactataataacgcaaacgtttgctttaaggagaacgctatggatcaacttgagatgaaaaaaattgcagctcgtgcagctttgcaatatgttaaacctgacactattgttggtgtgggaagtggctcaactgtaaactgttttattgatgccttaggtgaaatggcagataaaatcaaaggggcagtcgcagcttcaaaagcttcagaagaacgtttaagagcgttaggtattgaagtatttagtgccaatgaggtgactgagcttgatgtttatattgacggtgcagatgaaattactccgcaaggctatatgattaaaggcggtggggcggcattaacgcgtgaaaaaattgtgagttcacttgcaaaaaaattcatctgtattgttgatgcaagcaagcaagtagatgtgttaggctctactttcgctctgcctgttgaggtgatcccgatggctcgttcttatgttgctcgtcaattagtagccttagggggatcgcccgaataccgtgaaagcgttgtaacagataatggcaatgtgattttagatgtgtataacttcaaaatttttgagccattaaaaatggaacataccatcaataatatcgcaggtgttgttactaacgggatttttgcacaacgttatgcgaatgtgaccatcgtaggtacgcctgatggtgcaaaaattattgaataagaaaaatcactacggagggttgggggttgctactcaactctcttctgtataaggaaggcaatatgacaaccaaagtttctttagataaatctaaaattaaatttttgctactggaaggcgttcatcaaaatgcgattgatgtcctgaagaatgcaggttataccaacattgaataccataaaaaagcgcttgatggtcaagagctaattgatgcgattaaagatgcacattttgttggtatccgttcgcgtacttttataacagatgaagtcttacaacaagctcaaaaattggtcgctattggctgttattgtatcggaaccaatcaagttgatttagaggcagcaaagcgccgtgggatccctgtttttaatgctcctttctcaaatactcgctccgttgccgaattggtgttaggtgaaatcattgtgttaatgcgtcaagtgccaaaagcaaatgcggaagtgcatcgtggcatttggaataaatctgccgcaggttcaaatgaagtgcgtggtaagaaactagggattatcggctacgggcatattggttcgcagttaagcattattgccgagtctatcggtatgcaagtgtatttttatgatattgaaaataaactaccgcttggaaatgctcaacaagttgctagccttgaagaactactttcaacctgtgatgcgatttcattacacgttcctgaaaatgcttcaacaaaaaatttaattgacgcaaaacgtttagcccagatgaaagaaggtgcagtattagtgaatgcagcgcgaggaactgtggtagatattgatgccttagttgaagtattaaaaacagacaaattgcgtggcgcagcccttgatgtgttccctgaagagccagcttctgcaagcgatccgtttgagtctccactttgcgaatttgataatgtgattttaaccccacacattggcggttctacatcagaagcacaagaaaatattggcactgaagtctcaagtaaatttgtaaaatattctgataatggctctacattatcagcggtcaatttcccagaagtttccttgcctgaacataaaggcacaaaacgcttattgcatatccacgaaaaccgcccaggtattttaaatcaactcaataaagtcttcgttgatgcgaatgtgaatattgccgcagaatatctacaaactgatccgactattggttatgtagttatcgacgttgaaaccgaacagactggcgaggcattaaaatgtttgaaagagattgatggaacgattagggctagggttttatactagctgttgtttcccctctaaaagttgaaagaaaaatgacttttggaggggaatttggctaggcatagtagacaaaaaaagggcatagcaaccattttgtctactatgcctaaaatcattaagcgtttttaccttgatgctcttttgccgctttcacaaatccttcaaataacggatgtccgtcacgtggagtagaagtaaattctgggtggaattgtgctgcgataaaccaagggtggtttggcacttcgatgatttcgactaatttacgatctgccgataaaccgctcactttcaagcctgctgcttcaatttgtggaagtaatgtattgtttacttcatagcggtgacgatgacgttcaacgatcgtttcagtcccatacacgtcgcgtgcttttgtgccttcgattaagtggcattgctgagcacctaaacgcattgtgccgcctaaatctgattcatctgagcgagtctcaacattccctgattcatcttgccattcggtaattaaacccacgacaggttgtcgacagtgtttatcaaattctgatgagttcgcttgagttaaacctgcaacattacgagcatattcaattaatgcaatctgcatacctaaacaaatacccaagtatggaattttattttcacgagcatactgtgcggtacggattttcccttccacaccacgatagccaaaaccgccagggactaaaatcgcatcaaccccttgtaacacttcaacacctttggtttctacatcttgtgaatcaatatatttaatgttcaccgttaaacgatttttcaagcctgcgtgttttaatgcttcattgaccgatttgtaagcatctggtaactcaacatatttaccgaccataccgatagtcacttcacccgttgggtttgcttgttggtacagcacttgttcccattcagataaatctgcttctttgcaagttaagcggaagcgatcacaaatgaaatcgtctaaaccttgcgattttaataacgctggaatacggtagatggaatcaacatctttgagagaaataaccgcacgctcaggcacgttacagaataaagcgatttttgctcgctcatttgctgggatcatacgatctgaacggcagatcaacacatcaggttgaataccgatagaaagcaactctttcactgagtgctgtgttggcttagttttcacttcacctgccgttgggatatatggcacaagggttaagtgcataaacaatgttttttcacgccccacatcaacggctaattgacgtaatgcttctaagaacggcagtgattcaatatcgcctacagtgccacccacttcaacgattgcaacatcgtgacctttaccaccttcaatcactcgtgctttgatttcgttcgtaatatgtggaataacttggatcgtcgcacctaaatagtcaccacgacgctctttacgcaaaacttctgagtagatcttaccgcttgtaaagttgttcgctttggtcattttggtacggataaaacgctcatagtgacctaagtctaaatccgtttctgcaccgtcttgagttacgaacacttcaccgtgttgcgttggactcattgtacctggatcgacattgatataaggatcgagcttcataatagtgacatctaagccacgagcttcaagaattgatgctaacgacgccgctgcaatgcctttccctaaagaagaaacaacgccacccgtcacgaaaatataattcgttgccattttgtctgccttttatgtgataaatagagttgaaattcggaatggaataaaccatcaggacgggagcgtagtttacagcaaaacgtcctgataggctagtaagaaattatttataaagaaatatcccgtcttccgacaaatgaatgagaaaggcttgttccgtcaaccatttctaattcacttccgacaggaataccgtgcgcgatacgagtaactttaatattgtgaatagaacacatctcagcgatataatttgcggtcgcatccccctcaatcgttggattggttgccagaatcacttcttgaaaagattcttcttctaagcgtttttgtaataaatctaaaccaatttcgcgaggtcctattccatctaaaggagatagatgtcccattaatacaaaataacgccctgaaaattgcccagtttgttcaatcgcttgaatatctgcaggcatttcaaccacacaaagttgtccgctgatttggcggcggtagttttggcagatagcacactcatcttcttcagtaaaagttcggcaagatttgcaatgtccaatgtgagtcattgcttcgctcaatgctttagctaaattcacaccgcctgagcggttacgctgtaaaagatgatacgccatacgttgtgcagattttggaccgacccctggcaatacacgcagggcttccataagattttcaagtaaagggctactttgcataagtgatatgatataaatagtagcaagggcaatttgcccctacttttaaagtgattaactagataattagaatgggaacttcattcctggtggtaattgcatacccgcagtaacacttgccattttctctttttgcatttcatcagcacggcgaaccgcgtcgttgaatgcagctgcaactaaatcttccgccatttctttatcatcttccattaacgatggatcgatttcgatacgacgacaattatgcgccccattaattgtcaccttcaccaagccagctcctgattcgccagttacctctaattgtgcgatctcttcttgcattttttgcatacgctcttgcatttgctgagcttgtttcattaagccgcccaagccaccttttccaaacatgttatgaccccattagatattaataaaagaataataattgacattctactgaagcagtttagtcggcgcaagtgataaaattggatctcagctttctattgttttaatagcttagtatggatagaatccagcaacttctctaaaacttttctaaaaatcattatgtttaaactcaaatctgccttaattagaccagtacaacgtattaataacgcaaaactgacttttgatgaaacaatagttgttttagttaataaaccttacggggtcctatctcaatttactaacaatcaggcatgcaaaaccctgaaagaatttatttctattccaaatgtctatcctattggacgtttagataaagatagcgaaggtctattattactgactaataatggtcaaattcaacatcgtttagcaaaccctaagtttgaaaaagaaaaaacatattgggttcagattgagggcattcctcaaccagaagatcttaatagattagctagtggtgtaatattaaaggatggcttaacaaagccagctaaagttaaaattatcccagatcctcattttaaatggcaaagtgcccccaaaattcgagaaagaaaaaatattcctacctcatggattgaactaaaaattgttgagggtaaaaatcgccaagtaaggagaatgactgctcatatcggatttccaacattaagattagttagggttggagtcagttacttcaaactaggttctctggctcctggagaatatttaattttagataatattcaaaagaagctcttatttaaaaaattaaaattgagaacagtaaatcattaaattttaattaaaatttgtactatattagaatataatcaacaaaaattcataacaaggataacatatggcaattttagtaacaggcggagctggctatatcggctcacataccgtagtagaattattaaatcaaggcaaagagattgtggtgttagataacttatctaattcatctgaaatctctttagagcgagttaaacagattacgggaaaatccgttcgcttttatcaaggcgatattttagatcgtgaaatgttacgtcgcattttcgcagaaaatcagattgattcggttatccatttcgcgggcttaaaagccgtaggcgaaagtgttcgagagccgttgcgttactaccaaaacaatgtgacaggttccattgtgttggttgaagagatgttaaaagccaatgtcaatacgattgtgtttagttcatcagcaacggtttatggcgatccaaaagagatcccgattactgaatcttgtgaagtgggtggaacaaccaacccttatggcacatcaaaatatatggtagagcgtatcctagaagatacagcgaaagccttcccacaatttagtgcagtcgtactacgctacttcaatcctgttggagctcacgcaagcggtctgattggcgaagatcctaacggtattccaaataacttattaccttatatcagccaagttgccgtaggcaaattgcaacaactgtctgtgtttggttgtgattatgaaacccacgacggcactggcgtgcgtgattatattcacgttgttgatctggcaattgggcatttaaaagcgttggaaaaacatcaagatgatgcaggtttccacgtctataatttaggtacaggcactggctattctgtgttagatatggtgaacgcctttgaacaagcaaacgacattaaagtgccttataaattggttgaacgtcgccctggcgatattgcggtctgttactctaatccacaaaaagctcttgaacagctaggttggaaaacgcaatacgatttaacgcaaatgatgaaagacacttggaattggcaaaaaaataatccaaatgggtataaggggtaaaaatgagcgagcaagtaaaggtttctctttggcggcaaattttcagttacaaaatgttgctctgcgtctttacagggtttacatctggcttgccgttatattttatctatcaattaattccagcgtggcttcgctctgaacaggtagatttaaaaaccattggtttttttgctatcgttggtttgccttacacttggaaatttttagttgctccactgtttgaccgctattacccaaatttccttggtcgtcgccgtagctggatgtttttcacgcagatagctctattggggttaattgcttgcttcggcttcttcaatccagcacaagatattaaacccgtaatgatgttagccattgcagttgcctttgtgtctgcggtacaagatattgtggttgatgcttatcgccgtgaaattttgtctgatgaagaactgggtttaggtaactctattcatattaacggctatcgtattgctgggttaattccaggtggattagcgttgattgtttctgaccactatccttgggaaacagtctttttgtttaccgcactctttatgatccctgggattattctgagtttattcttagcgaaagagccaacaattttacaagataaccgcaatcttcctttccacgaagcctttgttattccattcaaagagttctttcaacgtaaaggtttatggccggcggttggcacactcacttttatattgctttataacttaggcgactcctttgcggctaccttacaaagtgcctttattctggatatgggctttagccgcaccgatttaggtacagcggtaaaaatcaacggactatgggcttctattgtggcgggcatggtgggtggcgtgctgatgttgcgtattggcgtaaatcgctctttatggattttcggtgtgttccaaatgctaatgttactcggctttgcgtggcttgcaagtcacggtaagtttgaaacaatcggtacttacgaacgcttcgctttatctgcggttattattggtgaatatatcggaattggcttaggcacagcctgttttgtcgcctatatttctcgtgaaacaaatccactttatacagcaacacaatttgcgattttcaccagcttaaccgcgattccaagtaaattgattggtgcgacatctggggcattagctgagagcgttggcttctaccatttctattggatctgctttttcttagcgattccaggaatgttatgcttgttttgggtagcaccttggaatgaaaagaaatagtacccagttaacatattgtaaaatataatctcgttacttaattcatactaggtgctttaagcagttactgttattattacaggcggtgttttttatattatagaggaactttttatgaaccaactagatgctttacgtcaaatgactgtcgtagttgcggataccggtgatattgatgcaatcaaagcgtatcaaccagaagatgcaacaacaaacccatcattagttttaagtgcatctgcactacctcaatatgctccattaattgatgaagcgattgcttatgcaaaaacaaaaagcaacgataaagcacagcaactgattgatgcggaagataaattagcggtaaatatcggtttagaaattttaaaagtggtgaaaggtcgtatttcaacagaagtcgatgctcgctactcttacgatacggaaaaaactatcgcgaaagctcgcaaactgattgcgttatataacgaagcagggatcagcaacgaccgtatcttaattaaaattgcttcaacttggcagggtatcaaagcggcagagcagttagaaaaagaagggattaactgtaacttaacactattattctcacaagctcaagcgcgtgcttgtgcggaagctggcgtttacttaatttcgccattcgtaggtcgtatccttgactggtacaaagcaaattctgataagaaagagtatgcaccggcagaagatccaggcgtggtttcagtaacttcaatctataactactacaaacaacacggttataacacagtggtaatgggtgcaagtttccgtaacgcaggcgaaatcacagaattagccggttgcgaccgcttgacgattgcaccagcattattaaaagagttacaagaaagcgaagcacctttagtgcgtaaattagagtacaaaggtgaggtgaaagctcgtccagcaccaatgactgaagctgaattctattgggaacataaccaagatgcgatggcagttgaaaaattagcggaaggtatccgtaaatttgcgattgaccaagagaaattagaagcaatgcttttagcgaagttctaattattctttagattaacagccccgaaatatcatcggggcttttatttgattcgatatgacaaatatggttctctccaattatctgataggggaaaatggtggggcaatgatattcctacgattttcgttccaatgaaaaccgataacctaagatacacaaaaatgagaaaacagtgaggagcgataaaataggctatatgagtttatatcttttacaaaatttaactacagcaaaattatttacaaatagagctattatctctataaagatttccctctctatcattgccagccttatacaacttctgtataatcttcacccttttacaagttcagaattttgcaaaatttggagtaaacaatggctcgtgtaaccgttcaagatgcagtagagaaaattggtaaccgctttgatttgattttaacggcagcacgccgtgcaagacagcttcaacttcacactcgtgagccgcttgtggctgaagagggcgataaaccaacagttatcgcattgcgtgaaattgaagaaggtttgattaataatcaaattatggatcaacaagagaaatttgatgtaatcgcacaagaagtggcagagaaagaagctatttcattcttggctgatgtgcaagcaaattcataattagatcaaattttgttaaaaatggacaatcaaaagggtaatttgcccttttcattgtccatttttcgttatacattacgaaatctcagtttttgttgtgtgaggtgtaaagtgcagttatttgaaagtcttaataccattattcaaggttatttacctgcggatcaaattgatattgtgaagcgggcatttgttgtggctcgtgatgcacacgaggggcaattccgttcaagtggcgaaccttacattactcaccctgtcgctgtggcgtgtattatcgccgagatgaaactcgatcacgaagcggtaatggcggcacttctacacgatgtaattgaagatacaccttacaccgaagaacagcttgccgcagagtttggcacaagcaccgcagaaattgtgcaaggtgtatcaaaactggataaattaaagttccgtactcgccaagaagcacaggtagaaaacttccgaaaaatgatcttggcgatgaccaaagatgtgcgagttgtattgattaaactggctgaccgtacccacaatatgcaaacccttggggcattgcgtccagataaacgccaacgtattgcgaaagaaaccattgaaatctatacgccgttggctcaccgtttaggcattgaacatatcaaaaatgaattggaagatctctgtttagaagcaatgtatccttatcgttataaggtgttaaaagcagcagtcgatatggctagaggaagccgtcgagggctgattgaacaaatttcaaaggaaattcaaattcgccttgatgaagtagggattaaagcccgtgtgtatggtaaggaacgccatctctattatctttatggacgtatgctgcaaaaagtacaacgttttaattctattttggatatttattctttccgagttgttgtagatagtgtggataattgctatcgagtattagggcagatgcatagtctatataaacctcgtcctttccaactaaaagactatattgcggttcctaaaacaaatggctatcaatctttacatacttcaatgattggtcctaaaggtgtgcctgttgatgtattaattcgcactgaagagatggatcaagcagctcgttttggtgttgctgcatattggggctatcaagaacaagctaatatgagtgttcaagtcaggacgcaacaatggctaaaaagtattgtggaaatgcaacaaaatgtaggaaattcggcagagtttatcgaaaacgttaaatctgatctgttttcaagcgacatttatgtctttactccgaaaggtcgtatcgtacagcttccagccaatgcgactgctgtggattttgcctatgcggtacatactgatgtgggcgaccgctgtattggtgcagtggtcgatcatcagccgtatccactttctcagccgttacaatcagggcaaaccattgaaattcaaacggcagaaagtccacggttaaatgcattgtggctgaactttgtggtcacggcaaaagcacgctcttgtattcgtaacaccttaaaaaaccagcagcgtacacaggcaatttctcttggaagacgacaattattgctctcacttaatacctctaattttgaacatcttgatcccgttgtaattgaggcattgctaacagatctacaattatccaattttgatgacctattagccgaaatcggtttgggtaatcaaattagtggagtgattgctcaacgcttatctagtaagaccttagagattgatacagacggtaatcctgaaaataatcaatctcttgcaatccaaggggtagatagcggtttgattagctttgcgaaatgctgtttacctgtccctggtgatgaaattattgcgcatatcagttcgggcaaagggttaatggttcactgcttaacgtgccgcaatgtgaaagaagctgcgacggatcaccgtcactatatgctggtaagctgggaaattgctaaagataaatccgttgaatttgaagcagaaatcgtggttgatattctcaatcaacaaggcattctagctgggattacttctgcgattgccaaaatgaacagcaatatccttgatattcacagccaacagcgagaaggtggcgtgtatcaagtgaaattattggtcagtgtgaaagacaaaacacatcttaccgagattttaactaaactcagccaccttgttggggttgtcaaggcagttagagcaatgacctaacttcaatctaagcaatatcttcacgagttaacacaagcggatatattcctgcctgttcttgcttaagatggtggactaatgcggtgatttgttggcaaatattgtctgtcaccgcattggcttgagccattttctcttccgttacattttcagggtgtttattaaagagaactgcgtcaagcaaacgttctgcgtgcataccgtcacggcagtaatgtaatacgcccgcttcagtaaatgccgttgcgacatagctgattttggtcgttgcaatgcctaaagcaccatcttcactgcccagttccctaaatagttgatattgtggaaaaccgccacaagcaaggaggaatgcacggcgaactaccattgcttcaggacggaaatggaaaattgcttcggcaacttgcaatgccccattttcataagcatcatcggcatcaagaaaagcgataacctctgtatcactttgtaacgccccccaatttcgagcctttgcaacaccactatttcgaggaatctgttcaactctaatcttatgtggaacttgtgcttcaaactgtttggcaagagcaaaggtgttatcggtagaagcatcatcaatgatccataatgtgcctaatccagcttggttaagcacactttgtatgctcgttgaagggtctgttctgcgttatagcacgggataatcacatcgatcatttaacgttcctcattaaaagcaaaaccttgaggtgatacagataaaatagatgcagtttttccccagtcgccaaggactatgcgagtaaataagcggtcagattttgcaaaattttggtcaaaatgcaccgcttgcctgtgagtatgtccgtgaataagccattcggcttgatagttatccacaatttgagcggtaaattcaggattaacgtccataatttcagccgacttttgttgtttatctgcacggcttttggctcgaattttctgagcgatatgaatacgcagtttgagcggtaagcagagaaatagccattgtcgccatttttgatggactttttggcggaattgttgatatttaatatcatcaatacaaagggtatcaccgtgacaaattaaggtttttttaccatataaatcaatcagttgataatcgggtaataagatcattcctgtggctttagcaaaatctttaccaattagaaagtcacgattgccgtgaataaaatagcacggaacaccctgatccgtgagctgacgaatagcgtgtttcactgtatcaatcaaaggcgattgctcatcgtcaccaatccagaaatcaaacagatcccctaagatatacactgcttcagcaagcggtgctttttctgtcataaattgcaaaaacagatccgtcaattcgggttgattgtcgttgagatgaagatcggcgataaagtaggtagtcattgttttttgttgttatgatatggaatgccttgaatgtagggacacactgcgtgtgtccacaatatctttttattatttgagtgacggacacacgcagtgtgtccctacactaattatttttcgctatcaaaccacccacgaataaactgcacagacaaaaagaaagtcaatgcaaagaaagcatataaaatatagcttacccacggttttgacacagtctcaccttccgcaagcggtgtgattgacacgatatttctaaattcattcaaccaattaattcgccagccgtagtacttaatttgtaccatctgtttttcgttcgcataggcttgtgcttttgcttgaatatcggcagagccaaatttgaagtaaagcggtaatccccagccagtatcttcattacggtaaaccattaccgctttggtatcagggtgttcggtgaaaagaaaatacacgtcacgcacttcgccatcggctggatttgatttgctgattaccccatctttatccatacgacgcacttccattcctgtgaccattgtttgctcatagctaggaaatgcataatttaccccaccaactaatacgatgtgtagtgagagtgacactaagatcagaaagtatttaaacattgctctcataaaaaatccttatccgaaagttcggagtgtattgccattaaattttaaacaattttcgcacgttttgcgtggtaatgttagcaaattcttctaaagatacgccttttagtgttgcgacatattcacagacttctcgaacataagctggctgattaggtttaccacgataagggatcggggcgagatacggagagtcggtttcaactaacagacgatcaagcggtactttccgcaccacatctcgcaattcttccgcattacggaaagtaataatccctgaaatcgaaatataaaaaccaatatccaatgcacgctttgccattgcccagtcttctgtaaagcagtgtaacacaccgccacactgctcggcattcccttgttctaaaaactgcattgtgtcttcacgggcagaacgggtatggatcactaacggtttctgcacttgttttgctacctcgatatgttgctcaaacaacgattgttggagagctttggtttcgggcgtgtagtgataatctaaccccgtttcccccacagcaacaactctaggatcttgcaccaatgccaccagtttatcatagtcaaacggttcatcttccacgttcaacggatgaacaccacaagagagggccacttcactacgatgagcagtgagttgcttcatcgcttcaaagcgaccaagtgtcgtacaaatcgagatcatctgctgtacgccacgagctttggcattgtcgatcacttcgtccacatttttatggcgagtttcatagtctagcgagtctaagtgacagtgtgagtcaataataaataaattgttcaaggttgttcctttttattacttggttttacgctggcactagggtcttgctcgtgccatcaaatttataaacaagcggtcatttatggtaaaaaatttacaaattttttggctacgccctttccaccccaaatgctatcacttgatcgatactgtcagcattcatcgcaatcatcattaaacgatccacccccaaggcgacacccgagcagtttggcatacctgcttttaacgcctcaaggaaacgacggtctaattgctgtggcggtaaacccatcgcttcacgcaacacattatcttgttcaaaacggcgaatttgctctttagcatcactgagttcatggaagccgttagcaagttctaaccctttgtaataaaactcaaagcgttcagccacacggtgatcttccgtactgatttgagcaagtgccgcttgagttgcagggaagtgataaacagccgttggacgctctttgccaatattcgcttcgaccacttcgctaaataaaaattgtagtaaagtatcacgttgttcatcttcatcacattgcaaaccgtgttcatgcgctttagccaccagctgggctttggttgcagagagtggatctaagccaacgtaggtctgaaatacaaattgataactaaaggattccgcaggttcacagtctaaaatctgttgtaacagatcgtccacttcattaatcaaacggtacatatcaaaatggggacgataccattccaacatcgtaaattcagggttatggtgtttactgacttcttcattgcgaaacactcggcagagctgaaaaatcgccccactaccgcaggcaagcaagcgtttcatatggtattcagggctagtaatcaagtgtaaggttttcgcttggcttgaaaacggcgacaagaattgagtactaaaggttgaaagatgtacatccgtcacggaaaactcactcatcgcaggcgtttcaacttccaataccccacgttccgtaaaaaattgacggatctccgccataatttttgctcgtttcaataaatgttgaatagaggctgatggtttccagtcaggctgttcttgcaaattttccattaaattgtaccgcttgtaataaaagtgggacattatagcagagtaagtagagcgtgttgatcttttaagtacaaaaaacaaacgacatagcagggcaaccgcatatgttgtccatttttcaacctacacaccgagcaacagctcatctcgaaattcatctgaccaaccagcagcggtcaatttccctttcatactctgctttttcgggtgcaatcgagccaagttcaacgctaatcgacgcaaaattgccagattttccgcaccccattcatcggtcacagcacattcgtcttctttatagaccacatctagcacccaatgggctttgttttccacttcccaatgccctcgcacacacttcgccaatatttgaatatcaacatccaaactactgatataaaagactttttcttgtgattctttgtcattatctgaccgcttgcgacacacctccaacaccgattttatccccttccattcctccgctttgctcagccaatcactcactttcagcttacggtagtaacgctcatcaattcgactacgttccgcatttacctcctcatacgtctcaagcatttcggggcaatctcggcggattttgtgaaaatacgcctccacttccgactgaaattgacggtgatttttcttcaacggcatcacataatcccctttcttttcgatgattttctccgcaattttcttctgtgtattcatcgcatccaccgttataacggcattttttaagcaaaaactatcgataatttccatcactgcctgctgctcattttgcttacccgaggattttttctgcgataaaatcaaaccacgagactggctccacaccgtcacactgtgcaaagcactttgggtttccggattgaaactatgacgaagtgtcttgccatcaatcgcaatcacttcacgtccttgttgtgtgcgtatctcattgataaaattaagaaaaacctcattaaatgcttgtggctcaatgcgttttattacacgggcgatagtatcatcgacaggaataccacactcaaaaggacgatattttcgcaaccaatccaaatgtaattcgccaaaaagtttgatttcagtccagctgtttgcccccgacatcacggcactgacgacgagaaaaacgatgtctaaaaagtggtgtttttgattataggctcgtgggtcggataaattttcaaaaaaacgaaaaacgctcattttacaacctgatttgatatggataattaaggtgtattagatcataaatttgagaaagatgcgatcttgccctgccccatatagtttcttaaatattaaatgcttgattgtgtgtatttatgtgtatataattattattgattaagacaaaggaggaagcatgcactcaagcgacttaatcaaggaactaaaagaggcgggttgtttctttgttaggcacggaaaaggcgatcaccaaatatggcaatcgccgattacaggaaagcgatttcctgtaccacaccctaaacaagatttacctattggcacttcacgttccatcaaaaaatcggcagggctgttatagctctgccgagcttagcaaaggagagaattatgttatttaccgttggggtagaaactccacataatgagaacgaagcatttggactttgtgtacctgcactatttactgatgaatatagttgctttagtgctgccgatgcaattgatgaaattatccctaacgtaaaagatgccattcatacaatgttagaaatgatggtagaagatgaatttgatattagcacgcttcaagataagggatttatccactacaaacaacaagaagatttttcccactgtgatagttggttgcttgttgatatagatatttctgcattcttaggtaaaaagcaacgggtaaacattgtgttaccacaatatctattagacagaattgacaatcgtgtctcacatagtaatttttatcgagatagaagccattttttagcagttgcttctcaacgtgaattaaccgctcaacaggtttaatggataggcgtagcaatacgcctaaaacttcaatctaatcaaccccgaaccaaataccgctccttccataaaatctcgagctgtgcgtagtcgtctgtcaaacgttctcggtgaaatatgcatctcaagacaaatattcttcttgtcttgcccctgtaaaaacaccgccattaacacctgataggcttctaagttcaaatcgtgtaacgtcatcacagcttcatctagcttaagataatgctcctctgacagttcatcaatactatacttggtaatttgagcagtcgcctcaggcataaaggattgtaatgatggataaccacggcacccacgatgagaagcccagcgacgaacccaaagaccctatcccaaattctgtgtaaacacccatttcaacttaacggtgatcgtctaagcgatcaccaaaatcaatcataaatcgattcatcgtcagtttccagttctgaatcggcattgtccatttttttgatgcatctttaatcgcaagccaaatcactttgaaaactgaatcatccgtcgggaatacatttcgttttttaatcacgcgacgaatcacgctattaagcgattccacggcattcgtggtataaatcgctttacgaatatcagccagataatcaaaaaatgtggcaatatttgcccagttatcttcccagcctttcgccacaagcgggtattttgcctgccatttttgcgaaagtgcggtcagattttcgcgagcttgtacttccgtcggggcttgataaacctgctttaaatctgcggtgacggctttgtaatctttccacgaaacgaatttcaagctgttacgcactaaatgcacaatgcaaagctgaatcttcgttttaggatagactgcattgatggtcttctgggaagccttttaaaaccgtctacacaggcaataaaaatgtcttttaaagcctcgtattttagaagctctgtcagcacatttgcccagtaacttcgcaccttcattttcagcaactccaatcacggtcacgaggcgtctcaatttctatctcaccttcatcacaaatgacggtcttagatgtgtaaccgttacgtgcatttttaccttttctaggctgatgtttttcataaccaagatggtcggtcagtttcaccatttaacgcagcctcgacggtgattttcttgagcatccgtgaaaattgattgaggtcttccggtgtttttagatttttggcaaattccgctgccaaggcgtgaagttgtttttcgttcataataaaatacctgtgtctgaatgtattatctcagaaacaggtatttacacaaattgtgggagaggctcattgcttgcgaatctgttaatcccgcttcctttgcaatagcaacaaggctagctaatttttcttgacgagctttttcttcagctgctaaacgctcagcttcttcttttgctaaacgcttcttttctgcctgttcagctgctaaacggtcagcttcttcttttgccaattcgttctttttctgcttgttcagctgctaaacgctcagcttcttctttcgctaaacgttctttttccgcctgttcagctgctaaacgctcggcttcttcttttgccaaacgctctttttctgcctgttcagctgctaaaacggtcagcttcttcttttgccaatcgttctttttctgcttgttcagctgctaaacgctcagcttcttctttcgctaaacgttctttttccgcctgttcagctgctaaacgctcggcttcttcttttgctaaacgctctttttctatttgagcctgttgttccgtagtttgtgaagtattttgattggcagaagttgctgaaccgccaccactacttccacaagccgttaagcccaaaagaatcaaactagctaaggttactttttttaatgacataagagtttctccttgaaataaaatgctgaaaatagccttgtaattgtcctttttctaaacaattatttatcaattaaattatttaaagcgtaaatcgttttattgataaaaaagatttatagctattcataatgcagaaatgcactcagaatccgataaaacaggctttagcaaaagattaaaagtcgccttagaattggctgggcttcaatctttatctttagctgaaatttcaaacaaatttaatcttcgtcacccgaacaagcctgttacaccacaagcggtacataattggctgattgggcagtctattcctacgcctgataaagtcgaaactttgtctaaatggctaaatatcagccctgaatggctacgttatggaaaagagcattttgaaggggagagcctttctcaaaatgaaattttaatgttgaaatattttcgtaatttacctgctaaccgccagcaagcgattttggcattactacacgaatttcataaatagataaaatgactggcgttaattcaacgaaaacagcataattccatcgtttatttagtgagattaatctatggaactcaaacttccccctcccttagttgcactaatttgtgcaacaatgatctattttctgccgaactatgcagagccgaattgggtctatcaaagttttgcgataatctgttttatatttggggttagcgtcgatctctgtgcattgtgggcttttcggcaaaataagacgacaatcaatccgcttgctcccaataaaacatcagctttaacaacacaaggtatttatcgctttagtcgaaatccgatgtatttagggttggcaagtctattatccgcttgggcattttggctaggcaatgcgttcgcattgcttgtcgtgtggggatttattgcttatataacccgttttcaaatcgagccggaagaacggattttagaacagaaatttggagagagttatcgccaatataaacaaaatgttgctcgttggttgtaataaataaaggggctgtattagattagccctaaattccacaccattttctcaaccttttaagttgctctttgggtgttccaaagttaaatcgaaattcacattctttaaagaataaagggaaactttttcgatcaatcccattatattttcggaggaatagtagacaaaatggttgctatgccatataaaaagcagtgttatgtagcaagtgctatataataccgattaaacgcatagtttgtaaaacattaacacatttgtctactatgtgatttacttcggtaatctctgacactttggacaatagaaactatttcgttgcccgattaccttagcttcaataatagagccacaatcgttacattcctcgcctttgcgaccatagacttgtaatacttgggcgaaatatccaggttttccgtcaggctgaataaaatctttcaaggtcgttcccccttggataatcgcttttgtcaaaacctctttaatcacagtgactaatctctcacactgtttcgcggttagattttgtgcggctaattcggggtggattccagccataaaaagtgattcgcaagcatagatgttgcccacaccaacaacgatagcgttattcataatgaagtttttcacagcaaccgttttattgcgacttttttcaaataaataaccgcttgtaaaggcttctgaaagaggctctggccctaaatttgctaataactctgctgtttcagcttgctctgcccaaagccaggttccaaattttcgtgggtcgttataacgtaagattacgccgttttctgtgatgagatcgatatgatcgtgcttatctatcgccttattctctttgaccgataaaatacccaacgatcccgacattcctaaatgaactaaaatatcgcccttatctgtctgaataattaaatacttagctcggcggtaaatctcaattatcgtcgccccttgcatagttgaaagctctgaactcacagcccaacgtaatttcggctgacgaacaataatctctttgatcttctgccctacaaggtaaggcgagatgcctctcatacttgtttcgacttcgggtaattctggcattgtttttccttataaaaaaggggcgaaaacgcccctatacaacaaaataagatgaattaatcttttttcactttaccaaccacataaccaatcacacagccaacaagtgcaaatggcaaccactccattgagtaggctttaagtggaagttgcgcaataaattcaacgcctgccacagataagattgaaatgaccgttacaaatacaatcgataaaccttgtgctaaacgtggtaatgggaagaataagttcactaataataccaacaatgcagtcattgaaatcgggtataacacgagtaatacaggtacagacttgctaattacctcatttaaaccttggtttgctaaaccgaagccgattaacgtgaaaatcaccgcataaacttggtatgaaattttcgggaaaatgctattgaagtaagctgatgttgctacaatcaaaccaatcgctgtggttaaacacgcaagagttacgatgaaacctaatacggtacgacctaattcaccaaaggcttgggttgtggtttcatttaaaataaatacccctaagttttgccctttagcagcaacgtctgccactgtttctgcacttaatggaattttataaccgatccagccgatagaaatatagataacggctaatgaaattgcagcgacaaaagaagcgtaagtcgtttgtttaactaaagatacgttgctatttgcattttttgctttaataccattgatcactaacacagagaaagcaaaggctgctaatgcgtccattgtttgatagccttctaagataccgcttgttaaaggtgattctaaggttttagcttctgctgtttcgacgcctgagaatagagctatcactttgatcactaaggcaataattagaattaataatgcaggggttaaaattgtaccaatgcggtcgatcattttgcttgggtttagacttaaccaaagtgctaaaccaaaatagacagctgtgaaaataaatagcgatgtagaatcaggctgacctacaaacggcacaattgccatatcataagcggtcgctcccgtacgcggaattgcgaagaatggaccgattgtcaaatagattgccgctaagaaaagcaacgaaatcgctgggtggatattttcaagggcttttttataaccaccttcgtagcaagctgcaacgatagttgcgattaaaggtaagccaacacctgttaaggtaaagcctaaaattgcagtccagaaatctgctccgctatcgaaacccaatttcggcgggaaaattaagttacctgccccgaagaaaattgcaaacagcataaagccgatgacaaagatatttttaaccataatgtatttctctagtttatttttgaaagaggatttattatccacaataatagataaaaataaagctgaattttgcctattacaaaattcagcttttatttattttttgaaataattaattcatatataaaccgccattcacatgaatggtttcaccgttgatatatgctgcatcatcagaagctaaaaatgccaccgcttttgcaatatcttgtgctgaaccaagtttgcctgctgggatttggcttaagatcgcatttttttgatcttcggtaagttcgtctgtcatatccgttgcgataaaacctggggcaaccacgtttaccgttacgccacgagaagccacctctctagccagtgatttagagaagccaacaagacccgctttcgccgcacagtagttggtttgccctgggttacccattgaacctaccaccgaaccgatagagataatacgaccgccttttttcatcatcggacgtaataccgctttagataaacggtagattgatgttaagttggtttgaataatgtcgaaccagtcatcttctttcatacgcatcaataaaccgtcacgagtgatccctgcgttattcacgagaatatcaatatcgccaaactgttctttgatttgagcaagcacttgctcaattgaggtaaggtcagccacgtttaacactaagcctttgcctttgtcgcctaaggaagctgagattgcctctgcccctttttctgaggttgccgtgccaatcacgaatgcacctttagacactaattcttcagcgattgcacgcccaattccacgagttgctcccgtgactaatgcgattttgttttgcatgtatatttttcctaattgaatttaaccatttccccctttgaaaaagggggggctagaggggattttaaatggtacgggaaaatatccagatctttaaatcccccttaatcccccttttttcaaagggggaaatttttaattaaaacaccaccgcctcaaacgatactacatcatttaccgcttttgccgataattctttaacaatacgacctgccaagccggtcagtactttatttggaccgatttcatacagtgttgttacaccatcttgtgccattttttcgacagtctccgtccaacgcacagggctataaagttggcgaaccaacgcatcacggattttatctgcatcagtttcaaccgcaacatctacgttgttaattactggaacaagcggtgcgtttaacgaaatattttgcaatgccgccgctaatttttctgctgctggtttcattaacacacagtgtgaaggcacgctcaccgctaacggtaatgcacgttttgcgcctgcttctttacataattcgcctgcacgctctgccgctgcttttgtgcctgcaatcaccacttgacctggtgagttaaagtttaccgctgaaaccacttcgccgatttcacttgccgcttgttcacacgctttgatgatcgcttcattatctaagccgataatcgcaaacatcgccccagtaccagctggcacagcactttgcattgcttgaccacgcaattcgactaatttgattgcatcttggaaatccaacacgccggcacaaactaacgccgaatattcgcccaagctatgtcctgccattaccgcaggtttttgctcagggaatttctcttgccaaatgcgatataaagcaacagaagctgccaataacgcaggctgggtgcgttcagttttacccaaatcttctgccgtgccgttttggactaaatcccataaatcataaccaagcacatcgcttgcttgtttgaaagtttgttctaccacagggtaaacaggtgcaagatcagcaagcataccaaccgcttgtgaaccttgtcccggaaataccattgcaaatttagacattgtttgttcctcttttaaatttgtaaaaatttgttgaaaattaaccgcttgcaaatttccccctctttgaaaaagaggggcagggggagattttttaatcgggtgaataatacaatttgccgatttcaatacgttgtcgccctgtttctaaacgccatttattcgtgtcacgcaatgaataaacgcaaccgcaatactcttgttggtaaaaacgttcacgtttgctgatttcgatcatacgttgtgaaccgccacctttacgccagttgtaatcccaataaaccacatcatcataagccgctgccgcacggtgtccgcaaccgttgatttggttcatatctttccaacgagaaatccctaaacagctggtaaaaacaggatagccgttttcgtgggcatatttggcggttttctcaaaacgcatatcaaagcacattgtgcaacgaatgccacgctctggctcccactccataccttctgctttcttgaaccactctttacggtcgttttcataatcgtcatcgacatcaataaacggaatgccgtgtttttctgcaaagcgaatattctcttctttacgaagcaagtattctttgagtgggtgaatgtttggattgtagaagtagatcgcaaattcgatccctgaagcgtgaatagcttccattacttcacctgaacaaggcacacagcaagagtgtagtaaaagtttgttgtgtccgtttggcagttctaatttttcacgcacaaaaggggtattcggatctttgcctttacgggttaatttgcgtttttgttgtaacgcttctttgtgttcttgaggttggtgttctgtcatttatattttcttatcacaatatataaccccttctgaaccgcctgagcgtgtttaaatttgtaggaacatttttctctgagccaacgaagttggcgaatttaaaatgttccgttaagcaaatttaaactaagcgaagataagcggtgaagtagggtcgcctttcttttggttacttttctttggcgaagcaaagaaaagtaacatttacttaataactacgatccaccgacaaatacgccaatgaaatcaacgcttgtttatattcgctttctggcaaaatagcaattgcatcaacggctttctgtgcttcctgtttggcacgttccattgtgtaatctaaggatttatgctctgccataatcgccaaaatctcgtctagggcttcacgttttccgccctgttcaatcgcttcacggattaatgctgcttgttgccgattaccgcttcgcattgcgtgtagcaatggtaaggttggtttaccttcggctaaatcatcgccgatatttttgcctaattgttcagcatttgcactgtaatctaaaatatcatcaaccagttggaatgccgtaccaagataacgaccataatcacgcatcgcaatcacagtcgcttgatccgcacctgaaacaatcgcagagcattgacttgccgcttcaaacagacgagcggttttactgtaaatcacttgcatataatttgcttcggtagtttcaggattattgacgttcattaattgctgaacttcgccttcggcaatcacattagtggcatcagacatcacttgtaacacatcaagagaacgcagacttgccatcatttggaacgctcgggtatagataaaatcacccacaagcacacttgccgcattaccaaaacgggcatttgccgtttcacacccacgacgcatatccgactcatcaacgacatcatcgtgtagcaaggttgccgtatgaataaactcaacaaaagccgcacaggtaatatgctcttgacctttatagccaaccgcatttgcagccaatactgcaatcaacgggcgaatacgcttaccgccaccgctaataatgtaatgtccaagttgattaatcagaacaacctctgaattaatttgagcaagaatagcctgatcgactgcctgcatatctgctttgacgagagttaaaatttgctctaaggaaagttgcgttgtcattatcgttatcttttcgttacaaaataaggcaggattttacctcaatggctccgtcgtatcaaaaaaagaatgcaaaaaagcggtctgttccgatcagaaaagtgcaaggtttatgtgaacaaatagacataattaatgcttagactcaacataagtataaataatcatctctgactatctttagagtaaaatcatttagtcgctataacatatgattttgataccattgcgctaataaaatccctgcatttacagccacattcagcccactattgagagaattagcaaatgagagctgaacaatactatcttcaggatattcaacttcatttgatataacttcacttaaaacaaatacaatctttttagataatactattctagataaatgtggcgcttgcctttggcgagttaaatgcacaatttgataaccagccttacgtaactgcattaaggcaatgtgtttatgttttgtctctaagggatacacaaattctagaccgccttcagcaacacgagcagcattacttgaattcagtatgtcattattttctacaataatgccttttattccataaaaggcactagtgcgtataattccccctatattttgagcattatttacaccatctaatagtattaagcaatcatgttgtcgttccagttgtaaatagccttctaacgagaatggtgtagatttttttactaataaacacataccaccgtgatgctctgttcctgtaactctcagcatttcttcagtatctactaaatgatatgcctttttatgatctgcaagatagcttaataacgctcctgtttttttggcacactcagaggtaatccataaacgaacgatagcttcagggcgttgttgaaaaatagtagaacaagcatgttctccataaactttcatttcactggctcgattattacggattttttctggtactcttggagatagggcaccacttttactttttataggtttatttctgtcttttacactgacttttacaaagccttctttactagatttgttagcttcagttgtataaatcgataaacttggtttgtctttgtagtgctcattttttgatgtttgaacataatcttgttgtagtgaagattttttcgttttaaatttaagaggttggcatgcttttactgacttaaaactaggggggttaggattgaatttattgttcatcattttcttaataaaaattacatttgataggtgattaatgaatattaaacggaaatatgaaaagtgtcggtaatagaaaaactaaaaccaacactttttactatctatctggctttaacattttaatcaactagcaaccttgtttaccatactgctcttgacgaagaattgcacgcacgcttgcatcaaactgtgctaacacttcttctgcatttttcggatcagttccacgagcatctaagtagaacttgattttcggttctgtacctgatggacgagcgattaagcgactgccattttcaagcacaaagactaaaatgtcgctttggcgatctgttttcgtatgatctaagaaagtcgctactttgaaaccacccacttcgcttggtgggttagtgcgtaatgcggtcattaatttaccgattgcagataaatcatcaacacggatagagatctgaccgcttacataagccccaaactctctggtaaagtcatctgcgtaatctgctaaggttttaccttgttttttcaagttacgcacaagatctaagaacataatcgctgcagagataccgtctttatcacgcactttatctggatcaactaagtagcctaatgcttcttcaaaaccgaataataagccgtttactttaccgatatatttgaagcccgttaatgtttcttctgactcaaagccatatttcttcgcaatttctgcaagtgctggggaagaaacaagtgaacaagctaaaataccttttttgccttgtgcgtgatattgttttgctaaataccaacctaagaaacaaccgataacattgccatgtaaaggtttccagttaccttgtgcatctggtactgccactgccaaacggtctgcatctgggtcgttcgcaataataaattccgcatttctctctttagctactttaatcgctaaatctaatgcacctttctcttccgggttcgggaagtttactgttgggaatgtgccgtccggccatacttgttcagcaacgatagatggctgcggtaaacctgctttggctaatgttttgctcaatacttcataacctacgccgtgcattgccgtataaacatagttaatatcaacttgtggctctttagcaaggcttgccgtttttgcaatataggcatcaacaatttcatcatctaatacagtgtaattttggctacgtggtaagtctttgatactgccttgagctactttatcaatacaagccgcaatttcttggtctgctggcgatacaatttgaccaccgccgtttgctttacctaagtaaactttatagccattatcttcaggtgggttatggcttgctgtgaccattacacctgctgtggtatcaaagtacttgattgcataggcaagcactggggtcggtaattttcttggaagaagataagttttaatgcctgctgctgccataatttctgcagtatcacgcgcaaacacatctgaatttttacgtccatcataacctaacacgatagatggctctttgtcatagccttttagaaattctgctaaaccacccgcagcttgagcaacaagtacacggttcatacccattgaacctgcttgtaagcgaccgcgtaagcctgcagtaccaaattgtaaacgtccatcaaaacggctagataattcagcttgagctttcgcatcatttgcttttgcttgcgaaatcaattgctctaactctgcacgagtttctaaatcaggatcttgatctaaccaattttgagctacttgaaagagagtttccatagtgagtttccttatagttaagataaacaaatagacagtaataaactaactgaaaagcagtaagattgaaatgattatttgtaaatattgcgtagttatttgatatggataaaagacaaacggttacatataaaaacaccgcctaattagacggtgtatttatcattaaattagaatgtttgagcaatacgatccagttcaactttagccgcttcaagagctttatctgaaatttctgctccatagccaagaccttccgcgtaaacaaactcgatgtcaaaaataccaataaaattaagaactgcatgcatatacattttggctaagtctgtaggtgtatccctatagactcctccgtgagtaagcacaacaatagcttttttacctttaattaaaccttcatgaccattttctgtataacggaaagttacgcccatacgggttaaatagtctagatatgtcttaagttgtgctggtatacctaaattatacataggaacagcaaatacaatgagatcgcattgatttacttcattgatcagattattagaaagagtcagagcattatattgagtatcatcttgtgattttcctcgtatatctaatacagcatttatatcataatacgggagcggattttcacctaagttgtgttctataatattagctgaaatttgagacttgaagtgatcaaccaattgattagattttgatttatccgcaagaatacttgactttatcactaaaatatttttcattgcaactccgaaggtcaaacgattatacctaataaacgacgattattttatctaaatagctagggaaataaaataaaaaacgtctatgaaaagaattaaagtgaacttttttttgacagcttattatttaacttgtccaacaccatttcaggctgaatatcgatcaaactttggtgataaccgtcttgcccttctcctttgcggatcttaattaaaccaccttcaatcaagcggataatcaccgcagatttagagagcggtggcgtatattgcgggctagttggaccatagagcgcaacaagcggtcggttaagagcagcggcaatgtgcattagtccagagtcgttgctaacaatggctttgcaatcagcaataaaatcaacagcttggtttaaatccgtttgtcctgcaaggttgacgcagtagcgttgtaaggtttcaggcaagctattgcgaatttgctctccgacttcttcatctttttttgaaccaaataaacgtacggaataaccttgctcaatcagtttttgagccagtgttgcgtagtggtaatggggataacgtttcgcaggtccaaactctgcacctgggcagaaaccaaccgcttcgcggttttcggcatattcaaactgtttagcaaaatgttgtttggtttgtgcaattttctcgctatcgacttgcaagtaaggataagcaatcggtaagttttctgctgttgggattttaccttgctcaaacgcaagtgtcacataacgttgtaccatcatcggatagtcgtttttattcgcgcgtaaatcgttaagaaaaccgtaacgcatttcccctttccagccacggcgttggggaattttagcaaacagcggaataaaagcagatttcaatgaattaggcagaacgattgccatatcgtattgatttcgcaaatttttgcctaaattgtaccgcttacataacgcaaacgagccgtgaccgattggcattgaaatcgctttgcgaacttctggcatacgagaaagtaatgggcgacaccagtcgggtgccatcacgtcaatttggcaattcggatagttggttttgagctgttgataaagggcgtgggacatcatcatatccccaacccaagaaggtgcaataactaaaatattcattatgcttcctattgcttcacgcagttttcggcaaggattttattgcggttatctcgcaatgtgcctttgccatcaaaatcttctgaccatatccagcggatattgctgtattttttgctttttttcgtcacacttgaataaagcgtatggatactttgctggaaagtaatatcaacagctctatttttctttgtattgtcatactgtaccctaacgatttgtttattatcacatagatattcgtaataaatacgttcattaattttaacaatcatttgggtattttttgttggtattaatgacttttcaagttgagaaacaggtgatacagcaggtaccatacaagcagagagcaatgctatcattgcatatattgaagaatacttcctcactattatggatatcatctcgtatctccttttaaatatagagagaggcaatgatgatattattgcctcaatatttattatttaaaaatataagtaccatttgattggcgagtataaattccagcatttattctcatttcaacaacacggctatttttgtctaatcgaacagttactttttctccgactttgagattgctgaccgctttgtttgctttgctcatagcgtttacatctgaaatatttaggtgattgtcacggaaaacctgcattaaagacacaccttttggaatcgttaatgtcttgcttgaaataaagccagatgaagctgatgtaacaacaggtttagcagttacgactaccacttttgttttagcaggctgttctttttctatgttgacttctgctttttgagttacagcagaaactggtttaattttttctacttgagttttctcagcttgaattttctctacttctgatttttcttcttccatctgatagctcacacttgcgctacttgttggttttgttacgacttcctcagtaggctttgtaatttctgtacttgttacagaaataggcgtaatagaagcattttcaacgttagatgaaactgtcgaacctcccgttgttaatggcagtattgtttctacggtgcttacggggggagatatcgggggagcttgctctacttgagcttgtggggcagttaatgcttttgcttcttctgctcgcttcgcttctgcttcatcaactgggcggaattcaataggtagagcattatcttgttccaattgttccagtgtttctggtgtatttggttttaacaagaaaagaatcaaaagtgatgccaataccaatgtccccacaagaagtaatcggcgagattgaaatggtaccttttctgcgattgatttttgaaaattaggttgagaactaggcagaattctctctatagtttgagtagtcattgctggttgctcggcatttgttgtttctgtttccttttggggtgcttcagataatggctcctctgttgtggtgacaacaggagaaaacataaatgcagatgttttttgttgctccaatgtacgctcttttgaagcttgttgatttctttgttcttccattgaggcaaaagaaaaagtaccacctacaggacgcttcattactggagtaaaagtgtgtcctggcgatttagttgaatgtaatgaaaaattaaccttcttagtaagtttatgtgctgagagagttaatttgctttccgaattttcgttctctgtttttactgcgctaggctcaccaaaaacaggttctttacgtaaattttgttggctcattttgagtatcccaaatgattaagtttaaggaaacattgtattattctaaaggatttctgatggattttcagaaaaatttcacaataagcttgctatttttgctaactttttactaaaacaaaaaaatagcagtattgtctagaagatttttcaattttttcgatctgcgtcgaaaaacacatttttactcattgcaggctgtttgtttgatttgtaaggtatgcgtgcaatttaaaccaacctttaaggagtaatttatgaaaaaactttctcgttacacattcagtcttttatttgggcttttctctgcaacaacatttgctgaagaaaaagtaactacgtcaacagaacctacaccagtagtgatgcaacaagtcgcagcgacacaaaaagtaaatgcgaatgttgtaaatatcaatactgcgacagcctcagaaatccaagataagttagtaggtattggagcgaaaaaggctcaggcaattgtggaatatcgtgagaaaaacggtaagtttttaaatgttgagcagctcaccgaagtttcaggtatcgggaaagcgacacttgaaaaaaaccgagatcgtattgtgattgaataatcatatgaggggcgaatctttattcgccctgacatacggcctatttagagatagtcaaattcaaacatctaggggctgttgatcttttgagtttaaatcttaaccaaacaacaatttcccccagcgaatacaacaaatcattgctagcgatgccgcataatttcttgctaacttatcgtaccgagtcgcaatggctcggtattgttttaaaaaagcaaacgcattttcaactaaatggcgataacgatataaacaccagtctatatcatcattacccacctttgaatttcgtctgcgaggtataaccagaactgcttttgttgtcaaaataagcactcgtaaggcttcacaatcataacctctgtctgcaacaatggtctcactgtcaggtaacaattccacaagctcagacgcagctttactgtcgtgaacttcacctcccgtcagaacaaaatcaataggatttccacaactatctaccgctaaatgaatttttgtgctattacctgccacacttttgccaatcgcttgcggattttgaccgcttagtttgtatggaatggttaggttttggcgaactaaattataccaaatttctatgtcgttcagggcaagatcgcatctttctcaaatttatgatctaatacaccttaattatccatatcaaatcaggttgtaaaatgagcgtttttcgtttttttgaaaatttatccgacccacgagcctataatcaaaaacaccactttttagacatcgtttttctcgtcgtcagtgccgtgatgtcgggggcaaacagctggactgaaatcaaactttttggcgaattacatttggattggttgcgaaaatatcgtccttttgagtgtggtattcctgtcgatgatactatcgcccgtgtaataaaacgcattgagccacaagcatttaatgaggtttttcttaattttatcaatgagatacgcacacaacaaggacgtgaagtgattgcgattgatggcaagacacttcgtcatagtttcaatccggaaacccaaagtgctttgcacagtgtgacggtgtggagccagtctcgtggtttgattttatcgcagaaaaaatcctcgggtaagcaaaatgagcagcaggcggtgatggaaattatcgatagtttttgcttaaaaaatgccgttataacggtggatgcgatgaatacacagaagaaaattgcggagaaaatcatcgaaaagaaaggggattatgtgatgccgttgaagaaaaatcaccgtcaatttcagtcggaagtggaggcgtattttcacaaaatccgccgagattgccccgaaatgcttgagacgtatgaggaggtaaatgcggaacgtagtcgaattgatgagcgttactaccgtaagctgaaagtgagtgattggctgagcaaagcggaggaatggaaggggataaaatcggtgttggaggtgtgtcgcaagcggtcagataatggcaaagaatcacaagaaaaagtcttttatatcagtagtttggatgttgatgttcaaatattggcgaagtgcgtgcgagggcattgggaagtggaaaacaaagcccattgggtgctagatgtggtctataaagaagacgaatgtgctgtgaccgatgaatggggtgcggaaaatctggcaattttgcgtcgattagcgttgaacttggctcgattgcacccgaaaaagcagagtatgaaagggaaattgaccgctgctggttggtcagatgaatttcgagatgagctgttgctcggtgtgtaggttgaaaaatggacaacatatgcggttgccctgctatatggggtttaattgctcaaaaagtgattgactggtggcgaaaaaagtagtacatttcagctatgcttgcaactcgtacaagcgagagaaagcgaaatgattttgtagccctgatcggaaacggtcggggctttttgtttgggggttaggatggaacaacgagatattctgttaaaaaacggtgaagtagttcaagaaaaatctcaatgtcactatgtcgctggctggccatctcgacgtatatcagactgcgttcctcacttccaaaataggaaaatttatccatttgccagtagtaattctgaacaactaagttaaatgcttctgggggaacggaatgtatttgagaaagttcatttttatgagttgaaagatatttttcgaactcttcatcaatttgttgtaaaaaagtaagattattggctacgttaatgtttttgaaggtaaattctagtgctagtttatttgttggggaacaatattctagcagatttttaaccaagctcagtctttacggactgggcttttttattgcctgaaacgagggctaaggtatgaaaaatgttatgagagatatgggaacacagacgtatatttggtctggatttagtgggattattgcgtggctgagtgagcaacagaatttaatgattttaagtcttgcgattggtattgtgacggcgtgtgcgaacttgtatcaacgctgtgacgaaggtaaggcgaagcgtcgtgaacgtgagcgagccgaagaagctcatcaaatcagaatgcagatttatcgggtaagggcagagaggttaagtaatgagcaagctaaaaacactaggtaaagttggcggtggggtttgttttgtcagtgccattattgcggtgttgaatacagattttcacggtcaatttcgtacaagtaagcaagggcttgaaattatcggcgatgcagaaggttgtaaacgagagccttatttgtgtcctgcaaatgtgcttaccgttggcattggttcaacggaagcgtcaagcggtaagattgaaagaaaagtttacacagacaaagagattgcacagcgttggttggttgatattcagcacgcagaaaaatgtgtgaagcgttacgcaaacggttggaatattccgcaatcggtgtttgatgttgctacttcgctgacgtttaatgctgggtgtggcaccgtgagtaaatcgacgttctttcgtaaaatcaaatcaggcgattatgttggtgcctgtaatgagttgcctaagtgggtttattcaggtggcaagaagttacgagggttagaaatccgtcgtgagaaagagaaggcgttatgtttagctgggttaataaaatcttaatggcattgattttgggcttgtgtgcgtggctatggggtcagtcacggaggatagatagcttgacagccgagaaccaaacacaagcccaaactattgagcaacagcaaaaagcaaacaataagctgacaatgcaactgcaacaagagcgacaagcggtggaataccagcaaaatgttgcaaataaactgcgaaagcaggtggagcagagtaatgaacagattaaagctattttacagaaagagccgtgtagcgttactgctttgcctcgtcctgttgtcgatgagcttaagcggttgcacagcaaagacaaagattgagtatttatatcctccgcaagcctttttagtgcagtgtgagcggtcagagtttggtggcacaacctatggtgatgctatcgagtatctcgttaaggtgatgggagaacgtgacttgtgtgcgggtcaggttgatagcattagagagtggcaagcacgaactaagcaagggtttaaatagcggattaacgtttgtgccacggtagagagcggtcagatgatcgctcttttattttatgtaaattaaatactacataatttgcatatggttttggggttgttagataaatccccgagaaaatacgcaagtgatgtaatttatatataacaaaaccccgatcactgcaaatgatcggggtttttcattacccattaaagccgaatgagtaacgatttatggagattatgacagttttaaccgtaaccatcaaggagatacttatggaatatggtttatggcaaataagccttgcagtaacactacctattttagcgtttgtttcaccaaagctaattaatgccattgctaatttattgaatgttttgaaataaaaaggattaaccacgatgacgaagaaagacgaggttaaatccacgtctaaaggcgtgggtaaattcaaactaacagacaaacaacagcggtttgttgaagaatacttaattgatcttaacgcaacacaagcggcaattagagctgggtatagcgaagatactgcaaaagaaatggggtatgagaacctcacaaaacctcacattcagaaagcaattcaagaagcacaaaacaaacgagctgagcgagtaaatgttactcaagatgatgttttaaagggattacttgaaattatctcaatgagtacaggcaagcagaaaatcacagaaacagaactaagtaaggttgatggttctattgttcctatggatgtagagaaagtttgttttgagcctcacgcagcaaataaagcgcttgagctattaggtaaacatcttggtatgtttaaggataaagtcgatgtaacaaactctgacggctcacttcgccctactattattgagttggtggctccagatgaaagtgcaacttaatctcccacctaaacttattccagtgtttactctccaggatgtgcgtcatcgtggtgcttatggtggtcgtggttctgctaaaacacgcacttttgccaagatgaccgctgttgttgcgtatcaacgggcaatgcaaggtgaaagcggtgtcattttgtgtggtcgtgagtttatgaactcgttggaagattcatcattagaagagattaagcaagccattcaaagtgaaccgtggttagcaaatttttttgatgttggtgagaaatatgtacgcacaaagtgcggtcgaatttcctatatttttacaggtttacggcacaatcttgacagtattaaatcaaaagcacggattttacttgcgtggattgacgaagcggaaagtgtgagtgaaatggcatggcggaaacttctgcctacggtgcgtgaaaacggttcggaaatttggttaacgtggaaccctgaaaagaaaggttcggcaacggatttacgctttaggcaacatcaagacgaaagtatggcgattgttgagatgaattatagcgataatccgtggtttcctgatgtattagagcaagaacgcttaagggataaagcccgtttagatgatgcgacttatcgttggatttgggagggggattatcttgaagaaagcgaggctcaagtctttagaggaaaataccaagagcttgagtttaagcctttacctgattttgaaggcccttatcacgggttggatttcggttttgctcacgacccaactgccgcagttaaatgctgggtgtttaaggatgaattgtatattgaatatgaggctggcaaagtcgggttagagcttgatgatacagcgacatttttgcagaaaggtattgccagcattgagcagtatgtaatacgagcagactcagcaagacctgagtctattagctatttaaagcgacacggcttgcctcgtattgatggcgtttcaaaatggaaagggagtgttgaagatgggattgctcatattaaatcctacaagaaaatctacattcacccacgttgtcagcaaaccttgaacgaatttcgcttgtatagctacaaaaccgaccgcttgtctggcgatgtgttgccaacattagttgatgcccataaccactatattgatgcgttgcggtatgcgcttaatcctcgtattcagcggaaaggggattttagccaaaatccacttaaactttactaaggataatttatgtctgatgtttctattgttatgcgtgaaatcagggcgttgaatgaaaaaggtgtaatgattgatgatttgcttggtggcactaaaacaatgcgacaagcagggaaaaaatacctttatcaattcagtcttgaggaagaagaggcttataaaaacagacttaaccgctcaacgctttatcctgctttatcggaaacgctctaccaaatgacaggtagagttttttttgagccgattacgacaaataacgttcacgataaattaaagcaagatattttgcctgatgtggatttagagggaaataatgtcgatgtattttcttctcgttggtttaatgcaggtttaacttatggcgtggcgtggtgcttagtggattacacccgtactgagaatattcgtaccattgctgatgagaaagccgttaatgctcgtccttattttattttgattaagcctaaaaatgttttgggatttaaaacggataaaatcaaagggaaacgacaaatcacgcagttccgctatatggaagaagtgtcggtagatgatggcgagtttggttcgaagattgaaaaaataatttatgtgtacgaaatcggccgtatgcgtaagtataaagcggcagaggggcaatggacgctgattgatgatgtgcaacttcttgctcaaaatcgaccgcttgaagtggtgcctgttgtgccgtttattacgaaagaaagcaatgtgtttgcattaggtgagccgccgttgcttgaattagcctatttgaatattaagcactggcaatcacaatccgatcaggacaacattttaaataccgctcgtgtgccgttattagggattttctccgatactgaagttaataagctacaagttggtggcagtgcgttgcatttaccagccggttctcaaattgcttatatcgaacattcaggtaatgcgattaacgcagggcaagagagtttgaaagagttggaaagccaaatgcgtgttgccggggcgaaactcttagataaaaccgtgttagcaatgacagacagtcaagccaaagaagagcagggcaaagaaatcagtttattgcgactgtatgcgaataaatttgaagatgcgttagatttagcgttggaatacgttggattatggttaggtattgatgatgttggtaaggtagagattagcggtaatattgatgacgatctcgatccaaatgcctcgatggatatggtcattaaaatgcaacaagcaggcacactttcaaaacaaaccgtctttaatgaggcgaaacgtcgtgggctgattagtgataatgtggaatgggaagatgaacaggctcgcttaaatgaagaaggggtagattatggccttgagttcgcaggacaagccgaaacaaagcctgaatagtcgtattgcatacgccttgactgatcgcaaaattctgcattttcgttatgatgcacatcttagacagcaggtaatgaaacggctaagtaaaacacaacgtgagttgctcaatcgtttagcggccgcaggtgtggatgctttacctaaaagcaattagacacactgcttaaggagcttaagcaagaagtggcaaaagtctatcaagaaatgaccgcttacacgcaagacgagttaagcggtttttttgcggccgaaacccaacatattcatcagctttataatgatgaagtcggctttgatttttttaatcaggtgcctgaatataagcaaaaagcgaataaaaccgcaacgattattgcaggttcacctttagaagactggtgggcaaaacaaggtaatgattttgcgtttaagtttgaagggattattcgtcaagggttgttagatggccaacaaacaagtcaaatgattagtgatgttaagcatttaatgaatacgtctcgcagacacgctgaaaccttagtgattactgcggtagcgaaagtggcagataatgctcatcaagccttaagagatgaaaaccttgatattttggcaggagaaaaacacctttctacactagacacacgaacatcaacggtatgtcaattaagagatgggttaatgtgggatttagataaaaagccgatagaccacgatgtaccttatcaacgaccgcctttgcacccacgttgtcgcagtattttacagcttgtaaccaagagctggaaagagcttgggattgatggtgtagatgaaatgccatcaagcacgagagcaagtcaagacggccctgtatcagagcaaattaactacgaaaattggttgaaaagcaaatcgcctgagcaacaagatcaggtattgggcaaaggtaaggcggatttatggcgtagaggtgtgattacttttgcggatatgttggatcagagtggtaggccgttgactttggctgaattacaaggtgatcgcattgtaagttggctcactcataatcaatataaaaatttaaaaaaagcggttgaaaaattgcctcattttgctgatactttagctcagtatcacttaactgaagaagaaggcttggcaatctatgcttacacaactaacttgtatcgtaaaatcaatacaaaaatgcgaaatggtaaattaactccaaaagatactgggtttattgctgtattgcagacagggttaagtagattaccaagttttgaaggtattacttatcgacgaattaaagagttgaaaggctttgatttcactcgatataaaaaaggttcggtgattacagagagtgcgtttaccagctcttccaaaaaagaaagtttaactcgttttggagagtatgttgtctttgaaatttatggaaaaaatggcaaatccattacacgattatcaaaatacccttatcagtatgaagtcttgttcaatgaaaatagccgttttttagtcgaagattatgacgataaaagtaaacgaggtgttatccgtatcacattaaaagagttgtaacaatgggacatgttttagatttgccgcctgatgaattaaagcgatgtattgaagagtgtgattatttcggtacgggttcatatgaagccagtattgaatatcttaaaaaatcaagagctgaaattgaggaacgaagaagaaaacgagaagctgaagaaagagcacctacgcaagaagaagctgataaactcattgccgagattttagcagatcctgatgattacgttggttttttacagcgacaagcattcgatcctgatagtgttacagtggaaggtgtcattgcagatattcgggcaagcgtaaaaaaatgattgcttggtatttaaaagtggatatttacgatgacaaacaaagaatttgctaaacaagaatgggataaagctgctaatgcggtttcttatttgaagtcatctcattcaaaattagattttaagcagcattgtattgatcttctagatgggaagaacagtgtagattattttattctattgataacttggacttggaataatcatcttgttgaattaaatgggcttagcggtttaactcattgggctatttggacgtgctgtgaagattatccgttatcagatgatgacgagtatccagtgtaccctgcaaatgttggtgaatttaaagaggctgtacaacttgctttagatgataattattatgctatttgggaaagactaggtctaagcgatcaggaaattaaagatctttctcaataaactatttctactaacctagcctaagcgctaggtttttttatacctaatttcaactaaaccgcttatacagcaatgtgtaagcggttttttattgcctgtaagatagaaaagtacactcgacaagtagcgtttgtgtctcccactcgctatttcttacaggtttctttttagtgggaagaaactaggaggcatttatgcaagcattaaaagcaaaattctttggttcagaaattttagtcatcaatcataacagcaagccttatgtaccgatgaaacagattgtagaaaatatcggtttagtctggcacgcacaattcgagcgattacagcgcaatgaggttctttcgcaaggtattcgtgttatacgaataccttcaaatggtggtgaacaagaagcggtttgtttaccattgcactatctcaatgggtggctatttggggtcaaagtttccaaagttaagccagaattaaaagagaaacttattcgttatcaaaaagaatgttacgaagtgctttgggattactggactacgggcgtagcgaagtgggatgaaattcgacaacggcgagaagttctagaagaaaatgaaaacgcatcaaaaaaacgcgcaagcgaagcaggacgagcattacaaaaacgaaaattagaaaagcatacttatgaaattggtatagcacggctagatagaatggaacagttattacttgatatttaaggtgtgattataacgatcgcaccttttttattacatgaaaattaaccgcactttcgcaagatcgtgcggtttttattatccacgtttcggaagaaacacaaacttacttaggaaggaaatccaaatgaaattaaaacttgatgaaaaaggcaatgttgtggttgtagatggtaaacctgtgtatatccacgatgacgggaaggaaatcccttttgatgcaccgcaagcaatgcagaaaatttcttcgctcaatgctgaaaacaaacaacaccgtgaggctaaagagaaagcggaagcagaactcaaaaagtttgacggaattgatgatgtggcaaaagcaaaagaagccttaaaaacggtggaaaaccttgacgctaaaaaactgattgatgcaggtgaagcggaaaaggttaaacaagaagtgattaagggctatgagcaaaagctggcagatgccaaagcgttagcagagaaagtacaagggcagttacatactgagttaattggcggctcattcgctcgctctaagtttgtcacggagaaactggcaatgcctgttgatgtggctcaagcgttctttggtaagcattttagcattgatgaaaacggtgcaattttggcaaaagatgcgcttggcaacgaaattttcagtcgagtgaaaccagggcaacgtgcggattttgaagaggcgttagaggctttagtggatgcttaccctaacaaagattctattctaaaaggctctggctcaagcggtggtggcggtggtgctggctctcccgctggcaaacaatttaaacgtagccaaatgactcctgaagagatgaacaagtttattcaggaacacggtcgtgaggcatatcttaatctacctaaagaataaaggaaaacattatggcaacaggcttaaacaaagatgtgattatctacaatgaactggctcaaactgcatatttagagcgtattcaagataatcttaatgtatttaatgctgcttcaaacggctgcattttattgcaagatgagaatatccaaggcgattttcgaaaacaatctttttacaaaatcggtggttctttagaacatcgtgatgtaaatagtaatggcgcggttgagaataaaaccattgcgatgggtgaaatggttggcgtgaaaattccgtttaaatacggcccttatgcaattacggaagaggcaatgaaacgccgagcgagaagcacggaggagttttctatccttattggccaagactatgcggacgcattattagacggttattttaaatacttgactgctggtgcaatggcggcaattgggacgaatactgacatgaaagcctcggcgtctattgcaaccgatcacaaaaaagtattgaccaaagggatgcgtaagtttggggataaatttgggcgaattggtttatgggtgatggactctgctgtctattttgatctgattgatgatgcaattacaaataaagtatttgaatcggaagaccagattatttatggcggtttaccagcaacaatgggcaagcctgtgttagtaacggataaagccaaagctaacaccattttaggcttacaagccggagcaattactatcacgaattcgcaattaccgggtttccgagcttatgacattaacagtgaagaaaacttagcgattggtattcgtgcggaaggcacatttaaccttgatgttttaggttattcgtacaaagaaagtgcgggagcgaaccctaacctttcgaccattggcacggaagcaagttggcaaaaatatgcgaccagcaataaaaatacggctggcgtgttaattgaattaagctaactaagttaagtgaatataaaagcggtgcgtttttgcaaaaaattaacaaaatcgtaccgctttttatgttgagaaggagtaatcaatgcaattaatttatacaacgcaaaccacaggatttgaaccgcataaacattaccgaaatccgctgtattttgaaaaagcagaaagtaaggtgaccgatgtggtgatttatggggattttcctaagattgcacaagcgtatcaatccttaggggttaaggttcaatgggttgatgaacaatctgataaaaaaccattagacaagatgaccgtgccagaattaaccaccgcacttaaagccttaaatgtggaaattccacaaggagcgaagaaagatgagctgattgcgttattaaagcaagcgaaagggggcgacaatgaccctgaacgtaccaacggatagttatgtttctcttgaagaggcaaatggctaccatcaattgagagctagttttgaggcgtggaatgaacttgatgatgaacaaaaagctcgtcgcttagttagtgcatcagattttctcgatcacaattatcgttttgtgggagagaaagtagacccaacacaaatcagacaatttccacgtcaagaaagtagtcaagagagtagcgaaattccgttacaagtgaaatatgcggtttgcgaattagcattgcagtctgatctaaatcagaacccagaacagaagatggcaagcgtgaaagtagggcctgtttctgtcaattacgaaaatcaagcgactatcagtggtagtagcaatcggtttgagtatgtcaaaaccttgctttctcgctttttaaattcatcatctactaacaatgtgtccttgttaagggggtaacttgtacggcaaattaaagcaaatctccaagcagttaattcagaagtttggttcgccttgtttgattaaaacacaaatatctgggcaatacgatccagccacgggaaaaatgcaaactgagatcaggaaacagaatgcttactgtctttttgataatctggcttatgatttttcagtaaaccgagaatttgcaacggtacagcaaggcgacgtggtgatttatctgacagaaaaagcagaagtcggctcagcggttgaagtgaatggcgaggtgtggagcattattgccgttcagccgataaaacctgctagtgtagcaatgctttatcaatgccaagggagaaaacaatgagtagttttattgcacaaattcagcaacaaattgagcagattgagcaacggaaaaacttagtcattcgtaaagtagcgttagaggcttttgcgaaagtgcaagcgaaatcgcctgttgatacaggggcgttaagacgaagttggactgtgtctgtctcagctttacccccgaattttaatggctcaaatgaacatattgccaaggcgaaatttggcgatgtgatttatattgcaactaacttgccttatgcccctgcgttggaatatgggctttatcctaatcctccgaaaaatccatcagggaaaacgaagaatggttattctatccaagctcctcaaggtatggttcggataaccgttaaagagctaaaagcatatttagctagaaatccaacattagggctttggtaatgaaaaaaatcattcgatccattctacaaacgcaactaacggaattaggcaagtttagtaccgcttgggagggggtaaacaataaagtgagtttgccttatcaagcggtttttctttctgtaacaaccagtgatacagcaagcatttctgataaaccgctttctgttgaaacagggtttttacaggtgaccttgttctatccaaatggcaatggcacgcacgctatcgaagaaagagcggagctcatccgcaatcatttttacggtcaatctatcattgaagagaatgttcaagttgttatctctcaaccgcccactattggcggtatttttttaaatgatgataagttggctttacctatcacaatccattacacagcctacgagctgaataaggagtaactatggctcaagaagtcaaaagaacactggttatcagcaaggaatccgtttttggcacaaaagctgagaaaacgggagccaagatcattccacgcattgaaacatccttaaatgccaattttgaatcgttccaatcagaagaaattcgttctgatttacaacgttccgcctctattgtcggttttgaaaaggtcgaaggcgacattaaaggtgaactatcggctgggcagtggtcgcagttctttgctgcggttctgcgtggtgcatttaccgcagaggctaaagccccgattattaagaaaacgtcaaatggtaccagcgagaaaaacggaaaaattctcattgtgcctgaaaccaatcacaccacggactcattcaccattgaagagattttccaagatattaacgtaaaccgtgtttataccggttgtcgtgtttctaagatgagcattgatgttcagcctaacggcatttcctctgtcaccgtttcattcttagggcaaaaaagtgaagagctacaagccacttactttaccaatcctaccccgattgctcaatcaggaaaattggcaggggtaaaaggaaaactgttactcaataaagcggaagtcggttttgtgacaggttttaagattgacatcgatctcggtgcaagcagtgagcctgttttaggtgcaacttacgcccctgatgtgtttattggcacagtcaaagtcagtggttcgttttctacttacttgaaagataaaaagatgtggcaagcggttagaaatggcacatccctttcacttgccttacgaatggatgctgaaagtgaaaccaactcagattatgttacgttaattttacctggcgtgaaactcacttcatccgaagtcaacagtggcgataacttaattcaaaccctgaattatgatgcgtttcccgctgtttttgatgcacaaagcaccattgatgatagcttgaaaaaagcaaccacaatgattgtacaagacacactcgcctaaccttaaccaagctccttaaacggagctttttttatacctaaattttacctaaaccgcctttattggcggttttttcgtttataaggaacaaaaaatgaacttaaaaaaccttgccaaagagaatatttcagactcacatcgctttgaacttgttcatcctgtaacgggtgaaggattgggagcatttattagtgtagtgagcgcaaaatcagatcaagctcaaaagttctttgcaaaacaattacgcaaagagcaaaaacgcgaattggaaaatgctcgttctcgccaccctaaatttaaggaatttgatgaaatcaaacaagaaagtatcgagttagcattaaatcgtatggttggttgggaaaatgtggaatttggcgacaaaaaagaactgccattcacggaagaaaacgcccgaatgttattaacggaatgtgattggattattgaacaagtccttgaacattctaacgatttgggaaagttcttgaagagctaattgatgatttgttggcatacgctaaaaaagaatttgaattagacaaaaagccaaaggattctgattgcaccttgcgagaacatcttttggctattcaagagcagactggtagtgttcctgaagagcttgagaatatcgaaattagcccagcgataagttatctgctgggttttttctatgagctatctctttctcgacagtcaggtatggggctttgtcctattacttatgctgagattgaggcgtggaatagactgcttcagatagagttagcagtatgggaaatcaaggtaattaaacagcttgatgtgattttcctgaatgtacaaaatacggagatttagtgtggaaacctttaactttaatcccgattggggaatgcaactcacgaaaaaacctgaggtgatgaaacttaagtttggtaatggttacgagcaagtagcacccaaaggattaaatcacaatctccgcatttatgatatttcttttagtggcacagaagagcgtattaagcaaatagacgcatttttagatagacacggtgggtataaatcgtttttatggactccgaacagttcaacacaaggaaaatttcgttgtgacgaatggaaaacaaaccaacaacaaggcttttggacgctttcagctcaatttagggaagtggtagcgtaaatttgttgaaatttaatcggtgtagtgttagatttcaaaaaaaggagtcgcatatgttcttattttcctgtgtaaaagccgttttcatcggttggctgatgagttgggttatatttttcgtattaggggcttttgctcaagatattacgctcttttatgccacgatttttggtctatccgtcaccctgattggctctgttgcatttgggctttataaaaataaagtctatttagatcgattaaagaaagagctggaaattcaacagcaaaaagacgctgagaaaaatcaggtaaagcatgtaatcattaaatagattttgcaaaaaatatcaatatcaaaccgcttgtgtcatgagatgcaagcggttttatttttgaggtaggaaaaatgacagatttagcaacattagccattaaagtcaccacaagcggtgcggataagtctgctcgtgatttaaacaatgtagaacgcgccgcaaaaagaacagaaaccgccactgaacaattaaataaatgctttgggcgtttacaggcgttattggctttatctggaataggcggtgggatttctcacctcttagcgctggcggacaaaatgcagtctttacgcaatcaagtgcagtttgtgacaagttctatgactgaaatgaaccaagtgcaaaaggaattatttgagattgcccaacgtacaaggggaagtttagaggcaacaacaacgctttatacccgctcagctcgtgcgttaaaagattatggttatgcgcaaaaagatattctgcaatttactgaaacaatgaataaagcaatggctgttggtggtgtgagtgctgaggctcaagcaagtgcattatttcagttgtcgcaagccttaggttcagggcaattacaaggcgatgaatttaaaaccattgcggaatctgctccgattattcttgatgtgcttgcagaatatatggggaaaagccgtgcggaagtgaaaaaattagcaggggaaggacaattaacatctaaattaatttttgaagcgtttaacggttcaacggaaaaaattaaccaaaaatttgagcaaatgccgttgtcctttggtggcgcaatgcaacaaatggaaaatgcctttatgaaatttgcggatgaacaaaaccgcactttaggtattacagaaaacttagcggcaggtatttcttttcttgcacagaattttgagtatttagccggtgtgcttttggcaattgcagctggcaatggggctaagtttatttcaacgttggttcttgctcgagtggaaacacacagacaagcgcaagcgagtttaatcgctgcgaaagccacacaaacccaagcagcggcagaattagcagctgcacaagccaaaatgaatttgttgaattcagaaatgcaattagcacgaaccaagaaagctagagcagcgattgaggctaaaatggctcaacaagcacaagttattacggggcttattaatgcggaggcggttgcaatgaataaccttgcgacagcgtctcaacgcgcgtctattgcaagtaacgccgccgcaggggcaaaaaatttattaagtggcgcattaggtcttattggtggcccagctggggcggcaactattgctgcgggtgcgttgttttatttcacccaaaaagcgcaagaggcaaaagaggcagcgttagataccgagagtgcgaataaccgtttaaaagaaagttatgacggcttaagcgaaagcgcactgactttgaagattattgagcaaactcaagcaatggaaaattatagcgagcaaatttccaaagtgcgggcggaaatctctcaaattcaaacaagtgcgtggcaatttggtttggaactgtctgaaagttccaagcaagatcttgaaaaattaaacgcggaattagaaagaattcgggaaaataaaaatatcgatctttcagttttaagcaaccaattaaccgctcttggtggtgtgtttttgtcaaatggaaaaagcattgatgattttcgtaccaaaatgaaaaatctaggtatcgatgccaatacagcagatggtgttattgccagtttaagtaacacaataaaacagcagaaagaggcggctcaaggtggcgtaaaagccaatttagagctagatgaggcgtttaagaaactaaaagagcgctctttgacggtggctcaaaatcttgaagtggcaaaattgaaacagcaaggacaagcagaatccgcttttgttttagcaggcttatatgaattacttggggaaaagggggctgaatataaccaagtgctaattgatattgccaacggtacgattaccgcagctaatgcagcggataaaagcattgatttatctatcgaaaccttgaataagctgattgaaggcaagcaagtattacaagggatgttcaaagatcaagctcaaacagaaagcattaatcagagtttacgtggcagtcgaggtggcggtgaaaatgcccgtgatagctggctttccttttacgatgagatccgcaaacacagccgttcgagccttgaagaaattgatgcagagcaacaacgaatgctccaacgcttggaagaacatatgaaaaaaggggtagtttcacacgaagaatatgagtcagcaaaattggcgatttcacaacgttttgccaatgaacgtgcaaaattagcagaacagttcgcccctgagttgcaatatgcacgcgagctaaaagagcatttacaagatattcaacgacttaatgcggcagggcgtttaactcatgaccaagcgaaaaaagccacagaaaacgccacttgggatgcgggaaataaacaggcacaattagctgggcaaaatgcagtgagtgaatatgaccgctggaaagctgaattcgatccaacgcaagccatccaaaatcagcaaacctcaaagttagctgaattacaatcattgtacgatcaggaattaattcaataccaagattttgtaaatgcaaaagcacaaatcgacaacaaagctacacaagatacgcaaaatctgtttatgagtagtatctctggttttggcggagcaattgatacaatgcttggggtaatgcgtaacgcagggcaagaacaatcagatatttacaaaacaatgtttgcgatgtcaaaagcatttgcaattgcggacagtattatgaaaatacagcaaggtattgccaatgcagctgctcagccattccctgcaaatattgcagcgatggcaacagtagcatctgaaactgcaagcattatttccactattcaatctgtttcattaagcggtaatggctcactctggtattgatagcataccaaaagaaggaacgtggttgcttgatcgtggtgagcgagttgttgatagtcgtactaaccaagatttaaaagcctttttagcaaatcaaggaaaccgaaatcaagcatcgggtaaatcatctgtaaatgttcaaatcatcaacaatggtaatgcggtagatgccaaagtttctcaagaagaaacgccagatggaactcacatcacagtggaattgttaaaaacaatgagaggaatcgcaagagaagaaagtcagaatgcgatcaccaataatttcgctcgtgcgggtggtcaatttagacgataggagtatgtaatgccaaaatccctaccccaaaaaatggcaaacgaactgccaaaacttgaacaaaatgccttgattgaactgtgggaaattgatttaaggcatatcagcagtaatagcgaccaaacacgaaaaggggagttgttacgctttcacaatggcttaaatcaaggtcagcagaatgtttggtggcaaggtaacgagtaccaagcctatccaattaatgcggacggttttgagattagcggtcaagggccgagtaaccgaccgactttaacaatctcaaacctgtacggcattgtcaccgctttagccgcagatttcggacaagggattggggcgaaagtgacacgtcgtttagtctatgctcaattccttgatgctcgcaattttcctaacggacgaaactcacaagccgatccgacacaggaaagtgtcagtttattcattattgaacagctaaaaatcctcaatgatgaagtggcgacctttgagctggctttacccgcagaaacagataatgcacgtattccgttgctgatgattacgtctgatacttgcatttggccatatcgttctgcggagtgtggctacacaggcggaccggttgccgatgaaaaagataatccgacaaccgatccgaaaaaagatgcttgctctcactgtttgcgtggttgcaagctgagattcggggctaacgccattttaccgtttggaggctttccaagtacgacgcagtatggggcttgattgctatcaaggtgttttacttgtaaactatatgagttcgccattgtgttgaactatattataaacagaagaggattttatggcagccattcaaccacaaactattgcggacagcctatttcgacgcattgaggatgctcgttatatgaagaagttcacccctatgtttattaatagattacttagcgacattgagaagttgaagttaatagtacccgatttggcgtggagcatggaaggaagtgtttatgctttagccaatcaagaaagtaaagcaatttttgcttgtcagaaatctattgaactcaatcatagcgcatcaaatatctataatttagggtttacttacgaaatctttaatcaatttgaattagctttagattgttatcgacaagcatttcagatagctcgaaatggcgacataaaaatacttcgaacattagaaggtcggctaatgaacttttttgcttatgacgatttaactcctatcaaaactgagctagataaatgtaagataaaacataatattgatattattactaaattaaataaagtatttggtagtggacgtttaatgttagatttcggtcttgaagtcaatcggcttattaatcaacatattgtttctagatttatcattggtactgagtttcgtgaaattgatgagcggttacatattgttaaccttgttcaatatgtagatgaagaagatcttgaaaagatagttgagtgtaacgctaatctatcagatttattcgcagaatttgcagaaaaaaatcacctagatttagattgcttgtatctttattgtgaggcgtataaataatgattaagcatacggaattaattgaacgagctgagattttgtcaaaacaatctagcgaaattgaatggagagatagcatcaaacatagttattattacttttatcatgagcttaaccaatttctctctaaacacaagattgatttaatggataagagttatggtgaacatcaatttgcgattgaaaaattaaaaagtattgaaaatcgctcagctaaaaccttagcaagatatgttcaaatattaaaagataaacgtgtaataagttgttataaacttgatgcaaatgtttcacaatttcaagcaagacaacaattaaaagaatgccaaaatgcgataattaaattaaaggaactggatacattattacaagaaaaataatctataagcccgatatgttcgggcttttttattgggagtaaaaatggaaacacctgatttagaatttaaaatcattgctcacgccaaacgctcagaaccgcacgaaagttgcggttttgttgtttctaagggcggtgagttacgttattttccttgtgaaaatgtggctgtcgatccgattaatcattttgaaatttcacctgatgattggattcgggcggaaagcgtgggtgagattgtggcggttgttcattctcaccctgatttggacacggaaaaaggcttgccgtatttatcaaccgctgaccgtgaatgccaagtgcggttaaatttgccgttttggttggtttgcgacggaaaattgcaaaaattccgcccaatcgcaccgcttgttggtcgttcgtttgagaataacaaacaagattgccgcaatatcttacttgatgcctatatgttgtcgggattggatttgcctgacgatgtggagtacgagtttgaatggtttaaatcagacaacttgtatgaagaaaacttgctccgctttggttttgaacgattggattttgaagcacagccccagcttggcgatattgtgttactgcaaattggtagtgatgtggctaatcacgcaggcatttaccttggtcatcaaatgatgttacaccacagcgaggggcgattatctgctcgtgtgccttatgacggcgcttggttacaacaaacgcacagtatttggagatacccgaaatggtcagagttaaattttacggcgatcttaaacgatttgagcctaacgaaccgatagcgcttgaagtcagttcatttaaagagctgatgagcggactacttagccagattcaaggcttaagccaacatctacgcaaaggttattacaaagtccgaatcggaaaacgctatttaagcgaagagcagataaaaaccaatcctacaatgacacttgcagatgattgcactgtacattttacgcctgtggtggcgggggcagggaaaagcgtaggatttgtacaagcgatcgtcggtgttgcccttattgcagtagcttggtggaatcctttaggttggacggcaggtacagcaatgatggttggagcaatgggggcatcaatggcaatgggcggagtaatgcaaatgcttgctcgtccaccagatatgaacacgaaattaagtgatagcgaaaaacagcaaagtacatcattctcaaacattcgcaatcttacccctcaaggcagaccgattccgttgctttacggaaaaatgatgacaagtcttatcttgatttcgcagggtattgatacctttgatgatgtgacaacgtaaacaaattacagtcgcacaggaaactgtgacggcttttttattggagaaactatgggcggtaaaaaaggcggtggtggccatacaccttacgaagcacccgataacctaaaatcagcacagcgattaagtgcgattggcttaatttcgctaggtcctattcgtggtgcggtgacagcagatcagtatcagagtgccttctttgattacacgccgatcaaaaactcgaaaggggagtggaattatcaaaataccttgattcgctatcgtttaggctatcaagaccagcaaccccttgaagattttgatgcgtcagaaagagaagtttctgtgggtgcggaagtgaaattagaacatcctatttctcgcacggtgatcgaccctgatattgactgtttgcgaattactttaggcgtgaatgcgttatttagtcaaaacgatcaaggcgatacgcacggcacatcggtgcatctagagattttaattaacggtcagtcccgacaaactgtagtgattaacggtaaatcttcatcacgttttcaccgtagttatttaatcgacaatttaccaccacgtccattcacggtgacggtacaacgtgttacgcctgacagtaaaagccaacgtttgcagaatgcgacattttggtcgagttacacggagattattagtgccaaattgagctatcccaatatggcgatagtggggattaaaaccgattcacgctataacccgagctttccaaacattaactttctgctatatggtcgtttggtcaaagtgccgagcaattacgatcctgatacgagaacctatggcagtggtttatggcgtggggattttaagctggcgtggaccaataatcctgcgtgggtgttttacgatttagttaccaataagctagctggcttagggcaacgtttaggcgattatggcattgataaattccagttgtatcaaattgcccaatactgcgatcaacaagtaccagatggctatggcggtgttgagcctagaatggtggcaaatttatggctgacagagcaacgtgatgcttattccgtgatttcagatatggcgtcggttttccgtgcgattgtggtgtggaatggtacgcaattaaccgctattcaagacagaaatgccgatcctgtctgctcatttactcaggcgaacgttattgacggtaaatttaaccgccagtatgtaccgcttaagtccatttttactgctgttgaagtggaatatgccgacgaacgcaacaactatcaaaaagcgattgagtatgtggcagacgatgcgatgatcaaacgttatggctataacgtgaagaaaatcgttgcgtttgcctgtacttctcgtgggcaagctcgccgttatggtaagtgggtgcttgaaacgtctcgcttagagcaatgcacgatcagctttagcgtagggcgtgaagggttacaggtattaccaggtgacattatcgaaattgcggacaaatcatacgctaatgtcaatcttggtgggcgtgtgttagccattaacggcagaaccgttacccttgatgccccgattgaagtcgctggcgaaaagtacctaagttatttagtcaatgataacaacggacagcggttagttcgtcgtaaaatttcgcaaattaatgcccaaaacaaatcgcttgtgacattagatagcgagccaacaggcttacaaataatggatacttgggcgttgcataccccgttagtcagcacacaacgctatcgtgtgcttggcgtggcggaaaatgaagacggtagctacggcattaccgcattacagcacgagccacagaaagagcgaattgttgatgaaggggcaatctttactcctttgtctgaaacacgccataaagttgagccacaattaacacacttaggcgtacaaccgacgttgagcggtgatatgaaagtgtcgtgggaagtgacatcaggtaatggcacggttaaatatgacatcaaagtcttaaaagacggaaagttgtatctgtttaaacgtgatgaatccagtagtgagctgaatcttgcagatttagcaaatggtgaataccaagtcacaattattgcaagagatgcacaagggcggatgctgagcgaaaaagtacaatcctttacgattgacaatccacctacacctaaaaatatatcggtatcgggcggtttatcaggtattacgctgtcttgggattttgtggacgaagccacgcaaacggaaatctgggcaagttcaaccaacaacctagccaacgcagagcggattgcgaaagtgatagcgaatatctacacccacaatgtaggtccacgtcaaacacgttactactggttacgtcatactcgtggcattaacgtgggggattggtatcaacagcaaggcttaagcgcagaaacaggggcagatattgatgccgagcttgcgttgttgaatgaaaagctagggcgaaatattattgatgaagtctttgataccgcaatgcccgcacgcaaattggagatgactaaaaccgttgctcgtattgataacccaacggaaaacattgggtataaccaagtgtataacgaagctgacggcaagttatatgtttgggatggcagaaaatacactgctaaagtacaagtggttgatttagaaggaaaacttgcaagtagtcaattagaccaagcgcttattaatcaacttacgacagcaagcagtacagccaataatgccttatccaaagctaacaccgtacaaagtgcgttagctcaagaggtaaatcgacgcacacaagcgatgagtgatatttctaccttgcagaatagcgttgcaagtgctaaccgtagtgtttcggagctaagtcagagccttaatgctaagattgatgggattgcgattggggggtggaatttaattaaaaattctcgtctattaaacaacactacccactggaatgtaattggtggaagggatgttagaaacggaatcgcagttttaaaaaatttaaacacggcaaactggtactggaggcaaggttttaatctgcccaagaagcaatatacatttagtgctgaggtcaaacccgaaagaactgcgttttatctccatatgcacgatgggcagaaatgggttaattttcatgcaagaaatttgactccaggcatatggcaaaaaatatcgattaccttcgttagtgcgataagaaacatttcattcattaatccaggtgaaggacttgtagaattacaaaatcctatgcttgtcgaaggcaatagagctatgacttgggctccagcgcccgaagatatagagcagtctatcagtgcagtgtcagcagagttgacgagttataagtcaacgcaagcaaccaaagagcaagcgcaagcgactcaaatctcaggattaaccactcgcctagggaatgcggaatctagcctatctacaacaagtcaggctattacaacgcttaatggcactgtcagcacaatgcacacaatccaagcagtatctattgctggcaatagaaaagcacttgcgggcatctctttaggctcaaatggaggaactgaaagttctgttattgtgatggcggataaatttaacgtggtcaaaaatgcccaggatggcaacgttaagccaatgtttagtgttgttaataacaaagttgctgttaatggcgatttgattgcagatggcatagtatcggctcgaatgatggcgaccgactcaatcgccgctgggagtattcaggggggagcaattcgagcaaatcatgttgcggtaggggaattgaccgctgataaatttgcggttggattaggggggaatctcttattaaacccaatctttgccaatgtcaatgtcgatgatggcgttccgcacggttgggcgaaaggtactgtaaacggcacagttacctttgggaggcataccaataaaaactatggtttacgttcaatgggtttaccgaatgaaaactgtatatttatcagaagaactgatattggcacaaccaattatgctgaattgacacaagttgtacctgtaaacagaaggatgtggtatatggcgtctgtttatatgggcaatcacagatgcgttaaaacagagttgattattgaatatcttaacgcaaacggaaccgcaatctcggcaacgcataaaacaggtggtaatggttttaccggattagaaaccgcagagcgtgtttttatcaaatttcaagcaccggcaaattgtgaaaaagtgagattttgtttacgccaaacaggcattacagcaagaaatacaaatgctctaatgcttgtcgcccgcccaatgcttgaagaatgcaccgcacatacccgagatcctagcccttggcagaattcaggtgtgacagccattcatggtggtagtattgttacacgtagcattactgcagaacaaatagcgactaagaccattacagcggatgaaattgcaagtaaaacgctgacggcagataaactcaatattaatagcttatctgcgattagtgcgaatttgggggcagtaacggctgggagtattaacattaataatcgctttaaagtcaatacgagtggtcaagttgaaatgaggtcagcgacagcaaatgtcggtatggtgattaacaacgaccaaattgtcgtctatgacgaacaaggtcgagttagagtaaaaatcggcaggttataaatgtcgatttatattattgactaaaaacgtaagaaatctaatcacagtacaaaatatggaggagatatggcggaatatggagtacaggtgtttgacgagaatggtagattacaagccactttaacagaacaagaaatgaatgtagtacattatcacctttattaccgtaaaggcacaggtaagcaacgagatatgaaatatcttgctcaacttgttaggcaatatcctggctatttggcatcaggaggggtgaatattgaaggggctggcacttggacgtgggacagcggatcgaacggctatgaagtaaatccacaacaacccgtgataatgggcgaagagtggtacacgatgtctgcggtagccgaagaatcgtcaaatccttttatccgaccttggacgatgccaggatcagcttgtatttacgacaaagacagcaataagtttatttgtcgtgccaataatgcgtatatttcgggattactaatcactgtgggaagcaagtaatgacagcacaagggattcaactggatcgtctgcaaatcaagcaaaattatcgagccttaaattttctggtgcgtggtgtgactagaccttatggtaattacattgaggtatttgagtttacttcaaactcacaacctaccgtctttgcacgtccggttgctgataatgtcaacacagcatcacactatttagtaaaaaatggaaatcgctacaaagcctactttttggccaaggttgaagtttttgttttcagccaagacttaaatcgcaaagcggcctacggcattgagattgttaatgaagcaggcaataaatttttcagcacaggagattaccctgtaaaacctattggcatgttctatctgccagcgattgggccaaatggctatgttcaatggcaagtctcgaatacggataaggttgcctataatctgctgaataaccgaatgtcggtggcttatagaccagcatctaagacaatcacttattggagagatgtggttaaacgggtaggtagctactttagagtagagcacgcagtagtatatagcggttcttcttatggtggcgaccactatttcgactacatagataatatcggtgcattaggtaacagtgcaccaaatgcaatttgccttattgatatttcaaacattccgtaaaattttttaccgaactcaccgcttgtattgttacaagcggttttttctaaaacaaaccaaaggagtcttatatggcaacatttaacaaaatcttaaatccactttattcaaccatctctggtttcaatatggatcagagtggttcaatgaatgttacctatcaaataggtacagcagttgaaaacgaagaaaaccaagtgacagaattcaatccgattgtgactgagtataaatatcttgatgctcaacaagcaatggaagtgatgatgcaaccacttaaaaaagaagatattggtaagtcgttccaagatttgatgattaggcgtatttacgactatatgaaagagcaggggatgattcaggtgtaaaaatcagagtggatagcctccattgtggaggcttgtttccagacttgcgagttagatcgcaaaataatttcttagattaatttttgggtattatgattgatattacttcataatcaaccatttaacaaatggtattaaaatcaacatgttactcttttaaatctattccagctagtttattttcgctgtgcattaacaacttctcctatcccttttcgtaaatcatcaccaagctgcctaaaatcattctgcatattttttaagtcatcttgtggagaaccgatatcaattgaagcaaataatggggcgatattgaacatagaaccaaaaccaataaagaaattggcaatgcattgatgttttgtcattttcatattgatttcctaaattaaagttattaagccacacacaaaaaaagcctgcaaatgcaagccctgtcacgttccgtattttaaaaaagcactttctgttgaaggtgggggtatcttaaattaaatggcggtgtcaatatggaataaaaaagcctacgaggtaggcttattcattctcttgttgttgcttttctaaaacacttgctttgcctcgtccaaatcctgcccagtaaccagcaagtaatgcaccaccgatttttagcatttctaatgcaaaatctgttttatctgtgtacattgcaataaccacaataattgtgataacaacaacacctacaccaattaagatatggcgttgtgaatgaagtttagaaactgcagtaatttgttgagtgcgatcgcctttttgagcttcaatacttgcgagtgcaattttctcattagattcaatgcgtttccgttcaagctctaattccttttcttttacagcctgattcgcttgttgaaccttcacaagatctcgcattgtagcaagaagttgtgcgtccgttggttgtgggtttttattattcattaacgtactggacaaagctgtggcgttttataagtgatttggaatgaaccataaccaccagagccaattttaggtggaacaaaagtaacattctggatgttgttacttactgtggattttctcgcttcgtttaagtactgtttcgctgaaacgttgcgaacctttttaggtacaagcagtggcgttttagtcatatgaaataccttgtttgagtgatgaaaatcccttgtgaaataaggattttatataaaaaaacacattgaagtggttgtaaactttctgttgaaagcacggctatcttaatccgaaggggcggtggttgtcaaatacaaaagcctgcggaaatagcaagctttgtggttattgtttgggtttatcttcgtcaatccatttttctgcaagccattcaaactcacaaaacagtttattgttgttatttttaatacgacgcaattccataatatagggtttcaacgtattccagtcagtgattacgctacttttactcattcgtttataaacggcttcatcaaataaattctctttgatgccaacacaaataaattcaatcgagttgagaatatcaagtacgatgaaattttgtcgatttgtttcatctgttgcttctgcatgtttttcgagggagcaagctaagctcgtgaagtttagccccccatcacgcattttcatataagattttcggcgtttgcggtaataggcattattgctattgctgataagtaattcgatagttgctttttgtttgtgctgttttcgtaattctttcagttgtgaccacgcaaaataggctaggtaacctgtgaataaacaagttcctagccctacaagcagattaatatcaaagttaaagttactaaaatataccagcatttcattggtggtaggttgaggcattaaacttcccatccttcatttagtgaaaaaccgtcccaaccttcgttaattgatttagacatttcattactcctaatttaaaactaaaatacacaaaaaaagcctgcaaatgcaagccctgtcacgttccgtattttaaaaaagcactttctgttgaaagtgggggtatcttaaattaaagggcggtgggtgtcaattagattttattcatcgaaccattgagtttcagaattttataaataacaggctcttcttcgatatattcaaccaatacatccaccaagaagattttgtgataagggtattcttcgttgatgatcatggtgtctttaagtgatttatcttcaaatcgcactcttactggctttgatgaaatcgcagggataatggctctgtcgtgagctttgctttgagcgtctgcggtggacgaccaataaagcgtggtgtttcgtaaggtattttcttcacgctctttgaggagtttcaattctcggttaatgttattttgagctagccctgccattgcattgtcggcgtgtagatgaatatgcacatcgccttgattattcgatacttgtagattgaattgtgctttggggtcgatagcgataggttctaaaatattgttagcattttttaacattgccagtgtaagtcgttcgggcttttcgcctttattcattgcccagtctaaaatcattttgagatgtcctccaaattcgagaatggcattaccctgttcaattatcgggtaggtgcttgaaaccagtgcggcaagctcaacaaggaaacagccttgtgtgatttttttccacataaatatgctgttcgcaaggctcaatttcaattttgttgtcttggataaattggcggtattctgcagctatcccttccatactttggcaaaaggtagagagttgtagcggttcactgttatcaatttcgatgagtagtttcatatttttgtctattgtgtaatgtgtttcagctaccataccgcacctcaaattttggatacaaaaaaagccgtgttagacggcttagattgagataatgttaaactgaaagggcggtgggtgtcaaatacaaaaacattaattattttagtttaaccttaaaaatatcttgattatttatttggtttaacctaaaatatgcttgttttcggaatggttctgaaaataagaagcccagctttcactgggccactaaatggagctaggatatgaagattttcagagttctaatcctagttaccgtagtattactcacctgttgttcaggtacggtagtttaaggtaactcctgaagggggaaggtcggatgtccccctgacggctccaactataagccttttggcttaaaagatcaacaaggaatttctatgcaaactgaaaaacgctctcgtggtcgcccaaaatctggtttaactcttcaggaactgcaagcaagaagcgaagctaagcgtggggttaagctcaaaggctttaaacttcatcaagaaacgatagagcttattgaacgccttgccgagcaacacggtatttcacaaacacaggtgattgtgcaagcggttgagttatttaatcagaaaggggcgtaatgccctttattctttcattagcgccatccaaaatagagttttccctagtttttgtttgactacacttaatttcaggttgatgatgctgagaattaagcataaacacgttaatgaaatcaaccagctcatctgcctagtccccattaaaaattaaacccctgcccgtgtgttacgactttttcgatttcttcgtagcggcggacgttaaatttctcaaactctaatactttgactaggctttctgctttagccttgagttgttcgagttcttgctgttgtttgaaattctgtgcgacaagttctgaaatgtgttcgtttgctcgaataacggcaagggcttgccgtgagcagagtgtcatataatagtttaactgcttacgcagtttgaaaggattgagggttttcataacggttcctttgtaataaatagagtggggtgtagtaggtatctattacgttatttgcaataggatttgcgtgttgaatgatggcggatatacccaagagtgaaagttgcacatagcacatctgaacactttttaagtcgatatcttgcgcaataacgagtaattgttgctgcggattatagccttgtgattttaatgtttcgcaaaagctgataattaatgcaccgcttccgcaagtgggctcgttcagcgtgaaatagcctttctcgtctatttcgcttggggcaataagcatatttgccatcacttgacccgtagaaagaggtgtgaaacattgtccacgttgtttgttggcaatttgtagcttcatatagcattggcctaacacatcttgaggttcttcttctaaaagattaagaagaatttgtcccagctgatgaaattgatacatctcatcatcggtgtagcgtgatttaatggagaagtatctttcatcacgatcttgaaagggtttgctaatggcacaagcacagatttcaacaaagtcttgaaacactcttaaattgtcatgtttacgccccattgtttggataagagaaagcaactcattcacattagatattctccaaaagcgcagatagtgccgcaggctctactgcaaaatcccaatacattgtgcttgaggctcttttgttgtcgggatctgaattgatgtttacttgggttttatttttaggcaatatctctctagggagtaggagaatacgatagccactcggtgggccatcacttttttcaacttcatcatctgaagcaaaaaggcaaaagaaatccggtaagttatcaggatcgtaccttaaagcatattgattcgagcctctaactttcctaaccgaagaatacttcacgtcaatctctttgttgtttacaacaaaatcaaaacgaggattattcatttgatactgcatattcatatcaatagcagaagggactaaacgtttaaattcattctccgcccaatctccttttaaaccagtttctgctcgctctttataactcgcccagtttggggataaatttaactgttcaagggtttttgccacaatccacacggtcaaaccaacatcttttgtgatttctttaaggtcgccattgtgtcgataataactatccaagacgcgatattgtgttgtttccgtttgtttaacaaaaccgtgatactttaatgtaaggtaaacgatacctgcccgcagatttaaggcgtcagcaaatttcgctacatccgcataggacgtataatgttcttttgccattttaagcaactgctgttctttgtctttatctgcgataatttgtcttttttgtggttgcaaataaggctcaatattttctgtcattattaactccataaaaaaactcacctagatagcgagttagttaagaattctactttgagcaacttcaatcagtagtttgtattcgtgatgggtcttgtcatcgtggacttcttttgattttgataaaaactcgtccaccgtgcctgtaaagcaaccacgagtaacaattaacccaaattttccattaaagaccgtaagcgttccattttctgagcctacattacttgcccaaaaaatcattttgcgttcagagataactgcaaaagatctcacccgagcatcaccgaacacccgagcgatatcgtacacccgagcatcaccgcacaccccagcgttaccgtacacgcaagcgtcaccgtacacccgagcatcaccgaacacccaagcgttaccgaacacccaagccttaccgtacaccccagcgttaccgtacacgcaagcgttaccgaacacccaagccttaccgtacacccgagcattaccgtacacccgagcattaccgtacacccaagcattatcgtacaccccagcgttaccgtacacgcaagcgtcaccgcacacccgagcattatcgtacacccaagcattaccgctatgatctaaattcttttcggtttcgatataaccgcctaattggcctgctccaactaaaccaaatgtaataagtgctttaattcgatagagcgttctgcctaaatgttctactgtgtcatctttgagtagttcgtatttcttttgtgtagtttgttctgtcatttttaatttccttgcaataaaaaaccgcctgtattgctacaagcggttggttttcgtgaaaatgttgcaataaaaaagccaccgtaaaaacgatggcttagtgaaataatgcttgatttagttagataactaacttataataactttgttttcagtaataatgctgaaaacgagctgggtctgacctttaatctacccaactttgaagaggataatcaaatgtttaaatacattatcctagttatcatcttgttagtacttagctcgccagcttactaatttgatgataatttaacgagagggagaaatctctctcgttcttcaaaactaatgttaaggatttattatggcgatgtcaagaaccgaaattgttaaacgcagtgaggaaaaacacggtattaaactcaaagccttcaaacttcctttagttgtgattgctgaaattgagcagttaagtacagagttaaatattccacaaaatcagttgattattcaagccgttgagctgtttaagcaatcgcagaaaggggcgtaatgccctttatcaaaacgccctcaaaactaagggcgttaattaaactcaaaacagtatttcatcatcaaagttatttgctggcagacgttcatcatcagcataaccgtcccattctttctgttttgtttgttgttgctgttttggcttaccctgtggttcttgtgcccagttgttgttactgttaccaccttgcgaactactgagcatttcgagtttgtcggcgataatctcggtggtgtagcggtctgtaccgtcttgcgcttgccatttgcgggtacgaagtttcccttcaatgtaaaccttagagcctttctttaggtattgccccataatttcggctaatttcctaaaagcgataatgctgtgccattcggtattttgctttttctcgcccgtttgtttgtcggtccattcttccgatgtggcgacactaattttaacgacggggtcaccgtttggcattgtacgcatatcagggttattgccgagattgccgactatgattactttattcacgcctgccattacatatactcctgaatgatttgttgataataattttgtgctgaggtgagcctttcttggattttggcaatcacttcttcatctcgcttgatggtgacggtggtaattcgcttggattgtggaatttgctctactaggtcgattagcttttcgccgttgtcgtagcttgagattaaatcaagcggagtggggaagagtacaaagtcgatttgtgcttcttcgcaatcccaaagccacatatagccttgcatttggtagtcataacctgcttttttggctttttcttcggcttcgtcttggaaaaaggggtgagagccaatgtcccacgagcattttgtatcaataatgagcttgcgtgatggaacgtaaatatcacattcgcccgtgatgaaggcgttttctctgcgttctgtgttctttttaagaaccaatccacgagtaaagccacttaatttgatggcttgctcttcaagctgattacctttttcggtgtacttgttgccgtcaaaggattggtagccgaacaagtcaaactttgcaatctctcgcaccgcatttttggcagtatcggaaattttgcccgcatctttatctgcttttgagcgtggctcgctcattagttggtgaagttgagagcaacggacttttaggttatacattttttccattgtgtttcctttgggtgatgatggtggattaaacttaatttgatgggtgtcaatcattcccttttattttcgagctcttctaaaatcgcatactgctctttgctgaattcatagccgttatcgcataagtcttgcaaagtggcatcaccgctgatgatgttttgcttacatttttcaaacacgtcatcattgacttttaattcggtaaattcagcttcttgaacttcattatcagggtaagaaaattctgcgttttctacatctttgacaaccgcttgatctgccagtaccgcttgttgcatttctacggaaagtggggcttgtttagagagtagcaacttaagaaccgttttgattgccatcgcctcaaagttgtcgtgccatacgccataaccttttttataggtttgtgagtagcgtgcggcgtggtcgtacacgtcttgggtactcatatagagttcggcagtaaattcgttgatcaacttgaaataagcatagtagccgattggtttttcatctttggctggcttttgtttccagtcaaattcaaaaccgtttattgggtcttcagcaatcagttgtttctcgtaaactggcactgcaacaaggcgtttaaattgccctgaccgttgtgccagttgaattaagcctttatagccgagttggaactgggcttccgtctttttctcttttcgattttgatacggcacaatgtatgcaaaacctaagccattttgtagcggtagattgagcgttgctgccatacacgccgcattaaatacactcattggatcggcattgcgaagcattgcgttgctattgacgatttgcagaacgctggtggtaaatgtcgcagcgtttttgttaagcaatgcttgtaatttttgctgtacgtttgggctttcaaataaagtcttaatcgggaatttgttttctttgttttgagttgctggtgtggtttgtgtggtcatacgtcttttctcccaaatagccaagtttggtcttggtaatctcgctctcttggattgcagatgagaacttcttcgcaaaactcgtcccattcatcagggacgacttcatcgttatatttcgcttgttgatgtgcttcaaacttttctagtgcgtcgtagtaatcatctttggtttcgtatcgcattgggtcaggtactcgcattttgttgctcctgagttttcttcaccatttccgctaatgctccgaacatctgcggttcaagtacaatcgtgttggcgttggctcttctgtctagcattaggcggacattgccgtttttatctaccagatagccttttaagccgtaaggggtaaatggtttgcgtttgggctgtgatggcttcggcttcggctcaacttgttctgttggtgctgtttcaatctcaacttgttccgtcggtgctatttgctcaacctgctctgcttggataactgttacttttagcccaacttttttagcttgctcaattacaatcggattatgcccttcgatttcagggtagtgagggatagctcttttaccgactaagcctttttgactgttatatctatcaatggctttgtttaaatttcggatagcaataatttccgatgtcattggtatgccttgaaacactagatgtttatccacccacatttcaccgaagtattttttatttgggttttgtaaaatttgaagtttgatcatctttttgctcctacaatcagtttgttaagttggttttggttatgttgtttaatcagcttcacatcttcacctgtaacgttatcaggcggtggaagatgtagggctaatgcgttgtaatttacctcttcaggggtgatttcagcttgtttgaagtcatcttccgtccaaatcttctctgcttggaaattgctttctacggggagagtagagacaagctcaggctcttcacagccagttaaacttccgcctgtcacaaaggcgataagcaaggcaccgagtaggtatttcaggttgagttttttgataagtgtcttcattttttattccttttgttgaattttgggtgtaggaagccaccgcaggctttcggggaaagtgcggtggggttgggttgtggttaaaatcttgctaatcgttgttgattaagctgaggtaagacttgttcaataaaagggtcaagccatacgttaaattcgtgtgcgatgtcgtaggcttttcctgcaatatcgtttttaacatagcgagaaatgcctaaatcttcgtacagtttacgatgaaatacttccacttcttttgcaaaggctcttgctcttaccaagtatttggcaatctgttctgctttttcgtgtggaagaacgacatcaggtttaggttcaagcggtacgatttgcgtagaattttgcaattcgcctttatgcattgcgagaaacgctcttaatacgaccaagtggaattttgggctgatccacattgcgtaagcgagggcgagttcttcgcaggcgtatgttccgccttgtgtgcctcgtagggttttaattgggagaacggcgatgttttctttttgaatttcagaaataagatcttgcgtttgctgatttttaacaaagaaagttgggcgatgtttaggatcattaccacttgctaaatgtagatcatttaatgaataaaggttttcgtatgtacgaatagaagttttaagaattgataagtttgacattttatgccccttgattttcagttagtctttcgatcaaccttagtagggttgatcgggcttcaactaccaaatcaagctggcggagcttatttcccgaaggtgttttattaggctctctcgacccgaccactgaaatgtgagaaatctcacatttaaattttaggcataaaaaaaccgctttttaatcggagcgttagataaccgacttgatttagtagtgtggttatcttaatccgaagtagcggtttttgtcaatgggatttactctgtttccgagattttaaattgaacagcaacgagagagtaatcatcaataggtgatttctctattcttttttgtaaggttgctgaaaatttcacaatgctattcatcgttttttcagagaagcgtgggcgatgttcccaaaaatgatgagcaccgtctgacataatgtagatggagacctcattattctcatccttaatttctgacatcggaataaagaattcatctggtttcatttcgacttgtgtagaaattgccgtggtgatgacattttttcctgatagctcttttaattctttctttgtatagattttttcatcaaataacttttgatgagttgtgtgatctttcgttttttggcgaagtttattaccttgctttatatatagacgacagtcaccaatatgccctatgcacaatccttcttgtgttaaataaccaaatgttaaggttgtagatgcttggttatattctgggtcaagttttttaatttcagccaaactagcggaaaatacattattgtaagctagttctaggtttttgatcgcgattctggaggcaatttctccgcctttgtatcctccaacaccatcagccactgcaaataagtaaccgttattgtgtttagtgcaagatagaatatgatcttgattttgccgtatttgttcttttggaaaagagaatgatgcactagcaattaagttaatcattgaattattcccccatcaaatgatttatatcattaataatttcttgcactgacatatacctatctttaggttttctagctgtacatttttgcatgattttatcatatttagagtctagctgtaattcttccattacaacaccgatagcaaaaatatcagattgtattgaataatcaccgccacttaaaatttctggcgacatatactgtgatgtccccattttttgtccaatttgcgtaagagcagtagatgcactatttagatttttcgttaagcccaaagcaattcagccaatcgcactttttctttaaattcattgacggcttttttagcgtacgtcaatgaataagaatgttctcgtttttcagggaatttttttaggtccgaatgcttgtcttctgcctcttttagcttatgtttgaaatactcaaggctttcaggcatagataaatcaattttttcagccattgattcccagtatgcaattttatcggcataactttcggcttttttcatttcttcaacagccttatccattcttttagcattacgttcaatcaaggctctgtgttgtttttcgctgtgatgtccgatttttattggttcagcaagacttaaaaagtcacgcccctcattagccgcctcacaatattgattactgcgttttgcggcgttatcagcatattcttgataacgttccgctttcgctgtggctcgagcttgactatccaacccatcacaacggacaaaagagtaaaaataaaatccaccttgttgtttaacgaggttgtgtatttcaacctccgtttcattgccgtatttacttgtcacggtaataatttcgttcttttcgtgctgctcttggcattttgctaaaaatacgtttgggcagaactttgcatatgtattcattttttcacctcaaaaaaacacccacctgttacagtgggctaacgtagcggatcatcattatgattacgggtgttttaagtgcttaccgtatacacttttgtttgttgccattcagaaccgcacttagttctggcttagttatccttgatttggtaacagcgctattacccagacctttagcggatctctaaatgcggttttgaatggcgactgtgatttttacccttgccacagtcagcaagttccttattgtttctcacaacatcaaggaatataattcaatttctcacaacataaatagggatttaattatgagtaattctgagttcacttttgcaaacgctgtacaagtcgcagccattcttttacgcaatgatattgaaatttatgataaagacggcactcatatttcagaaaatgtggaggctcagtcagatttagcttgtcgcctttttatgttggcgagcggtcttgttgagcaacatcaagctcgttttggaaagcctgagtgagccatttttttaattcaaagtgcttttcagcattaatttgcattctctcaatagcatcaataggttcaagtagcttttcaatttgatgttgaatagcggtcttttgcatattgatgtggtcgttttgtggaggagtaaaggtaatacctctgttcattgttattccgttcactgttatgctaatttgggcgtacattgatgtcattttatactccttaaaaaattaatgaatggtgcgttgatttgctacgctggctcaacgctaagcctcgatagccatttcgttgagttcaacgagatggtcagccgtctctccgagctgtcacgtttttagctaacgtttgctgtctgttgctttttcattgttcaccaactaaaaaacagaccaaaaaatgtggttctgtccccactatccgttccactcactggcaaacttggcgatagtgggttagtcgtcacctcaatggttctgttgccaatctgccgtcacggcagtttttcacataagactaaacgttcaatcagccagcggggcttttaatccgctagtttaagcaactgcacttattgaccgcttgaggtgtttttgtctgaatttttaaagagcattgagccgtagctcgttttgatgggtgtattatcacttaatgtgatttaaaagtaaataacaaaatgtgatttaattaatataaaaatcactttttgtgattaatgtattgattttaaagggaaataaattttgtaatgtgtgtttgattgcttgttttttaatcattttcttggcgtcaggaagatgtttttgcagaaatttgatgagatttgaccgcttgttgtgagtgttaggtggggttagttagtagtagtatggagtagttagtagtagatttttggcgagaaaaagcccgcagggtgcgggcgaatttgctattttttctctttcactattgcaacaaaatagtgtccttcttgttgataacctatgattttttgagctttttgctgtgattctgcggtaggctcattttttttaggtgcaacaagtgaggttcttgttttgaatgtgtgccgctctgcttttattgcaattttcatttgagtgtcagtaaataatctcgtagagtgtcagattttggtgtggttttgcgattattcttaaccacagtatatgccttttcgcctttttggcgagtaacttgataagttagacctttttcgtcagtaaagttccattcgtgcgaagtgtcactttctgtacactgccaatctaagccattgtaatcaattttacttaaatcgttaagaatatctctcacattattgtatcttttttcaacatcgacttctaaacattggcaaacaattttcatcaatggctcaggaatatgcggaagaataatgcttcttgtcgggaattttttgttgtataagcctttggtaagcgtagtttgtgttattgagatgctgtaccgaataattgggtggaagagtgttatttagtagtttgattaggcaactttttaattcattttgactatatggagataactttgttgtcttatcaatggcaagaaaacagaaatgacttaataagtcattattctgcgtaagattttgttttattatttgtgtcatttcatttcttacactaatttcaatttcttggataagtgaagaaaaaatagatgcacgatgttgcaaggctgtatatatgcaaatagtgcgtttagacagagagaattgtaattcacctgggtacgcatttttacatagagcactgtagggcgctaatcggcttttcgatattgcattaaaatgttgtaatactgacatatcttctaaaaaattattgacaatagcggaatactttattaatctagctacatctggcaagttgcccggtgggcgtagggtaaagcttacgtaccttcgataacctataaggcaggatttctatcctgcctttttcattttaaattagctcgtaaccatgatctcaatgtttcagttgtccatcgagggtaactacctatatagacatcaggtttagcaaatttgtaatgttcagttcgttctaacgatgagttaaacattgccctgccgagctctccaaatagtgagtttgtagggatttgatatttggggtctgcattttttacccattgatgaaaaacttctataggaatacctagacgagaggctatattatccgcagttaaaagtggattccttcccataataatttcatcaatcaatttatctttatcaaagtctcctttttgctcttgtaagagcatattttttgctgcttttaatgcagaagtttcttctttcctaaatgtgtctgcaagatctgaatttggtagtttgatttttctcatgttatttcctttgtatttttacaataaatttactactatttcccaacaagattcaacgtggctctacaaataactcctatgctcaaccgctacgcctataatacgaatatcttgtttcattgagctaagcgttgggaaatcttgatttaatggcactagctcaaaatgtggattgcctgatggtgataactctccaagttcacgataacgttttaaggtcgcttcgccattgccatttactgctgcaacaaaatcgccaggatgtgggcgttttctgacatcaatcaacactaaatccccttcgctgaatttaggctccatagacattcctgacactcgtaagaagaatgcatctggacctgcgtcaatttccgtgtcgatatagtcgtacccttctgtatctcgatagtcaaagacttcaggccatactccagcttgaattgagctaattaaagggtatgagtatgaattcttaactattacaggctctacattcgggtcgccaaaagcaagctttgctggatctataccaataacttttgctatcacttcaatatcatcaagatcaggcattcttacatttgtttcgtagttagcaattctagattgcccccatttagaacgctctcttgtatcaatttttgatacagcttctgcaaaatccttttggttcattcctgttttggctctaaaagcttttatccgctcacctattttcatataccgctccttaacctataaccaaacaataatatcacgcaatgaaatatcatcaaaatcacaaaaagtgttttacataaatcacttgatgtgattaaatgtgcgttatcttaatcacaaaaaaggataactatgaataatcttgcaaaagtaagggaaagcgtaggtattactcaaaagcaattagccgatcaactcggatttggacaaccaagaatagctaactatgaaactggtaatcgaactccatcgttagctgatgctagaagaattgtatctgctcttaataaatttggtgctacaacatctttagacgacgtttttcctgttggcagttaatttacccaaaggagtgtgcaatggcacgcaatgaattaagcaagtctgcaatgaagaatgcggacttaatcagacagaaggcatcatagacgaaagatgctcaagcggcagaatatgttggtgtagatgcatcaacgatttgtcgttttaaggcagaacatttagacaaattctgtgcttaccttgattttttagaattggaagtatcagagaaaggtttaaatcgtttgacagacagtgaactggatgccctcaagctatttgcagagaagggcgttcatgctattggaaaataaaaacccacgctggaacgtgggtatatcaaagggagataatgtttatgaaaacagagttattatctactaatcagagagaaaatgcaaccctaacgatgagtagtcgggagattgcacgaatcacagaaagcagacaccgtgatgtgtgcttatctattagaaacctgatgaataaaggggtaattggggggtatgcggaaagtccgtacacccatgagcaaaatgggcaagtctattacgagtatcatattaataaacgtgatacttatgtgattgtggctcaattctctcctgaatttactgctcgtttagttgatcgttggcaagagttagagcaaaagcaagtgcaacaactccctagctattcagaagcattacgccaactcgccgataaaatcgaagagagtgagcaaaaatcccttcaaattgcctcaatggaaagttatttccgtaatgggatttcaccgtttgagtttgtcaaaggcttgaatggagtgaacgctttgaaaattggggcgtttttagtggataaaaactggctctatcaagatggtaatcataaacgtgtgaagtcgtacgctcgtgatcagtatttgacggaagaaacgacggagatttcgcaacacggaaaagatccgtttgtggcatataaacctgttttactcaagaaaggagctgcaaagctctatgagtggtacacaaagcgagaattaccgatgaaagcaaattggaatggcgtatttacacaagataaggtggtgggattatgagttttagccaaaaattacgccaactgggacagcctattgcgtactatccacaattagcaaaaccgttaggcggtgtgacagcggcaattttatttgggcaattattcttttggcaggataagacctcaaacccattaggcgtatataaaacacaagctgagcttgagcaggaaacgggattaagtcgccgtgagcaagaaacggctcgcaaaaaattagttgagctaggcatattggttgaaactcacaaacgcttagagcaccgcatttatttcaaactggatttagttaaatttgatgcattaatggacgacattcgggaagaagcaaaaccgccattacccaatgtcactaatgaacattccccaatggcggaaagcgacattcgggaagaagcaaaaccgccattcgttaatacagagaatacttcagagaatactaacaataatacttccctgacgggaagtataaacgcgcgcgagaaaaaatccgcagatttgattttgttggaaaagtttgggattaccgaacaactggcaaaagatttcatcgttcatcggaaatctttcaaagctccgatcaccgaaactgcgttgaaaggttttcagcgtgaggcggataaagccaaaattcctattcaacaagctattgcgatttcgattgagcgtggttggcgtgggttcaatgctggttgggattggcaaaatgacggagtttctgcaaaaaatccacaaaatccgtccgctcgtaatacttccaagccgtttatccctgatgacgaaggcaactgggcggaaggtatgtctatcacgctaaggggaagttaatgcaaaacgtggcatcaatgaacttgaaaagccttgtcgggcaagagccaaattaccaagtgccagcaaaggcaacggcaattcctgacggtgcgattagaaccgttaatcaattattcattcagcttcgggcgatttttcctgcgtggaagaattcatttcctgatgcagacagttaccgtgaagcaaagcggatttggcttgaaacgttggtgaacgaaaaaattacgacgattgagcaactgcaaaacgggattgagcgagcgaaaaaatctaaaaatccattctggccaagcgtaggcgagtttgtggagtggtgtaaagcggtggactatgaagcgttaggtttgcctgatgaggataaactttacaagcggttacaagcgtttatggcatttggtatggaagaaatccagaagtttaagtttgtttctacggcggagtattacttgattaccgatttgtatgtgcgttgtcggactggtgaatggagcgataagcaactcaaagatgagattaaaaaatccctcgtcaaaatgagcaagcggttaaaaacaagggaggttttaccagaaccaaagctggcattacctcaagaagtgaaagcagtcgatcgtgaaaaggtgagggctttctggggtggtttgttgaaacaggttagggggttttaggtgagttttgatgtaggtgggtatgagtgattacaaatgccccaaatgtggcggagatctagaagatttaagcattaacgatgattggggctggcacgttgaagagccttatcgctgtaacggtcattacacagggcgattccccaacatcagcaaggattgtgcgatgaacagaacgaagtcttgtgggtattttacgaaagagcaggttaagaagtaaggaggttggtaggtatggaacaaaggttggtaggtatggagcataagcaaaaatactttctacgcactgagcaaatcaaaaacaatgcccttgaatttgtgaaagcgttgccgatagatgagaaaaagccgttagtgattgatgtgaagcctattactcgtaaccttgagcaaaatgccaaattccacgcaatgtgtggcgatattgccagacaggtgcaatttaacggcgaatggctaccgcctgaaacgtggaaggtcattttaatttctgcccacgctgaagcaacgaaagaaggctcttttttggtcacaggattggaaggcgaattagtgaatattcgtgagagtacggctcaaatgagcgtaaaacgaatggcaagtttaatcgaatatgcaacttcgtggggtgtttctaatggggtgcattttaatgacagatggaatttttggggggtgaaatgatggaaattaaatctttttcttttggaaaattaattgcggatttagctattgttggtggctttgtttattcgcacttgtatctcacggatggcgcagtaaatgtttatatttgggctttctgggcattttctattttaactttaatgtctgcgtttattaagcccactaagtttttgttcacggaaaacagagccaagcaaatgattataagtgagttaactattagcttggtcttggtttattttgggtatccagtattagctacggtcggttttatatcaactcttgcttatgctggctgtagaactgtaaagaacaacaagaaaacaggtaaacacaatgagtagttacttctgcccaaactgccaatcaattcttaaagactggcgtaggttttctgaaaagtcagagattgataaggtaaaaccgtttgaatgtactggcttgaagtgcactaagcggtggagtgaggaagaattggaggcatttaatgataaagccgaaagtgaaaaagcgtaaatgcaaatgctgtggtggtgagtttaagtctgcggatagctttagaaaatggtgtagtgctgaatgtggtgtgaaacttgccaaaatagcccaagagaaagcacgtcagaaagccatagaaaagcgaaatcgagaagaaagggcaaagattaaagcaacgagagaacgcttaaaatctcgttctgaatggcttaaagacgctcaggctgtttttaatgaatacattcgtttacgagataaagatgagccttgtatttcgtgccagcgttttcatcaagggcagtatcacgctgggcattatcgcacggtaaaagcgatgccagagctgagatttaatgaggacaatgttcataaacaatgtagtgcttgtaacaatcatttgagcggaaacattacagaataccgtatcaaccttgtacgtaaaatcggggcagagcgagtagaagcattggaaagctatcaccctcctgtgaagtggtcggttgaggattgtaaggaaattattcaaacgtataaggcgaagattaaggagttgaaatgattagattacatatcagcattgacgatattctactcgtttgggttcgtcgttgggcttctcatcgtgggtgtcgtggttatccatcattacaatcttttatgcgtgaggcaactgctcaaattacaaagtatagtattgataaactgtcagaggaacagtatcttaagctagatgaagctgtgatgacattacacgatttgaatttggaagcctatcaggtgctaatggcagtgtttttacaagggcaggataagaagaatatttgtcttgaaatgcagatttcaccgactacatttgataaccgtttacgcaccgcacgagattttatggaaggggcggtatttggttcggggttgattagactgaagttttaggcgtattgctacgccttattttgttctgcaaacagcttaataccttgagtaacaatttgcgttttagacagacccgattgttcagagagttcggttagtaaagcaatcacttcttcgtggagtttaaagccaaccatacgcaccccacgttttttatcgcttttctcttgaatttctttttttgttagtgccattttcgctacctttggttgatttttaaaactgaagttgttatattaggagccgttgggggacactctcacatatcccccgcagggttatctattaactagtaagcgtaattgcttaccaccaacaagataactaggatgattagcttccaaggcatatcctagctccttttttgagaccgctcaccagaagggcggtttcttcatttctagcccttgctaaaaacaaagttattatagtttaaactatatttaattgcaatagtaaaaactacattattttatttgacaaccccaaaacttcagagtagtatttatcccaaaggtctcaaaagccttataaacagcggtaattcaccccgtcagcgtgattttttttgtttctattgtttgttaccaaagaactttagaacaaaagtaacaaatttaattcaatggtcggcagtgcgaagaatacaatacccgaaagggaaataattccgcctgactgtttacaggttttgagctgccgaccgcccgatttatcgggatttctctcaaaaggaataaacagatgactactcaaatttcaactcaaacaatctctttctacggttcagaacttattacattaaaagtcgaagatgttatctacacagcggtaaaacctatcgttgaagctatggggttagactggggcggacaacaacaaaaactaagcaaatcaagcgataaattcaactgtagagatatctctatggttgctaaagacggcaaaattcgccaaatgctctgtatgccacttaaaaaactcaatggctggttatttagcatcaaccctgaaaaagttcgccccgatctgaaagatcgtgtaattcagtatcaagaagaatgttttgaagctctctacaattactggcactttggcaaagccgaacgcaaaacaaccacagacgaacgcacaggcttacgacaagcagtcagtgctttagtcagtaaaaaaggtttaatctattctgatgcctactcacttattcatcagcgttttaatgttgagcatattgacgaattaacccctgaacaagtcggaatggcggtggagtatgttcacaaaatttatcttgaaggggagttgattattgatgagcctaagaaagaagatgaacaattattaagattacttgtttcagcataccatttttgctacgaagcccacgagttacgagaaaagattgttaaaacatatataggctgggatatagatagacactttagcccacattatcttcataacttaggcattccacttgaacaatttttagaaaagacaagagattttattcactctaatagcgaacgcattatgtttgttaaaggaatgaaccatttgctagaagaaccgaagcaaacagcaagattttaagcaacaataaacgacaaacagaccgcttgcgacctagcgttgcaagtggcttttgtgtttcaaaaaaataatgtgtttaatcgctcaaaaagtgattgacagcttgagcaaaaagtagtacatttcagctacgcttgcaactcgtacaagcgagagaaatcaaaatgattttatagccctgatcggaaacggtcggggctttttgtttgggggttaggatggaacaacgagatattctgttaaaaaacggtgaagtagttcaagaaaaatctcaatgtcactatgccgctggctggccatctcgacgtatatcagactgcggtcctcacttccaaaataggaaaatttatccatttgctggcaataatgacgtaccacaagattaaacatatctagtggtactgagtaaatttgataaaggttatcacaatggtagaactaaatgttgcgttaaaaaatgccgcagagctttatggtgaaaatcgaccatttgtcgatcctgaaagtggaactctaaccctagcaggttgcgaagctctaagtcgtcttggtattggattttccgaaagtagacttgaacctgatcttttagataagttgcgtaagaatctcgctgctctttagtaaaacctgttgtgagtttttctatgaaaaaaaggtgaagatccttttcgagttgaactaagaagttaaagttgtttgcaattttggcatctttaaatgtgaattcaatataagagaaatggctattatcatattttcctatccagtgagaacaacctagtgtgataaaggggctatcaggcttgttaagttcaataagtgtggttttaagttctggtagttgagcaatttctaggatttcatctattttttcaggatgattaactaaatcaattccacctgcatttggtgttggattttggcaatcttcagatccatttgatggtcgatatggaaatttggtataaccttcacgaaagtacataatttaatcctctgctagtttatttgttggggaacaatattctagcagtttttttaaccaagctcagtctttacggactgggcttttttattgcctgaaacgagggctaaggtatgaaaaatgctatgagagatgcaggaatgcagagctatgcatggaatgggcttacaggttggttagcctggttaggcgatcaacaaaatttaatgttcattagtttggctctagggattgttacagcgttagttaatatgtactcaaaatgccgagaagggaaagtaaaaaaacgcctaagaagaaagggctgaagaaaagcataaagcagagatgcgccacctcgaagaaatgcatcagatacgtaaacaacaactctcaaggggattaagtaatgagaaagctaagaaaactgggtaaagttggcggtggggtttgttttgtcagtgccattattgcggtgttgaatacagattttcacggtcaatttcgtacaagtaagcaagggcttgaaattatcggcgatgcagaaggttgtaaacgagagccttatttgtgtcctgcaaatgtgcttaccgttggcattggttcaacggaagcgtcaagcggtaagattgaaagaaaagtttacacagacaaagagattgcacagcgttggttggttgatattcagcacgcagaaaaatgtgtgaagcgttacgcaaacggttggaatattccgcaatcggtgtttgatgttgctacttcgctgacgtttaatgctgggtgtggcaccgtgagtaaatcgacgttctttcgtaaaatcaaatcaggcgattatgttggtgcctgtaatgagttgcctaagtgggtttattcaggtggcaagaagttacgagggttagaaatccgtcgtgagaaagagaaggcgttatgtttagctgggttaataaaatcttaatggcattgattttgggcttgtgtgcgtggctatggggtcagtcacggaggatagatagcttgacagccgagaaccaaacacaagcccaaactattgagcaacagcaaaaagcaaacaataagctgacaatgcaactgcaacaagagcgacaagcggtggaataccagcaaaatgttgcaaataaactgcgaaagcaggtggagcagagtaatgaacagattaaagctattttacagaaagagccgtgtagcgttactgctttgcctcgtcctgttgtcgatgagcttaagcggttgcacagcaaagacaaagattgagtatttatatcctccgcaagcctttttagtgcagtgtgagcggtcagagtttggtggcacaacctatggtgatgctatcgagtatctcgttaaggtgatgggagaacgtgacttgtgtgcgggtcagattgatagcattagagagtggtataacaaatacaaataagaaatatgaccgcagtcactgctttctgagtacattgcggttttcttttgtgtaaaacaaatgctacataatttgcatatggttttggggttgttagataaatccccgagaaaatacgcaagtgatgtaatttatatataacaaattttaaggatttatcttatgaccaagaaagacgagggtaaatccacgtctaaaggtcgtgggttaacacctaagcaagaaaaattctgccagctttatattgagcttggcaatgcgagtgaggcttatcggcaggcttacgattgttcaaaaatgagtaatgaaacaatcaatacgaaagctaaagaactactgaagaacggtccgattacggtccgattggatgagttaagaagttctcatcaacaacgtcataacattaccgttgataacttgttaggcaagctagagcgtatctataacgaggcgatggagcgtgatacccctcaattctcatctgcggtaaatgcggtaatgggacaagctaaacttttaggctttgacaaacaggttatcgatcatacaaactctgacggctcacttcgccctacggttattgagttggtggcaccaaatgaaaatacagcttaatcttccccctaaactgataccggtgtttacacagcagaatgtgcgttatcgtggtgcttatggtggtcgtggttcggcaaaaacacgcacttttgccaagatgactgcggttgttgcatatcaacgggcaatgcaaggcgaaagcggtgtcattttgtgtggtcgtgagtttatgaactcgttggaagattcatcattagaagagattaagcaagccattcaaagtgaaccgtggttagcaaatttttttgatgttggtgagaaatatgtacgcacaaagtgcggtcgaatttcctatatttttacaggtttacggcacaatcttgacagtattaaatcaaaagcacggattttacttgcgtggattgacgaagcggaaagtgtgagtgaaatggcatggcggaaacttctgcctacggtgcgtgaaaacggttcggaaatttggttaacgtggaaccctgaaaagaaaggttcggcaacggatttacgctttaggcaacatcaagacgaaagtatggcgattgttgagatgaattatagcgataatccgtggtttcctgatgtattagagcaagaacgcttaagggataaagcccgtttagatgatgcgacttatcgttggatttgggagggggattatcttgaagaaagcgaggctcaagtctttagaggaaaataccaagagcttgagtttaagcctttacctgattttgaaggcccttatcacgggttggatttcggttttgctcacgacccaactgccgcagttaaatgctgggtgtttaaggatgaattgtatattgaatatgaggctggcaaagtcgggttagagcttgatgatacagcgacatttttgcagaaaggtattgccagcattgagcagtatgtaatacgagcagactcagcaagacctgagtctattagctatttaaagcgacacggcttgcctcgtattgatggcgtttcaaaatggaaagggagtgttgaagatgggattgctcatattaaatcctacaagaaaatctacattcacccacgttgtcagcaaaccttgaacgaatttcgcttgtatagctacaaaaccgaccgcttgtctggcgatgtgttgcctgttgtaattgatgcacataaccactttattgatgcgttacggtatgccttaacgccgttgataaaagtgaaaagtgccaaaggagttttactatgagcctagagcaagaccgattggcttttttagccgaagccctagggcttggcaataccaagcggaaaaaattatgggatgaattcggctaccctaaaaatttggtattttctcacttccataaggcttacaaacgaaacagcgtggcgtttgctgctattgagcgattgctcaatcaatgctggatagacgtacctgtaatcgtcgaaggcggaaaaaaagatgaagtagaaaagacatccgaatgggaggctttggtcgaaagatttctgaagccccattgggctgcaataaaagaagcggacaagcgtaatcttgtcgggaactattctgcattattgattcaagttaaagatggccaacaatgggatcaaccaattttgcaaaattcacttactaagttgggtgagttcggattggtgcgtcttattcccgtgtggcaatctcagctttctgtgcttgattatcaagaggacattgccgcagataactatggtgagcctttgatgtatcagtttagtgagttggcattcggcaagaaagggcgtggacgagatattaaagttcacgcaagcagagtaattctgctcaacgaaggtggtgattttaattctcctgagtcgggagtgccgctacttgaacctggttacaacaaattgctagaccttgaaaaaacatctggcggtagtgcggaaggatttctgaaaaatgcgagccgacagttggggatcaaattaaccaaagacgttgatttgagacaacttgaagaaggtgcgaaagccttaggttttacttcgttttctgaagctttaaatgacaaaattaaaaaaataaatactggtacagattctgctttagttactcaagagggagatgcttccgtgctatctgtggctccagccgatcccaaaccaacgtgggaaatttctgcaaatgagtttgccgcatcggttcagatcccatttacgattttgttcggtcagcagacgggacgattggcaagtgacgaagataaagcggactgggccaatcgttgtaatgctcggcgtaatggttttttaagtgagacgatcaagcaggtgcttgagcgattgtggttcattggtgttttgccaatgcctaaaaatggtgagattacggtttcgtggtctgacttattagctccaagcgaaaaggacaagatcgcaaacgcacaggctttgacatccgttgcaacaacatcacaatctgctttcggtgcatctgtgatagtaccaaacgaaattcgtgaagcattagggtttgagccgctacctgataatccactgccgccaacaattgaacaagacgatgaaaatcaagacgaaaatcaaaccactaaggattcctacaaataaagccgatccgcttaatatgggcgtatcggtggccaagttgtttcgtcacattgatagcatttattcgcaaatcaagcggtcagttaatttgcaaattttgcaaaaaatatcaaatcgactgcaaactaataatcttgagtattatccaccttatctcacttctggcgagttggcggagctgcttgagattttgcaaaaaatcatcgacaaagagatgttggcaaatggaccgcaaggcgaaaatctttggtttgatgtctatatcgacgaagctaccttaaaaggcacgcaatcggcagttactgatttaagtctgcaatctgagatttatcgtgctaagcgaaatctatcatcaatcatctttagccctgcttattttaaccgtttggcactagctcacacagcaagctatagcgagtggcaagggttaagtgacgagttgcgaaagactttagcaggtgtgatcacggaagcagtttttaatggcagtaacgtaaaagagactgctagagagattaaacaaaaacttgatgtatccgccaagcgagctaaacgaatggcacaatcaagccagttggcagcatacagacgggcagaatggcaagaggcagaagaagcaaaacaagagcttggactaaacaccaagctcttgcatttttcagcactcaaagcaacaacgagactgacacatgcacaacggcacggtaaatactttgatgtggcggaagtgcgggcgtggtacagcaaagacggtaatcagttcaactgttactgtaagcagtcagtggtggttgttaatgctgacggtaaaacagatattgagccactcttgcttgagttggcaaaagaacgtaaacaatgggtgggagcattaaaaaatgtcaaaaaatagcgtaaatatcatctcagtcgtcaatagcaacaacatcagtaatgagacgattgacggcgaccagcatttaatcattcgtggtgttgtgcctatcgttgatgatgtcgtgatgaacgacggactatatccagcggcagaaatccagaaaagttacaacagccttgaaggtaacttgatgccattagggcatccgcaaatagaaggtaaatatgtgtctgcccaagatgtaagagcggtgaacaagcaccacgttggagcttgggcaaaaaacgttcgaaaagaaaatgataaggtgctggttgatatgtatatcaatcgccgttttgcggaaggttctgatcagggtaaaaatttgttggcacgtcttgatgatttagtggcaaatcaaaaagccgaaccaatccacgtatcaacgggactgatcttaaacaaagtaaaacagtctggtaagtctaaaggtaaaaaatatagctggattgcgacgaatatggcgtttgaccatattgcgattttgcttgatgtgcctggtgccgcaacaccagaagacggtgtaggaatttttgtaaaccaagatggaagcgaaatgggggtggaaaatgtaaacctatcacaagcggttgattaccgcacggaaaacctacttgataaagtccgattttattttatgcaaaattcagacttgtcttttgatgagatctaccgaattttgcgtgaagcgattcgcccagaaggcaacgataagtggtctttatggatcgaagcggtttatccgaaatattttatttattctgacgacaatagcggcaagaaatacaagcggagctattacattgacgaaaatgacaaggtgcagcttacaagtgagcctgtcgaagtagttaagaaaatcggctacgaagaactcacaacaaatggagatcaaaacgaaatgaaagacaaaatcttagcggctcttaatgcggcaaatgttaaaaccgaaggcttggatgatgaacagcttttaactgcttacaacaaattgcaagcagaaaaaggcaaagaacctgaaaagccgaaagaagatggtgacaaggctattgatgaaaaaatcaaaaaagcagttaatgaagcaattgcaccattgcaagcagttttacaagctaatgcggataaagagcaagctgcaatgcgtgatgcagttaaaactaaatttaacctgagtgatactgcggtcaatgcgttaaatggagatgctctgaaagagatgtacgctcaaacacaacaagcggctgggttaaacaacaattcagcgaatcaaaatggcaaaaaccagtgggatggctacacccttaaccaaaaggagagcgaaaatgagtaacgtaatctatcgtggttcggtcaaacgtgaaccacttgtggaaaatatcgtgatcaacgatacgtcagcaccaggtgcggtggttaagttgagcaacggaaaattagaggcggcggctgatttaaaaggtcgccgttttttattgggcaacaaccgatttaaggggcagacggtagatcaaccttatgccaagggtgacacagcaaccgcttttcgtcttgagcctgaacaagagtattacgcacaaattgcagacggtacctataactatggcgatgagctaactgtaaaacaagcgggcggtaaactcaccaaggcggaggtgggcgatgtggtgttatttttctttgacgaaaaagcgcaacgtcaaattagcggtggcaaaggttatgccgatgtcgttgttgccaatgcttacaccaaataaggagcaataaaaaatgttgaaattcacaaaagagcaagaacgtttcgtaattaacgagcggatcaattacgacaaaaaacatgtactaatggccacaaattcagcggggatgttgggtaactcaatgacgttgccgaaagacgtttgggcagaatgggatcgtgatgcggtgcaaattcagcgtgaagagctggtggtatttaatgacttggcgagcatttccaaatctatgcctattggtaagttaattcaccatttccaaaccgtttcagatagcggatcggtcaatatctcgttagatggccgctcttctgcaaaaacagataacgtagtgtataactaccacggtacgccattaccaattattgattctagcttctcttttggctggcgtgatatgtcagcggcacaaagcgaagggtatcaaattgatagtgcggcacgtgcaaacagcctacgcaaagtggcagagaaaatggaagacttagccctaaacggtgataagtctatcgtagttggtgatgcaaagttatacggtttacgtaccgctcctaatcgtatgaccaacactcacagtcttgatttagccacagcaacacctaaacagatttacgatgtattccgtgatttgattagcaagttccacggcaaaaacttctattcaccagttacgctctacgtaaactatggtgactatttcgcaatgagtacacgtgattactccgagcagaaatccgaagggtctatcttggacaaagtgatgacgattccgcaaattgcgaaaatcgtacctgcaagtcgtgtgcttaaagacgaaattctcggcttgtgcaaacgttcagacgtgtaccaagtgcttaatggtatgccgttggtgacacgtccaattgcccgccacaacgaaacagacgactacgcattccagattatgactgcggttgcggttgagtttaagtttgacgacaaaggcaatgcgggctatatccagtacactaaatcctaaggtggtgcgaaatgaagtggctattaacacacgatagccacgagttaaagaaaggcgatgtttacgaaggtgaaacattgccactttggcttgtggggaaagcggttgaagtcgaagaaaaagcctttgaagtggcaacaccaaaaggtaatactgatggcgaaactggcgaaactggcgaaactggcgaaactggcgaaactggcgaaactggcgaaactggcgaaactggcgaaactggcgaaactggcgaaactggcgaaactggcgaaactggcgaaactggcgaaactggcgaaactggcgaaactggcgaaactggcgaaaccaagaaaggcaaaaaggacaaataactatggctattgagatagagcttgatgatgctcgaataatgcttaacgaacttggctttacttcgcccgattcattgttagagctttatgttgcacaggcaaattcgctggatagcaagctagacggtgcaggctataaagacgagacacaaaagctaatcaagctctatcttgttgctatccttgctatttcttcgggggcaagacggattaaatcagaatcagctccaagtggagcaagccgaacgtttgagtatggcaatgatgtgattggtcatctcaaatctgctattcgtgggattgaccaaaaaggctgtgcggacgaattattaccaaaagataaggcgattgggttcttcgatgtggtcggggggtgctaaatgtcaaatgtggctaattggtcttacaccgccaaagcaacaatctggcaatcgcaaggcaaaaataatgatggcattcagactttttttgagcccattattattgattgtgattatggcgtaaatgcaaaaatggcacgctttgagattggtcgagagcaatcggttaaaaatgtaatttggacggagttctcagcggcaaaactcggcgattatgtgttgattggcgaaagtagtgctgtagatccttttgtggcaggggcggacgagattatccatatccagcgatttgcagatacatttgagcgtaagcaagatgattatgctttattgacaggtggcggataatgggcgtcaaggttaagggtattaagcagacaaagcggcaattaaaacaattgattggcgagattcacgcaaccaaggcaacccgtgcaatgagccgcattttaaatacagttgcaccgcttgcagctcattacactccagtggacacatcaacgctaatcaacagtcaattcaccgagatggagctaaacggtacacgcttaactgggcggataggatattctgcaaattatgcggtttatgttcacgatccgagagttaagcaaaatttccgtaagccatcagcaaaaaaagagtttttgacttcggcattaaaagagtcacaaccagcgattcaggcaatcattaaggaggagttgtcattatgatttcttatgtcaaagccttcaagcggtggctcgagcaacaatcgcttgtggacgattatgtggtacagctatatcaatgggaggacgctcaaaaaatcaagcctgtgatagtgatccagcccaatagcggaacaccacaagtcgcagatttaagcagtgagcattatcttttgattagccttgtggcgagcaaaagctcaggctacatgatcgaagaacgagcaagggctattttagataaagttttatccaatccttttacaaatttcgggtacatcgagtcaatgggtagcatttctgccccaatgtttaccgaggataaccgaatgattatcaggctacaatttaagattgtatcaacaaatcaataggagtaattatgggatcatcatctcaaacaacaagcaattcagaaaacctaatggttggtcgggcagtcgtgttggagtacgcaacgaccgaagtaaaaccacaaagctccgaatggaaagcagcgggagcgatgacaacaaaaagctgggattttagccctaacactgtcacgtcagaagcagacgatacaggcggatttccagaatcacttgtgactaattcggactttagtatttcaggcgaaggtgagtggcggaaacgtccaaaatccacagagcttgggattaaggatattgtcactgtttatgttaattcagttaaagctcgcaagcagccttatctatgggttcgcttaaactatggagatatgactttcatcggtaagatgatcatcactgcattaagcagcgaagcaccgactaatgacttagttaagttctcaatcgagcttaaagtaggtgatgcaagcacgctggaaatctcttaattaaaaaccccaccctttatttaaaggtggggttattctgcaaatttaagcaagcgatagctgcaatggtctgccaagacttgccaagattctgccaatcgtgtcaatcctagttgtatgtcttggggctaaaatccgatggatttctggcggcttaatattatttaggcgagcaacttctgcttttgagataaatttttcgcacatagtgttgtgcagtaaaattttcgcataaacgctctctggtataaacacagatgtttcataaattccagcagggcgtgatagcgggaacgctcgctcatcatcgaaatagatttctacactagataataaaacatcttcagccatttccatcgcttcttcaaatgtatcaccttgagtgatcgcttctggaatatctggaaatgtcaccacaaatcccccttcttcggcaggggtaaataacgctggataaaacatattttctccttaattggtgaggtgtagcgaaagccccttaacatcaggggctttatattattttaagcctagttgctttttaaccccttccactaaaccagtttttaactcttggctagggtgtttggggaggtggcttcttttgccgttgtagtagagctttaaatgttttgtgccattctcaacttctaccccgttagcctttagccacctaaggaattcgctttgcttcactacctcctcctatctgtttaacttggtagtattttagcaaaaatgctaatattgtcaataaaaaattaacaaaaatgctaactttttgaggtgaaaaatgactttgacaccaataagcgaaattggcgaaatgcttgtttcgactgaaaaccgagactttttatttaagcctagcttcaagaacatttataaaatcggtagcccgaaagaaattgtcgaaatatatgcgttattacacggcagtgaaattcgggagaggatgccgtacattttgactaaatcagagccacatcagtctttcttttgggctatgctaaattcgccagttttcggtagaaaaattttgcaaaacgcaatgtttgtgatgtcttgctgttgtgacgatgatatttctagccttgttggtgagtggttgccgtcaaagtcaggtgtaaaatataagtttggcacattacctcctaaaaccattatcaattttgcaaaaaatttaatggtccacggggtgattggttgctgcgaattaccaaagcaagaaaaatctgcaaataacgaattttcggaaagttttgatgtaatagagtacataagtttagctcgaactcatttcaacatgagccgagaagatgccgaaaatctgacaatgacagagctgcaacaattgcttaaaagtcaaattctgcctgaaaatacaaaagcgggaatgttcaccgaagatgaatatgatcagattatggcggagtatgaaaaaaataagaaagcggctgagtagccgccaacattaaaagaattttcctgataaaataggttttggcggtggaaaaacgaatcttaattcgtagaatggtaaaatttctttatttttaaggtatttttatgaaaaaaatgattgtttttgtagcttctgttttgtcatcttttgttattgcatcggattgggaaataatagaagcgactcaaaataaggtgaaagctgagcttataagaaaatcagaaaaaaaagcagagttatgtttaaatgttgctcaggctgtcttaattactaatcaaaaagtacaaaaagatactttctcaatgtgtggtgaattttcgacagagattgtcttttctgactctaaagcatatagccttgcagtatgtggaaaggttaaaggtaaagatattatcggaaatccgatagagagcgactatatataccaaagagcaactaaggatttttactttaattataatggcaaaaaatcagcttattatgatcctcaatctgatcttgcaaggcttaaagaggcctcagactctatgtttaatgctatgcaaaatagatattgtaagtgatgcttgcattggtttttaaatatttaactcaaataatttatgtgtttttagtttaatagggcaatttatggatgcaagggattgcaaaaatttaatgtaacaaaaatatagattgaattgtatttaaccaatctattgctagataaattgtaaaaaaatcacagaaatgaccgcttgtgctatgtaacaagcggttttttatgcaaataatttaagggattgtttatgacggtcgaagttggtggagttgttattactgcagatttagagtttgaaaatctgataagagatactcaaaaggttgataaagcgatggacgacattggtaaatcaaccttaaaaggaaaaaaagggcttgaagagctagaaacacaggcaaccaaaacagcgacagcagtaaatcaagccacaaacaaaatgaaaaatatccgtggagtagcaggtcagctgggttatcaaatacaagatattgcagtgcagttacaaatggggcagaatgcttttatggtttttgggcagcagggctcccagatcttaagcatactaggaccgatgggagctgtagctggtgcggttttagctatcagtggtgcaatggctggagcattattgccaagtttggttgagacaacagaagcatctgaagtattagcaactgcacaaaaaaatttaaatgaagtagttactcaaacggaaagtggtgtttctgctctttctgcggaaatcattaaattagcaaaaattagtgaagatgccgcaaaggcaaaaattgcagtggctatgattgatgcaaaaactgccattaaggcagcaggggattcgtcacaaaaggcatttgagcaatttgatggattttttggatcgtttacaaacggaagtcaaagtattcggaacgcaattgaccaattaaatcgctatgaatcaaaaggtaaagatgttggtgctgtaataaaagagcttggtggatcatatagtggtgcgattgccgaagttaatgctctaaattcagtgacaatcgaaatgtctaaaacacttggtattactcaatctgaagcccttggtttgataaaactgttggctcaactagaacgagacagaagccctgagaatgttaagttattggcggtggcgttgactcatttaagtgaaaaaaacaaatggactaatgatgagttaagcaaattaacacgaaccattaatgctaactctgcttcagcacttagtgctgaagaatcaataagaattttagattctgccctgaaagatttacaaggaactatccaaaactcccaaggtgcattggatggcaatgtagcaaaaatgaatcaacttgcagatgcggcagaaagaaaagctgcaacgataggcaagactgagcgtgaaactgctaaatatgcagctacgctattagctacaaccgatgaagctaaaaaaaatcttgattccacattaagtaggattgacgcatcatacgatcaaatcgaagcctatcaaaccgagcaaaaagccttacaagataaaaagaccgcagatgcaaaagctgccagagaagctgaagcggctgcaaaaaaatccgctcaagccaagaagcaagttgttgaacagttgagacaaatggctacacagtacgagattgctgttttgaggcaaaagggaatgcatctcgaagccgtaaaattagaagctggtatgcgtttaggagctgcggcaacaaaagagcaacgagaagaagctgaaaaactagcacaaagcatttatggagcaaccgcagcaagtcagaactttaacgctatgcaagctcaagcatctcctgttgctgcattagaccaacgacatcaacagcagctagctcagatcgaagaatataaaatcttgtacccgcaaaaaataatggaggcagaagctgcgagagctgcaatcgaagaacaataccgccagcaacgaatggaagctcaatgggaggagtggaagcaagcgagcgacggggcgagaatgtttggtgatgcggttgatgctgttggttcaagtgcaacaagcacaattacgggattgctaaatggcacaatgtctgtgcgtgatgctttcgcatcaattgcaaatactatcttaaatagtgtagtacaaagccttgtcgaaatgggtatggctcaagttaagcaaatgattatagggcagactgctgcgaaagcatctatggcagctcaaatggtgcaggctaaagcgttagctgctgcttttgctccagcagcatctatggtgtctttggcaacgcaaggagctaatgctgtaccagctaaggcagctattacatccactatgggggttgctcaaatggcggcagtgaccggtcgtaaagtaggtggtcctgtatcagcaaatcaaatgtatcgggttggcgaaaataaccagccagagatatttaaggcgagtaatgggatgcaatatatgatcccaggtcaaagcggtcgagtttttagcaacaagcaatcacaaagccgaagtggtggcgatagcaaaagcgtgacgattgtagtcaatcaaaccaatcattttagtagcgatgatgcaaatagcaatcaagttggtttggctaaattacttggcgaacaagttaagactgcggttagggttgagcttcaggctcaaatgagatctggcgggatgttatcaaggtaagggtatgcaaacatttgattttagagtcgaacaaaactataccgttcagcacgaacctgatgtaactactttagtctttggtggcggctatgaacaaacagccccgaaaggacttaatcataatcgtagaaaatatcaaggggttacagttagggcagacaaggcggaatcggagcgtttacgccagtttctgaatactcacggcggatataaaaaatttcagtggttggataaaacaagcggacaaatggtgactgttcgctgtagaagctggagctacacaaaaataggctcaatcattgagttttcacttaattttgacgaggtggtttaaatgccaaaatccctaccccaaaaaatggcaaacgaactgccaaaactggaacaaaatgccttgattgaactgtgggaaattgatttaaggcatatcagcagtaatagcgaccaaacacgaaaaggggagctattacgctttcacaatggcttaaatcaaggtcagcagaatgtttggtggcaaggtaacgaataccaagcctatccaattcaagcggacggttttgagattagcggtcaagggccgagtaaccgaccgactttaacaatctcaaacctgtacggcattgtcaccgctttagccgcagatttcggacaagggattggggcgaaagtgacacgtcgtttagtctatgctcaattccttgatgctcgcaattttcctaacggacgaaactcacaagccgatccgacacaggaaagtgtcagtttattcattattgaacagctaaaaatcctcaatgatgaagtggcgacctttgagctggctttacccgcagaaacagataatgcacgtattccgttgctgatgattacgtctgatacttgcatttggccatatcgttctgcggagtgtggctacacaggcggaccggttgccgatgaaaaagataatccgacaaccgatccgaaaaaagatgcttgctctcactgtttgcgtggttgcaagctgagattcggggctaacgccattttaccgtttggaggctttccaagtacgacgcagtatggggcttgattgctatcaaggtgttttacttgtaaactatatgagttcgccattgtgttgaactatattataaacagaagaggattttatggcagccattcaaccacaaactattgcggacagcctatttcgacgcattgaggatgctcgttatatgaagaagttcacccctatgtttattaatagattacttagcgacattgagaagttgaagttaatagtacccgatttggcgtggagcatggaaggaagtgtttatgctttagccaatcaagaaagtaaagcaatttttgcttgtcagaaatctattgaactcaatcatagcgcatcaaatatctataatttagggtttacttacgaaatctttaatcaatttgaattagctttagattgttatcgacaagcatttcagatagctcgaaatggcgacataaaaatacttcgaacattagaaggtcggctaatgaacttttttgcttatgacgatttaactcctatcaaaactgagctagataaatgtaagataaaacataatattgatattattactaaattaaataaagtatttggtagtggacgtttaatgttagatttcggtcttgaagtcaatcggcttattaatcaacatattgtttctagatttatcattggtactgagtttcgtgaaattgatgagcggttacatattgttaaccttgttcaatatgtagatgaagaagatcttgaaaagatagttgagtgtaacgctaatctatcagatttattcgcagaatttgcagaaaaaaatcacctagatttagattgcttgtatctttattgtgaggcgtataaataatgattaagcatacggaattaattgaacgagctgagattttgtcaaaacaatctagcgaaattgaatggagagatagcatcaaacatagttattattacttttatcatgagcttaaccaatttctctctaaacacaagattgatttaatggataagagttatggtgaacatcaatttgcgattgaaaaattaaaaagtattgaaaatcgctcagctaaaaccttagcaagatatgttcaaatattaaaagataaacgtgtaataagttgttataaacttgatgcaagtgtttcacaatttcaagcaatacaacaattaaaagaatgccaaaatgcgataattaaattaaaggaattggatacattattacaagaaaaataatctataagcccgatatgttcgggcttttttattgggagtaaaaatggaaacacctgatttagaatttaaaatcattgctcacgccaaacgctcagaaccgcacgaaagttgcggttttgtcgtttctaagggtggtaagttacgttattttccttgtgaaaatgtggctgtcgatccgattaatcattttgaaatttcacctgatgattggattcgggcggaaagcgtaggtgagattgtggcggttgttcattctcaccctgatttggacacggaaaaaggcttgccgtatttatcaaccgctgaccgtgaatgccaagtgcggttaaatttgccgttttggttggtttgcgacggaaaattgcaaaaattccgcccaatcgcaccgcttgttggtcgtccgtttgagaataacaagcaagattgtcgcaatatcttacttgatgcctatatgttgtcgggattggatttgcctgacgatgtggagtacgagtttgaatggtttaaatcagacaacttgtatgaagaaaacttgctccgctttggttttgaacgattggattttgaagcacagccccagcttggcgatattgtgttactgcaaattggtagtgatgtggctaatcacgcaggcatttaccttggtcatcaaatgatgttacaccacagcgaggggcgattatctgctcgtgtgccttatgacggcgcttggttacaacaaacgcacagtatttggagatacccgaaatggtcagagttaaattttacggcgatcttaaacgatttgagcctaacgaaccgatagcgcttgaagtcagttcatttaaagagctgatgagcggactacttagccagattcaaggcttaagccaacatctacgcaaaggttattacaaagtccgaatcggaaaacgctatttaagcgaagagcagataaaaaccaatcctacaatgacacttgcagatgattgcactgtacattttacgcctgtggtggcgggggcagggaaaagcgtaggatttgtacaagcgatcgtcggtgttgcccttattgcagtagcttggtggaatcctttaggttggacggcaggtacagcaatgatggttggagcaatgggggcatcaatggcaatgggcggagtaatgcaaatgcttgctcgtccaccagatatgaacacgaaattaagtgatagcgaaaaacagcaaagtacatcattctcaaacattcgcaatcttacccctcaaggcagaccgattccgttgctttacggaaaaatgatgacaagtcttatcttgatttcgcagggtattgatacctttgatgatgtgacaacgtaaacaaattacagtcgcacaggaaactgtgacggcttttttattggagaaactatgggcggtaaaaaaggcggtggtggccatacaccttacgaagcacccgataacctaaaatcagcacagcgattaagtgcgattggcttaatttcgctaggtcctattcgtggtgcggtgacagcagatcagtatcagagtgccttctttgattacacgccgatcaaaaactcgaaaggggagtggaattatcaaaataccttgattcgctatcgtttaggctatcaagaccagcaaccccttgaagattttgatgcgtcagaaagagaagtttctgtgggtgcggaagtgaaattagaacatcctatttctcgcacggtgatcgaccctgatattgactgtttgcgaattactttaggcgtgaatgcgttatttagtcaaaacgatcaaggcgatacgcacggcacatcggtgcatctagagattttaattaacggtcagtcccgacaaactgtagtgattaacggtaaatcttcatcacgttttcaccgtagttatttaatcgacaatttaccaccacgtccattcacggtgacggtacaacgtgttacgcctgacagtaaaagccaacgtttgcagaatgcgacattttggtcgagttacacggagattattagtgccaaattgagctatcccaatatggcgatagtggggattaaaaccgattcacgctataacccgagctttccaaacattaactttctgctatatggtcgtttggtcaaagtgccgagcaattacgatcctgatacgagaacctatggcagtggtttatggcgtggggattttaagctggcgtggaccaataatcctgcgtgggtgttttacgatttagttaccaataagctagctggcttagggcaacgtttaggcgattatggcattgataaattccagttgtatcaaattgcccaatactgcgatcaacaagtaccagatggctatggcggtgttgagcctagaatggtggcaaatttatggctgacagagcaacgtgatgcttattccgtgatttcagatatggcgtcggttttccgtgcgattgtggtgtggaatggtacgcaattaaccgctattcaagacagaaatgccgatcctgtctgctcatttactcaggcgaacgttattgacggtaaatttaaccgccagtatgtaccgcttaagtccatttttactgctgttgaagtggaatatgccgacgaacgcaacaactatcaaaaagcgattgagtatgtggcagacgatgcgatgatcaaacgttatggctataacgtgaagaaaatcgttgcgtttgcctgtacttctcgtgggcaagctcgccgttatggtaagtgggtgcttgaaacgtctcgcttagagcaatgcacgatcagctttagcgtagggcgtgaagggttacaggtattaccaggtgacattatcgaaattgcggacaaatcatacgctaatgtcaatcttggtgggcgtgtgttagccattaacggcagaaccgttacccttgatgccccgattgaagtcgctggcgaaaagtacctaagttatttagtcaatgataacaacggacagcggttagttcgtcgtaaaatttcgcaaattaatgcccaaaacaaatcgcttgtgacattagatagcgagccaacaggcttacaggtaacggatacttgggcgttgcataccccgttagtcagcacacaacgctatcgtgtgcttggcgtggcggaaaatgaagacggtagctacggcattaccgcattacagcacgagccacagaaagagcgaattgttgatgaaggggcaatctttactcctttgtctgaaacacgccataaagttgagccacaattaacacacttaggcgtacaaccgacattaagcggcgatatgaaagtgtcgtgggaagtgacctcaggcaatggcacggttaaatatgacatcaaagtcttaaaagacgggaagttgtacctgtttaaacgtgatgaatccagtagtgagctgaaccttgcggatttagcaaatggtgaataccaagtcacgattatcgcacgagatgcacaagggcggatgctgagtgaaaaagtacaatcctttacgattgacaatccacctacacctaaaaatgtatcggtgtcgggcggtttatcagacattacgctgtcttgggattttgtggacgaagccacgcaaacggaaatctgggcaagttcaaccaacaaccttgctaacgcagagcgtattgcgaaagtgatagcgaatatctacacccacaatgtaggtccacgtcaaacacgttactactggttacgtcacactcgtggcattaacgtgggggattggtatcaacaacaaggcttaagcgcagaaacaggggcagatattgatgccgagcttgcgttgttgaatgaaaagctagggcgaaatattattgatgaagtctttgataccgcaatgcccgcacgcaaattggagatgactaaaaccgttgctcgtattgataacccaacggaaaacattgggtataaccaagtgtataacgaagctgacggcaaactgtatgtttgggacggcaacaaatacacggctaaagtacaagcggttgatttagaaggaaaacttgcaagtagtcaattagaccaagcgcttattaatcagcttacgacagcaagcagtacagccaataatgccttatccaaagctaacacggtacaaagtgcgttagctcaggaagtcaatcgacgcacgcaagcgattcaagcagaagccaatgctcgtggtactgcggtgagccgattagagcaagccgaccgtgagcaagctcagttaattacgacagcaaccgctaaagccgataatgcgttatcaggtttatctgaagaacgtcaagctcgtattgctggggataatgcacaagcacaggctagagcgatattaacaacgaaggtagcaagtgtagagagtggtatttctaccttgcagaatagcattgcaagtgctaatcgtagtgtttcggagctaagtcagagccttaatgctaagattgatgggattgcgattggggggtggaatttaattaaaaattctcgtctattaaacaacactacccactggaatgtaattggtggaagagatgttagaaatggaatcgcagttttaaaaaatttaaacacggcaaactggtactggaggcaaggtgcaatcaatgcacacaatccaagcagtatctattgcaggcaatagaaaagcacttgcgggcatctctttaggctcaaatggaggaactgaaagttctgtgattgtgatggccgataaatttaacgttgtcaaaaatgcacgagatggcaacgttaagccaatgtttagtgttgttaataaccaagttgctgttaacggtgatttgattggagatggcacagtatcggctcgaatgatggcggctaactcaattgctgctggggctattcaggggggagcagttcgcgcaaatcatgttgcggcaggggagatttctactgaaaaactggcttcagaggcagtcactaccgagaaaattcgaagcaacacaatcacttccgataaaattggtacagggcaaattatcacaaatcacatggtggctgggtcaatagatggaaaaattcttcgtgcagggacggtaacagcagataaagtggtagctagagtctccctacaatcaccagtgattcgaggggggattttggaagttgggagccttattggtggtaacctctatgaggttaaatctttcacaccggctggtcgaaatcaaatgagcattacgatcaagccttcaatagcacaacgattactgaaaatgacttgggattatggtactgttagattttcaggtaattctgctgctattggtggtactggcgattgggtaacaagcataaaaaattcagcaggtactgtatcacagcatttaaaaggattttacacgctcgttatcccatctaatacacaggtaacgttatctttaacatttaataccacccgtataatgaatcaaattcttgtagaaacagttgtttattctgggtcaagttatatacaataggtcataccttatgacatagggggaaattatgaaaatcttgtcttcaatatcgatgattgctttaggcgtaacattgattggttgcggaagtggtggaggcggtggaggcagtagtgctagcaatccgccctctcaagttccgacaaagaccgaaccgcaattacccacaacaccgccaacatctcaggttgaaagtgaatggaaagctaagataagggaggcgaagttaattaggatcgatcatgagacacttagactttctgacgatgtggcttttccatctcagatatttaatatggcagatgagaagcttggtaagctagaacaagaattagggcgtaattgggttctcaaagcctacaacttaccttattctgcagttggctatgtattaccagcagatgtctcaacagatgaatatggacgtgtcattgatagccgagcgaataattatatggctgaagtagttggtgcgagaacggaaatattaccaaaaggctcagcgtactatgaaggagtttcttttggtgcaaattctgagggtaaattgaagctgtccataaacttctcagacaagactatttctggttcggtgactgatagaaagctacttagcacaaaagaggcactagcagatattagcttgaaagaggcaaatatttcagctgttggagaacaccatttttcaggtgttgcggaatcccaaggaatacaaggtagctactatggctcatttttcggtccaaatgctgaagaagttggcggcatcattcgagatgatgctggcaataagtatgaaggattttctggcactaaataatttcagcctcttaacgcaaaaaaccttgatagaaaaaactatcagggtttttctttttctaaaacaaaccaaaggagtcttatatgcaaaaagatgtgaaataatggtgggtattttagatggggaatctctgtaagtctttgttttaattaaataaataaacgccttttattcgatatgtattgcccttctaaggcgtgggtcaaaggttcgaatcctttagggcgtgccatttaacaaatgaatcttttaagttcacctcctgagtttgataaaataagcaaaacccagcctatttaaaggtggctgggttttgcaagtgatgtactaattgcgaattttattgagctaaacacacaccaaattgatccgccaaagattgtaaaaattctggataggcgtttttacttaattcaatttttgcccctaacggatctaattgccctactttggctgatgtgcctttgcttaagctctcaatcacttttggcgtaaattgtggctctgcgaataaacattgtgcttttttctgagcaatgcttttcttgatggcatttaaggtttttgccccaggtgcaacggttggattgattgtgaatgaacctaatgatttcaatccataagcctcttcaaaatagccgtaagcgtcgtggaaagtgtagtaaccttttgattttacaggttctaactgttttgcaatctcgctatttttcgttgccaatgtcgctttgaaatttgctaaattctctgcaatttttgctttttgctcaggtagttgctggcttaaacgctcagcaatttgttctgcgatatgttcacttgctttaggtgataaccaaatgtgccaatcttcgtcgtgactatgtccatcgtgactgtggtcgtggtgagcgtgattgtgggaatgtttatgctcgtgtttgtgatcgtgtttatgatcgtgcttgtcttctttttcttcacctgaatgctccacaagctctttaattgcaggcacatcttcaagggttaagactttctcttttggtagtttttcaatacttttctctaaaaaagtttccatctcttccccaatccatactacgagctgtgccgattgaagttgttcaacatcagagggtttgaggctgtaatcgtgtggcgaagcactggttggtaatagcactttagtttctgtgacaccgtcggtaatcgcattagcgataaaacctagtggtttgactgtggttaaaacatcggcattggttactgcagttgcccccaataatgcaaggcttaataaactttttttaaacatagaagatctcctctcaaataaagcggtgagatcttagcagaatattgcaattaatctataatttttttatggttattagcattaatcacaaaaaaataaggacacccaaaagcgtccttataaaactgacggtaaaactacaacaacatcttcacaatcttatccaatttcacccgtccaaattttttcagtaattttttcaccttttcggggtaatcttttagctcttctaaatcgctataatgggttaagactgttgtatgtgtacgaatttgtgctaactcaccttgggtcttttcactcagctcaccctttggatcagaaatcaacacggcattttccgcatctaatttccaagctcgtgggttgagattgtttcctgtaagtagaatataacgttcatcaatccatacaccttttaagtgatagctgttcttgccatctttccacaagcggatcgttaattgcccattttgaatataatggtcgaattttttggcaaatgctcgtagatttttttcatacagatacggcaaagcggacgccatcgtaaatttttcttcaggtggcgtgaaaaagtcgtttgccgttttatcaccgacaataatttcaatctgtttgccattgtctagcaaccaagagatacgttggctgatagaacgtgggaaattgaagtaaggggtgcaaatggttaatttctgttgtacttggaaaaacagtgcttcaatcgttttattcagcggatttttacgccctaagcccactaaaggtgaaagcattagttgagaatgatccatcgttctaccgttaaaacgatattcctgttggcttaattctttacgaaacgttttaacaagcggtcggatttcaatggtttttgggcgatttgcttgatccaagcgatttaccgctgggttagtcaaaatattctgctgaataaaattaacccaactgtctgccagcgttttattttctatttgatgatagcggtcgtagcgataacgctcaaactgctgtaaatagacgttgttaatgctcgctccgctataaagcaaggtatcatcaaacacaaaaccttttaggtgtaatacaccgaagatctcacgtttattgacaggaacgccataaaacgaaatctcttgatctgtcggcagggtatatttttctcgcatttgggtgtaccagtcggcgtttgaactttgggtttcttcgccaatacgcccacgttgtgccctatgccaatccacaaggattttgatttctagttgtaggttagctaatttcgcttgatagagtgcatccaagatctcttgcccagcttcgtctttttcaaaatagagagcggtaagataaatgcgaaattttgcttgtttgattaacgctaaaatttgttgtttaaacgcagtgctacttgttagaaaatccactttttctaccgcttgggggataaaagtgagattatctaagtggcgttttgcacgggtttgtttatttagaataagcatcttatgctccattttttctttacttcgtagatagtttctacgcagtaacactatccctacttttcttttctttgcttcgccaaagaaaagtaggcaaaagaaaggcgaccccaagcgtttcttcttcctacgcttgttgctaattttggggacgaacttttcaaactcgcttgcttcgcaagctcaaacacgaaaagttgtcctcaaaaattgacgcaaccgcttcggcgaaacgcaggggaattgatcgaacatctcgatctcaactttgcaaaaaattaactaaaacttaccgcttgtttggcggtttgggttcccttctgaaccgcctgagcgtgtttaaatttgtaggaacatttttctctgagccaacgaagttggcgaatttaaaatgttccgttaagcaaatttaaactaagcgaagataagcggtgaagtagggttgcctttcttttggttacttttctttggcaaagcaaagaaaagtaacgaaattaagcgacgatgaaactacgcaaagtttcttgtttcaccttccccaaccacattctccacacaacgcccacaaatctcagcgtgttctgcatttgcaccaatatctgtcgcatagtgccagcaacgtgggcatttttcaccgtctgcacgttctactttcaccgcaagaccagctaattcgccttctgcaacatcagcttctgcaagtggtttaacaatcgcttgtgaagtgattagcacaaaacctagctcattgcctaactgttctaacagtggacgaatatcatcatttgcataaacggtgactttcgcttcaagagcagcaccaattaacttgtcgttacgcgcttgttctaagacacggtttacttccgcacgcacttttaacagtttttgccagtagttgtcatctaatttgtcgctttcacttaaaccgaataagtctgtgtagaattcttcagtaaagacaaattcagaacgcccttccacttgtggtaagtagccccaaatttcatccgcagtgaaggataaaatcggcgccatccaacgcactaatgcttcagagatatgccacaacgcagtttgacagctacggcgtgcaagactgtctgctttggtggtgtattgacggtctttgataatatctaaatagaacgatcccatttcgattgaacagaaacgcattaaacgctgaacaacggtgtggaattgataattatcataggcttctttaatgtcgttttgcgcatctaacgcacagcttaccgcccaacgatctaaggcgatcatctcttccggtttaaccaaatcacgttttggatcgaagccgtttaagttcgctaataagaaacgtgcggtattacggatacggcgataagtgtcgcctgcgctgtttaagatgttgtgcgaaacggcaatttcacctgtgtagtccgtagaagcaacccataaacgtaaaatatctgcaccatttttgttccacacctcacttggcaaaatcacgttaccgagtgattttgacattttgcgacctttttcatcaacagtgaaaccgtgtgtaagtacttgattataaggagctttattatcagttgcggtagaaagcatcaatgatgacataaaccaaccacggtgttggtctgaaccttcaaggtacatatccgcagaattgccattaaactctggacgttgttgtaccacagacgcataggttgatcccgagtcgaaccacacatcaagggtatcaggcactttacgatagattttcgcatcttcttcgcctaaaacttctttcggatctaaatcccaccacgcttgaatgcctgcttgttcaacacgttttgccacttcttccaaaatttctaaggtgcgagggtgtaactgttctgtttcgttatgcacaaacattgtcatcggcacaccccaagtacgctgacgagagatacaccagtcaggacggttcgccaccattgtatcaatacgagcttcaccccaacttgggatccaacgtacacgtttaatttcgcctaatgcctgtttgcgtaaaccttgcgtttccataccgataaaccattgcggggtcgcacggaaaataatcggagttttgtgacgccaacagtgcggatagctgtgtttgatacgctctaatttgagcaacgtccctgtttcttttagtttttcaaggactaaatcattactttcaaacacgcctttgcctgcaaagaatggcgtagttgaaataaatttgccatcgtttgccaccaagccagccatttctaatttatatttttgacccacaatatagtcgtctaaaccgtgatctggtgcggtgtgaactaaaccagtaccgccatctgtggtaacgtgatcgcctaaaataaacggcacgctaaaatcgtagaatgggtgattgaaacgcattaactctaagtcacagcctttcgctgaacctaacacttcaacttgctcaacgcccgttgctttttgtacggcttccactaattctgtcgcaagaataacacgctcatcgccaaactgtacgagctgatattctaattccgaatttaacgcaatcgcacggtttgacggcaatgtccaaggggttgtagtccaaatcacagcagaaatctgaccgcttcctttgccctgagcattaaatttcgcttccacagcaacaggatctaccgctgaaaaacgtacatagattgatggtgatactttatcttcatattccacttcagcttcagcaagggaagatccacagtctaaacaccagtgaactggttttgaacctttgtataagtgaccatttgcaatcactttacctaatgtacggataatatgtgcttccgtatcaaaattcattgtgagataaggattatcccaatcgcctaaaatacctaaacgcataaaatctgctttttgaccatccacttgctcttttgcatattcacggcatttttgacggaattcagcggttgaaatattttcgttcggtttacccaccaaaccttctacttttaactcaatcggcaaaccgtggcagtcccaacctggtacataaggtgtatcaaagcccattgcagttttagatttgttaataatatctttaagaatatggtttacagcgtgtcctaagtgaatattcccattcgcatacggagggccatcgtgcagaataaaggatcttttcccttttgatgcttcacgaattttttgatagagctttttatcataccaattttgtaacatcgcaggttcacgcttagcgagatccccacgcatcggaaagcctgtttcaggcagatttaatgtgtttttgtaatcagtcattttgttgttccagttaataaaattaaaagtctttatgaaaaataagtaagcggtagaaattacccattattttgcaaaatagatcgtactatttggtttacctcttgatgatcttttatttgataaaggtaaatatttttatcctgttttaactgctcaaggcattgttgataatttactgccattcgttcaatcacttctcgctcaacaattcgagggagagtattacctgcggaaattttactttcataacgttgttgatttcgtaaaatacttaactcaatatcaatgggtaatgcaataacataaatttgatattgtttttccttaaatgtatcaagtaaatttgttgccgtttcaatatttccgaatgtggtttcgtataatatatttagttgtttatcaaatgccttattgagtaattctatcgcaaaacgatgtgcaaaatttcctgtttttttatgtgcttgatcattaccaaatttctctctgtattccttcaatttagggtgaaacttacgataatcatctgcttgaataggaaaataatttaaagagatcttttccaataaatttgcaatacaagtcgattttccacttccactcacaccagccacaacaattgcataaggtttttcttccgaatataaatgatagtcagcgatcatttcatcgaatgcaagttgaatttgtaagtccgtcggcttaatatcttttgccatatattatccaaatcttcgtttttgatatttattttgtaaagataatactttttcaaccacaggaataatttgttcgtaatgttcaggtacaagattaaaataagtacgcttcaaatgacgtaattgatttttatcatttcgaccttcttctgtctgtaaagcgtctgtcatcaccatatcagcaaaagtatccgcacaaatttcgtggaaaacatcactaaaaggcacataatcttgctctaagctggctaaaatttgggcttttctttcttctgttaatctcattttatacctcttgaaagaataatctcaccgcttgtacatctttctcaatttgcaattttaactcatcaaaactcgcaaacttaatttctgaacgaactttctttaaaaaacggacttcaatcgcttgcccataaatagaattatcaaaatcaaacaaatgcacttccaataacggctttgtcccatttatcgttgggcgattacccacattcgcaataccattaaaaatctctgctgatgttttgactttgactgcataaacaccctgaatagccgttactaaacgatttagcataaggtttgccgtcggaaaaccaatggttcgacctaacttattaccgtgagcaacacgaccacaaatcgcatagggtttgcccaacattttttcggataactgcaaatcatcattatgcaacgcatcacgaataagtgaactactaatccgctgttcctctaaacaatggctgtacgaattttctacgtcaaacccaaactgctttcctgcctgttgcaaactgtcaaaagtccccgaccgcttgtagccaaactggaaatcgtcaccgacacttaaatacttcacattcaacttatcgactaataaatattgaataaattgctctggttgtaattgagcgaactgagcattaaaacgaacacaaagcaaataatcaacaccgatttcttgtaaggcgtgaattttatcgcgtaaacgcatcaaacgtgcaggagcggtcagtttatcttgttttttggcaaaaaactcacgaggctgaggctcaaaaatcatcaccactgacggcaaacgcaaggcatttgctttctctagcaaacgcttcaaaatttgctgatgccctaaatgaacaccatcaaaattgccaatggttagcacacagcccttagaaaaatcagcacagtgagctaaattatgcacgcctcgaattaattgcatcggataaaaatagattacgttttcaaacaaaaattatgcccgattatacgaggaatggggggaaatgaaaagaaaagcataaagatattttggcgatctttctagcttatcttggtataattactgtacgcaaacgtttgcttaatgttatacttatgaataagtttttttatttaagaggattgctatgacagttacacaacttagttataaagacgctggtgtcgatattcacgcaggtaatgaattagttgaacgtattaaaggcgatgtaaaacgtactcgtcgtcctgaagtaattggtgggttagggggctttggggctttatgtgccttgcctaccaaatataaagagccgattttagtgtctggcactgatggtgtgggtacaaaactacgtttagccattgatctaaataaacacgacactataggtatcgacttagtcgcaatgtgtgtgaatgatttagttgtgcaaggtgctgaaccgctgttcttccttgattactatgcgacaggtaaattagatgttgatgtagcaagctctgtcattaaaggcattgccaatgggtgtgaacaatccggttgtgcattagttggtggtgaaactgcagaaatgccagggatgtatcacgaaggcgattacgacttagcaggcttctgcgtaggtgttgttgaaaaatcagaaattattgatggctcaaaagttcaagttggcgatacgctgattgcattaggttcaagtggtccacattcaaatggttactccttgatccgtaaagtgctagaagtgagcggtgcgaaaccaacggatttactcgaaggtaaaccattgagtgagcatttccttgcaccaactaaaatctatgtaaaatcggtgttagagttaatcaaacaagcagaggttcacgctatcgcacacttaacaggtggtggtttctgggaaaatatccctcgtgtattaccagccgatgtaaaagctgtgattaatgaagcaagctgggaatggttgccatcatttaaatggttacaggaaaaaggcaacatcagccgttatgaaatgtatcgcacctttaactgcggtgtaggtatggtgattgctctacctgaaaaagatgtcgaaacggcattaacagtcttaacagaagctggcgaaaatgcttgggtgatcggtaagattgaagcattaggtagtggtacagagctggttgaaatcttgtaatttctcccaccttattcgccccccatccgcccttcgggcaccttcccccgcaagcgggggaagaattggaggggagggggaagtgttgtagagcggtgttatgagaaaatttttcccctcatttatgggggaagtattgggaaagtgggggagcgaaaaaattcttccccatttatgggggaagtccctgagcgttagcgaaggggatgggggctgagggataaaatctgtgaacaaaaaaagcggatagaagtgtaaaaaagtttacacaactgtccgcttttattttgagattgacatgaggttgtcatgtcaatctttttttgggggattagatgactaagatgccctcttgaatccagactgcatgtttattgtcattattcatggtataaacataatatttgataccattttctgtgactgaacttacagacttattccagcttgccccagatagtccaccagatgcgtctcccaatttgcttgaactaacattagtatccgtcaaccaatcattattgttgttacccaagtcaactttgactttgttgccgttattcacattcaatcccttgtagattttcactgggccttctaagcctgagtttttcaaatctccatatctaatgccgataactgcgccattatccattaactctatgcgctcgaagcctttcactttgtctgtggttgctcttacgcctcccgctatgcggtataagtcaatgcctgtgcccccgtcaatcaacgagcctgcacctataccttttgagtcttggcggaaggtgtcgttgcctgagcctaggttgattcttgagccttcaccaatttcggtattccatgcgatggttccgtttcctgcaatggtttgaccttgctcgtttttactgtagtttttgatttctacaatgtcgtctcctgagcccatgttgacacatgatgacgtctgtgccttgttgacgtaagctcttatatcttgttcctaggtcgttatccaccactaaggtgtcgttgccttgttggaagttgaagtcgagcttgtagtttttacctgattggtcgttgatgatacctagactttcatgcacgtagacagtatcattgctgttaccccaagtatattttgcacctgcgccatcttttgatacagaagttggcttgctgttgccgtattttccttcttgtacctgttggagaccccatgttgggtcgttaccccagtcttggtagacgtctgaccatctgtcttcccaccaccataatactttcactcggctataacccacacgtcctgtcggtgttccattaccatttcctacgacatttgtgtattccactttgtctgtcgtggtggtgacgtccgcactttgggtgattctgtcttcgttgttatacgattctatcttcacttggcttctgtctttcactgcgtctggtgatagggtgactttgccgtcagtttgcgacaattgaactccgtttggagcttgagtattgttgctaccatccacctgtttcagtttccagcttccgttctctttttcatatacaagcgttttggttttgttttgctcatccgtgcaagtcaacttgaacttgttggtgttctccttcggtgtcactattgcgccgccttggttagtaccgtcaatctctgctgttggtttcgctggttgtggttcctgagccgcttgagctgttgcatttttacgtgcaataccttggctatcaagtgctgttattgtgacgttggttttgtcttttactgcacttggggcaaaggttacttcgccagtttgggcattcagtttaattgggccattaccgccgttagtatctacactaataccattcatttgcggatttttagttggatccaatttccattgactattctcatacttgaaccaaatcgttctgtttgtaccatcaggttgttgatagtccacttggaaggctttggtttttggctctccattagaaccttctctcggtttaacgataacgccaccttgagcagagttgtcaactgttgcttttagttcgtctagctcttctactttcggtgcaggtgtcggtgctggggtcgttgtggttgaaccaccactgcttgtgccgctgcttccgctagttgagctagtaccacttccgcctgttgcattggctgctgctggaccagttggaaccgatgctgcattgaatgtgagatctgtaagagtaatacctgaaccagcccaaggtgttccttcttcaccagtatacatctcatccattcgacctttggtagaatctggaatagttgtatatacaatatatgttactttattgttaggtgactgtgccgtcgtcttgaaggatatagtcgcttgcgtcagctttttgtgcaccgttagatagcgttgcagtgtcatcgacaacccatttaccttggtctaggtctttcttgattgcgatttcttttggttgacctttatcatctacgtacttcacaaccattctgtcgttatcaccacccggtttcgctacgatgtcgccggagtttggttggtcgttttgaacgccgttaactgcctctgttctgcccgcagtgattgtcggtacgtctgtgcgaactttgctgtattcaggctcattggctgttgcgtctgtaggtcctttgttcagttctttagtttctgcagcgttttgtttgtactgtggcaacaaatttatccccaacggctaatggagttgctgtagattcgctaatatcaaacttgaacttaccgcttgttaccgttgtttctgcaattggttgtccgttagtttgaccttctttgtagaggtaaactttggttccatctgcttctgtgcttgttccttcaatgatgactcgctcaggatctttgtctgctgttgttgatgtatcaatcgccttgattgaggtaatcactggcttatctgatttcacatcaaacggagcatctttcctgctggtttcactttctgcagatgtgcgtcctgctacatcagtcgtggttgcactgacagatgttttatctgctactttgtcttcaggaatcgttacactgactttgccactttgatcagtggttggggtgagtttaagtgaatctttttcatcttgaacccagtttccgccagtataggtgtaagtcaatgtcgtcggtgtacccgctgttccattttcaagttctggggtgtagttgatggtgactttatccccttcaacaattgggttttcccctgttgtcgctgggaattcgatcttcacataaccctcattatatgaaggtggtgcagaatgcattgttttataagggatatttgataggaaaagaactcatttagttgaaaaagtgaagaaaagggataaaagggagaaaagctaggtggtgtgattgaattgagtgcatttttatcaagagaagggcatttttagccaatgctatcatatgccctagaaatacctacgaattaaaattgctcgccatatttaggcttttcaatatttgtaaaggttttattttgattctctttaatcatttcagaaattttttgtgcagaatctttaatacccatcgcttcaaaagatgtttttagtaagggtaatgcttgatatgttgcctgagtatcgggatataaacgtagcatttcatctactcgattaacaaccgcaacataagcctttctttccatatagaattcggcgatttttagttcatgttcagcgaggcggtttttcaaaaaaatcatccagttttgagcatctgaggtgtattggctatttggatattgaaaggtaattgtttggaaattaccgtacgcatttcgaatgttctctattgctctagaggccctgttaattccgaagaaatcttgtatccagttatcgcctaaacgtgcgtagtttaatcctgcaaggtagtaaacataatccatacttgagctgtttggatgagttctcgcaaaacgttctgcaacctctaatgctttgtaatattcacctaatttatagttcgcataaatcaaacttaattgaacttgctcatcataagccccttgatttgagcgtagatcaactgcatctaaatagcgaattgcattgttataatcaccatcttgtaaatatgcttgtcctttgtcataaagttcttgagatggaataccttcaaattcattattcttagaatttgaacatcccataattagaagccctgcaaggactaaagaggctaaagaagaaaatttacgcataatgatttacctataataaagtgattgcgaattaaagttaatgtacaatgctatttgacccagcattgtccgtgaaagttcatacgataatgcccttattctacaataagaaaacataatttggaattttatcattaatgactcaacaaataacattacaaactgaagtcacttcagatttattaggtgcaagattagatcaagctcttgcgcaacttttccccgattattctcgttcacgcattaaagtttggatcgaaagtgatctcgtttcggtcaatggcaagattgtgaataaagctcgtgagaaagtattcggcggtgaattaattgaaattcaagcggaaattgaagaagaaatccgttttgaaccacaaaatattccattaaatatcgtttatgaagatgatgatattttagtgattaataaacctaaagatttagtggttcaccctggggctggcaatccagatggcacggtgttaaatgccttgttacaccattaccctcaaattgcagaagtgcctcgtgctgggattgtgcatcgtttggataaagataccacaggtttgatggtcgttgctaaaactgttccagctcaaactcaccttgtcactgctttacaaaaacgtgaaattacccgtgaatatgaagctgtagcaagcggtattatgacacaaggaggcaaagttgatgaaccaatggctcgccacccaactaagcgtaccgcaatggctgttcacccaatggggaaatctgcggtaacacattatcgtattatggagcgtttccgtaattacacccgcttacgcttacgcctagaaaccgggcgtactcaccaaattcgtgttcatatggcacatattgcccacccattgttaggcgatcaactatatggcggtcgtcctcgtccacccaaaggggcaagcggtgagtttttagaggttttacgcaattttaaacgccaagcattacacgcaacaatgcttcgcttgcatcaccctatcactggtgaactgatggaatggcacgctccattacctgatgattttgttgaattaattgaggcattaaaagcggattatttgttgtataaagatgagttagattattaaatgagaaaaaatccccaaacctatgtctggggataaaatgaaaaaagtattaaatacttaaaatttaaccaaggaaatatctatgaaaacagtaaggaatctctctatttgtattgaatggcggtgagagggggattcgaacccccgatacagtttcccatatacacgctttccaggcgtgctccttcaaccactcggacatctcaccgaatcaataaaaaatgtgcatttaaatgcacatttgaaagatatgcgaactatactgatttttcatagtctaatcaagcattttcttcacaaactaaaataaattgtgaattaatgtccgtgtcctaagcaatttgttgatgctggaacttcttcgcctcgagctttccattctgttggggtgtaaagatgtaaggctaaggcgtgaacgccgttggctaattcttctgcaaggcaggcataaatagcttggtggcgagcaacaggacgtttgttttcaaagagttcactaaccattgtcactttaaaatgtgactctgagcctcgtccagagctatggcgatggctctcgttttcaatataaagtgtcactgggttaaattgtgtttgtaatttttcgacaatagtttgttcaacagacattttttatctttttggtttggaaatttgggtggaataatactatactttgcattaattttaattgagattatcaaggatcctatatgaaatttaataaaaaaacgtttttagttgcaaccacccttgcaaccgcattattagccggttgtcaatctcagtcaaatacactgacgtttactacgccagcaccgaccgcaatgtttaatacccataatcaaacagcgttagtgaatgtgagtacacaagatctgcgtacatcggctgaagtagcaagctataccagtgctggcaatgttaatcgtttaagtgttgtgccaacggtgacacagttataccaacaagcaatgcaacaaaatctgaacagcaaaggttttactgtagtttctggtgctggaaatgcgaatgtgattgtgaatattcgtcaattttttgctaatgtggaacaaggaaatgttcgctataaagtaaccgctaatgttggtgtagaggttgttgttcaaggtgcgagaggtcattttgcgaaaaactttaatacctcccgttcttatgaaggggcatttggtgcaaataataatgaaattcataaggtgttaggtcaggcgtatagtgagtctattcaggcaatctataacgataatgaaattagtaacgctattcatcaatttaagtaacaatgtagaagcggtaagattgagataatcttttgagattatccgtattatgtagcacttacacaaaaaatagtagggacgccacgcttggcgtccattctctaaatttgcaaacagcttatattcaacggacgctaggcgtagcgtccctactgtatgaaaaagtttgcgtatttgctacctgatactgcctgcttacctttaggaacgaacctacccacatttcaatagcaataatgagaataccaagaatttaccacccagaagcccttgctggcaaaagccactgtatcttgagtgaagatgcctttaaccacgttgggcgtgttttgcgtatgggcgagggggctgaacttgttttatttgatggctctaaccatatttttaatgcgatcattgataacgtatccaaaaagcagatcagcgtaaaaatccaaaatagccaactggacgatagagagtcgccgttacctatccatttagggcaagtgatttcccgtggagatcgaatggagtttaccattcaaaaatcggttgaattgggggtaactaccattacaccattatggtcagaacgctgtggtgtaaaattagatggcgagcgtcaagataaaaaaatccaacaatggcaaaaaaattgcaatatcggcttgtgagcaatgtggacggaacattattcctgaaattcgcccgataatgaagctgaccgattggtgcaaagaacaagatggaatgctcaaactaaatcttcaccctcgtgctaaatacagtttaaaatcgttactgaatgtaccccaagagggcgtacgtttgttgattggttcggaaggtgggctttcccctgaagagattgcgatgacagaagcggagaattttacggaagttttacttggaaaacgtattttacgcacagaaacggcttcacttgccacgatcacggtattacaaatgctttatggagatctcagctaaatgatgaatttacaaggacaatttttaattgccacgcctgatatgaatgatgactattttgatcgtgcggtaatctatatttgtgaacataatgaacacggggcaatgggcataatgatcaactcaccgacagatctgtccgtgatggaattgctcgccaaaatggattttttaatggcaaatgaacgcaattacaccaaagatcagctggttctcagtggtggacctgtggggcaagagcgtggctttattttgcataccgcaaccgatcagctctttttacatagctatccaaccgctgatgatttaatgcttaccacatcgggagatattttagacacctttggacgacaagatgcccccgctgattttatcgtctgcttaggctgttgcacttggaaggccgatcagcttgagcaagaaattgcacgcaattactgggtaactgcccctgcgtcctataaaattctttttgaaacaggttatttagatcgttggagcgaagcgaatgcattactgggtatcgaaggcattttagccaaagcagggagagcctaatgagccaaactgtgcttgcctttgattttggaacaaacagtattggctgtgccgttggacaaagtattacgggcacggcacagggtttgtctgcgtttaaagctcaagatggcataccgaattgggagcagattggcaaagtgattgcacaatggcaaccagatctcttagttgtcggcttaccgcttaatatggacggtacggagcaaccgctcacgcaacgagccaaaaagtttgccaaccgcctaaacgggcgttttaatttgcccgttgaattacaagatgaacgcttgaccaccgtagaagcaaaatcagaaatttttgccagaggcggttttaaagccctaaaaaaaggcaaagtcgatgcgatttcagcttgtttaattttagaaagttggtttgaacagcaatcataaaatatagcagttttgaatctataaactttgatacaacttaaacgcttgcccatcagacatactcgcaaggtagtcacaaatcactcttggacgttgctgttcatctgcttgtatccaacgttccgccacagatttaggcagtaagcgggttggatcgcaacttagcatatcaaacagatccattaaaattcgctgacctttatattccacccgttgcgttttgacatcacagataacatattgatagacaaagtttttaagtacttctaacacagcttgtacttccgttggtaatatcgcattaaaacgcagtaatggctcttcaaacgctgctgtttctgtccattttacatttgtcacaaaataattgactagcgctccaatcacatctttgcgttcgtagcggtgagttgagaacaattttttgctgatgtcaggtaacattttttgaatccaagctgatttacattgagagaaggcttgttccgcattttgccacgattgcggcgtgaccattccgccaacaatcgcatcttctaagtcgtgaaccccataagcaatatcatcagccaattccataatactgcaatctaaggatttataacgggttttgtggggaagcagtggatcttggcttatttcaatttgttgaaataacgctctatctgcgacagaaagcggttcaagcacccattcaaaaaagtgagcgtctgcacggaaaattcccttacttgtttttagatcgtgtaagttgatataacggctatttggaatggcttttggagtttgtggctgagttaaatcaataaagctaggatatttgatgatacctaacaaggtgcgacgcgtcaggttcattcctgcattttgggtataaggctcaagctgagtgacaatgcgaaaggactgagcatttccttcaaagccaccaaaatcctgcattttataattcaatgccatttcaccgccgtgcccaaaagggggatgaccaatgtcgtgagcaaagcatagggattccgtcaaactacgagaaggtaataaagcggtgagatcttcattgaattttgcaaatgttggatcggaacagaccgcttgaaagccttgcctatcttccgccaattttgctcttaagctactgccaatttgggcaacctctagagagtgggttaagcgtgtgcgataaaaatcatcttcgcccactgcgtgaatttgtgttttagcttgtaagcaacgaaaggcttccgagtgtaaaatgcgtccccgatctcgttggaaaggggaacggtgatcttgttcgcgttgtttgtctgttagaaagcgtgatgtccaagctgaatccattttattttcctccttagtcacagtttaggctataatagcggataattctttttgtttaaaccttattcaaatggcacttttttattctgataattccgcaaaaaaatccacaaaaccgaccgctttacagacatttcatatccaatctttagactatcaaggattaggcgtagcgaaagtcaatggcaaaacgtggtttattgaaaatgcgttgccgaatgaaaaggtggaagccaagattattgaagataaacgccaatatggacgagcgacagcggtacgatttctacaaaaatccgcagatcgccaaacgccattttgttcaatctatagacaatgcggtggctgtcaaatgcaacacattccactggctttacagcgagaaaccaagcaacagacgctttttaaccgtttacagaaacttcaagcagagcctatcgcatttgagccaatgcttataggacaaggtataaactaccgccgtagagcaaagctgagtatggtggttcaaaaaaataccttagtggtcggctttcgccaagcgaatacgcaagagattatccctctaaatcattgtgatattcttgagcctgaacttaatacgcttttacccaaattacagcaactttttgccagttggaaaaataaaaaacagttagggcatattgagctggttcaggcggataatggggtggcattgctgttacgccatatcggcgaacttcattcacaagatagtgataaattacaacgctttgcggaacaagaaaatcttttgttatttgtgatgacggataaagatcagattagtcagtggcgtggtgaagttccgtattatcaaatcaacggcttaacgcttcacttttcgatccgtgattttattcaaatcaaccgagaaatgaacaagcaaatggtgaacaaagcgatagcgtggctcgatctgcaaccgacggatcgtgtgcttgatctcttctgcggaatggggaattttaccttgcctatcgcaccgcttgttgaagaagtggttggtatagaaggggttgagccgatggttgcacaagccaaacagaatgctcaaacaaatcagattaacaatgcgaagttctaccaaacggatctggataaaccttttgtggatcagccttgggcgaaagcacattttaacaaagtactactagacccagcacgcaacggggcttactttgccttagatcatctttgcgaattacaaccagagcggatcgtgtatgtttcttgcaatccagcaactttagtcagagatgccgaaaaactgattgcaaaaggatatcgtttaagccaatccgcaatgattgatatgtttccccatacggcacatttggagtcgatttcgttgtttgaaagaagaacaaagaataggttctctaattaatgaattcctatgtagactaaagttataatgttcttacttttgtcgcagccaaaatttttcatatatggttaaaatagaggagatgttagatacaaatccagaacatttttttaacaaaaaagcgatttttaataaaaaaagtattgcatttcataaaaaacttatatattccattttgtcgggtaaaaaaataacccctcaaacacaacaaaaaacaactatcacttggagtgaagcaatgaaaaaattaacacaactctctttattagcattggcagtggcttctgggtctgcaatggctgcaccaaaaacctttgtttattgcttggaagcatcaccttcttattttagcccagcattaggtactgatggtgcaacactagatgcaagtggccgtgccatttttaataaattaaccgattttaaagaaggtgaaaccaccgttgttccatctttagcggaaaaatgggacgtttctgcagacggtaaaacttacacattccacctgcgtaaaggggtgaaattccacactaccaaagattttaaaccaagccgtgattttaatgcagatgatgtacttttctcatttaatcgtcaattagatgcaaatcacccatatcacaaagtttcgggtggtaactacgaatatttcgttggtatggatatgcgaaatatcattgataaagtggaaaaagttgatgattacaccgttaaaattagcttaaaagtgcctaattcaccatttttagcaaaccttgcgatggactttgcttctatctactcggcagagtatgctgataagatgttagcagcaaaaacaccagaaaaattagatagcaatccagttggtacaggtccgttccaatttgtggattaccaaaaagactcaaccgttcgttacaaagcctttgatgattactgggcaggtaaagcgaaaattgatcgcttagtgttctctattacgccagatgcatctgtacgtttagcgaaattacaaaaaggcgaatgtcacgcaatgccttatccaaaccctgcagatattgcaaaattaaaatcagatccaaacattgaagtattagaaaaaccagggttaaacgtgggctatttagcgttaaatatgactaaagcgccgttggataaccaaaaagtacgccaagcattgaaccacgcaattaacaaagaagcgattattgaatcggtgtatcaaggttttgcaaaagtagccaaaaacccaataccaccaacaatgtggagctataatgacgacgtgaaagattatgactataatcctgaaaaagcgaaagcattgttaaaagaagcaggctttgaaaatggctttgaaacagaattatgggcaatgccagtttctcgtccatataacccgaatgcacgtcgtatggcggaaattattcaagatgattggaaaaaagttggcgtaaatgcgaaaatcgtcagctacgaatggggtgagtacttaaaacgtttacgcaacggcgaagcctctacttcaatgatcggttggacgggcgataatggtgaccctgacaacttcttaaatacgctattaagctgttctgcattagaagctggctctaactatgcgaaattctgttataaaccgttcaatgacttagtcacccaagcggctcaagaaacagatcaagcaaaacgtactgagctttataaacaagctcaagtgattttcaaagagcaagcgccgtgggttactatcgctcactcaacaacgtacttcccagtacgcaaagaagtgaaaggttatgtggttagcccgttcggtttacataacttctaccaagtagatttagcgaaataaggcaacattgtagggtgggtcttgacccaccttttagtttagttatggtgggtcaagaccctccctacaaattgaaaaacgctgagatatttaatgtttcaatttattcttaaacgtcttttaatggttattccaacctttattgcgataactttgattacctttgctctcgtgcatttaatccctggcgatccgattgagatccgaatgggtgaacgtggtttaacccctgaagttcacgcacagatgatggcacagcttggcttagatcttccgttacacgaacaatactttaattatatcaagggtgtatttcagggggatttaggtaattcgtttcgtaataacgaacctgtactgaaagaatttttcactcttttccctgcaaccgtggagttagccttttttgctctgttgtggtcgctgattgcaggtattttgtttggtgtgattgcggcggtgaagaaagagtcgtggttttcccacgctatttcgtcgatctctttaacaggctattcaatgccgatcttctggtggggcttaattttaattctttatttttcaacgccattaggcttgccagcctcagggcgtttaccagcagaatactggatcgaagccgaaactggctttatgttgattgatacttggaattctgacgaaccaggcgcatttgttgcggcgattaaatcgttgattttgcctgcgattgtacttggtactattccattagccattattacccgtatgacccgttcttcgatgttggaagtgttaggcgaagattatatccgcaccgccaaagcgaaaggcttaaacacaacacgtattgtgattatccacgctttgcgtaatgcgttaattccagtggtaacggtggttggtttaattgtgggacaactattatcaggggcagttttaactgaaaatattttctcttggccagggatcgggaaatggattattgatgcgatcaactcacgagactaccctgtgctacaaggttcggtgttgattattgctaccttgattattttagtgaatttaaccgtagatttaatttacggcgtggttaatccacggattagacatacttaaaaaatagatttatttgttggagtaataaatgtcttctcaagtagaaacaacctcaccagccccactaacgcctttacaagaattttggctctatttccgccaaaataaaggggcggtggttggtttaacttttattgtgattgttggacttgcctgcatttttgcagaatttgttgcccctttcgatccgattacacaaaaccgcagtgcattgttattgccacctgcgtggtttgaaggcggtaattctgcctatttactcggcacggacgacattgggcgtgatattctttcccgtattatttatggagcaagattgtctatctttatcggtctgttgatcgtagtgatgtcctgtattcttggggttattttaggtctgttagcaggttattacggcggcactattgatattgtgattatgcgttttgtcgatattatgcttgcaattccaagcctattattaactatcggcgttgttacaattcttggaccttcgctactgaatgcggcgattgcaattgctgtggtgtctattccaagctatgtgcgtttaacccgtgcttctgtgttaagtgaaaaaaatcgtgattatgtgaccgcttcccgtgtggctggggctggcgtatggcgtttgatgtttattgtaattttgccaaattgtttagcaccgctgattgttcagatgacaatggggatctctaatgcgattttagagcttgcggcacttggcttcttggggatcggtgcacaaccaccgacaccggaactcggcacaatgcttgccgaatctcgtggctttatgcaatcggcaaattggttggtgacaatccctggtttagcgattttatctctcgtgcttgcctttaacttaatgggtgacggcttgcgtgatgcacttgatccaaaattaaaacagtaaggggaacgaaatggcattattaaaagtagatgaactttcggttcactttggcgataaaaaagccccgtttagagcggtggatcgagtaagttatgaagtcaatgaaggcgaagtgttaggcattgtgggcgagtcaggttccggtaaatcggttagttctcttgcgattatggggcttattgatttccctggacgtgtaatggcaaattcgttacgtttcaacggacataatctgcttgatttaaaaccaaaagagaagcagaaaattgtcggtgctgatgtagcgatgattttccaagatgcaatgacaagcctcaacccaagttacaccgtgggttatcaaattatggaagccttgaaagttcaccaaggcggttcaaaagcgtggcgaaaagagcgtgcgattgaattattaacgatggtcggtattcctgacccgacatctcgtttagaggtctatccgcaccaactttcaggcggtatgagccaacgtgtaatgatcgcaatggcgattgcttgcaatccgaaattattgattgctgatgagccgacaacggcgttagatgtaaccattcaagcacaaattattgatttattgcttgagttgcaacgcaaagaaaatatggcattgattttgattactcacgatttggctttagttgccgagtcggctcaccgtattatcgtgatgtatgcagggcaagtggtggaagaaggcaaatctgaacagattttcaaatcaccgcttcacccttatacccaagcgttattaaaagcgttgcctgagtttgccgaaggtaaatctcgcttgcaatcactaccgggtgtcgtaccgggtaaatatgaccatccgcaaggttgcttgctcaacccacgctgtccgtatgcaacggatttatgccgacaaaaagagccggaactacgcacagtaaatggcagacaggtgaaatgccatacgccgttgaatgaaagtggattgccacaaccaatttagtaagatagataaatatgcaaaacaatacccaaaacccaccgcttctcaatgcggcggatctcaaaaaatactaccctgtaaaaaagggaatgtttagcaagccgaaactagtaaaagcggtggacggcgtttcttttacccttgaacgtggcaaaacccttgctgtggtgggcgaatcgggctgtggtaaatcaaccttagggcgtatgctgacaatgatcgagccaccaacagaaggggaattgttctacaacggacaaaatttcttagtcagcgataaggaaacggaaaaattacgccgtaagaaaatccagatcgttttccaaaacccttatgcgtcgcttaatccacgtaaaaaagtcggggcaattttagaagaacccctgcttattaataccgaattgtctgcacaagagcgtaaggcacaagtgttagaaatgatggcaaaagtggggctaaaacctgagttttgcgaccgctatccgcatatgttctcaggcggacaacgccaacgtattgcaatagcccgaggtttaatgctgaaacctgatattgtggtggcagatgaacctgtgtcagcccttgacgtatccgttcgtgcacaggtattaaacttgatgatggatttacaagaagagcttgggttgtcttatgtgtttatctctcacgatttatcggtggtagaacatattgctgacgaagtgatggtaatgtatttaggacgttgtgtagaacaaggcaacaccaaagagatcttcggtaacccacgccacccttacacccaagccttgctatcagccacaccacgtttggaagcggagcatcgccgagagcggattaaactcaccggcgaattaccaagtccgcttaatccaccgaaaggctgtgctttccacgcccgttgccgtttggcgacagagcgttgtaagcaagaacgtccagagctaaaaacctatgaaaacggcacgaagatagcttgttttatggtggagtaagaattttatatttgttgtatgctttattgccttactctatagtaaggcaatttaatttctaaatctaaaccttcctcgactatatctcgttttcatcaacgccagaatttgctctttttcgcttgataccgcttggctactctgtttagccaccgtaagcgaatgttgaatagagtgagcgtgagtaatggcaatcgccaaagcatccgcagcatcagcttggggtttggcggaaagttgcaaaatacgtgtaaccatatcttgcacctgcactttatctgccgaaccaatccccacaaccgtttgttttactaaacgtgcggcatattcaaagacaggcaaatcgtgattaaccgcagcaacaatcgccgttccccttgcttgccctaatttcaacgctgaatccgcattttttgccataaatacttgctcaatggcaaacatatcgggttgaaactgggtgataatttctgtcacccctgcgtaaatacgttttaatcgagttggaagatcttcaacagaagtacgaattgctccgctaccgagatattctaaatgccgccctgtttgacgaatcacgccatagcctgttacacgagagcctgggtcaatacctaaaataattgccattttatgtccaaaaagaaagtggatttgttattcacaaacccactttatagtcaatcttaattagataatcaacttattttgcaacagtgcagtttttcgcaagaatttgattgtttgcggtaaacattacgggcactgttgtttcagctgttttcgcattaaagcccatatctagactccatacctttttaccagacacaaatttcacaccgtcttgataggttgtatctactttcagatttttacctaccacttttttgttaatggttacagttgcagttgatggctcgccattgttgaaagtataaaccgctaaaacaggttggtttgttttgccatttacgctacaaatgtaagcaatagtttttgagcctgttaccatatcttttgcagcagtggcaccatcagacattgccgttcctactgctgatgctccatcaacaaccgcactacccgcattacccacagcatttgctgttgaagatgcaacatcagaaactgttgaacaagctgcaagtaccgcagctgctgcaaatgttggaagtaatttaactaatttcattgtttttccttttgtgttgattaaaaagatcactcctttagaaaaggaaaaaacaggaaagttcaaaaaaagtaatctcaagctaaatacttgagattactttttattcatttttaattaaagcaatgcagccacttcatcgctgatttcgccattgtgataaacgttttgcacatcatcacaatcttcaaggcggttaattaaatccaataattttggtgcggtttctgcatcaagttgaacagtggttgatgggatcatcgtcacttctgcattttcaactttgaaacctgccgcttcaatgccatcacggacagaacctaagtcttcccaagcagtatagatctcaaatgaaccatcttcttgtggctgaatatcatcagcacccgcttcaatcgccgcttcagttaatgcgtcttcgtctgcacttgcgattaaaattaaaccttttttgctaaataaataacccaccgaaccttcagtccctaagttaccaccacatttagtaaaacttggacgtacttgtgagattgtgcggtttgcattatcacttaaacactcaaccattaccgctgtaccacctggaccataaccttcatacactttggtttccatattggtatcatcgccaccgccaacaccacggtcgatagcacgattgatggtatcacgtgtcatattattcgataacgctttatccacagctgcacgcaaacgtgggttagagctggtatcgccaccacctaattttgccgctgtcactaattcacgaattaatttagtaaaaattttaccgcgttgagcatcttgtgctgctttgcggtgtttaatgttagcccacttactatgacctgccattctcttgtttccttctttattatgttttgaaaaaatccccctctttagcaaagaggggttaggagagatttggtagaactgcttctcgctcataagagaatttgacattgctatcaaatctcccccagcccctcttttctaaagaggggagttgcttgttaaatattttgcaatcgcttcggcattattaggggatttggtgagtgccaccgcctcatttaccgaaagccattgatacgctaaatgttccgtcaatatcggttcgatttcatcgggtaatcccaataaaaaccaatgttctgtattatgcgtaatgtcaggggcgtatttataacggaattgcggaaaaatctcaaatttcacactcgttttgcaatcataaagtgctaaattttgagcaataatatcaattcccacttcttctcgcacttcacgcaatgccgtttgataaggtgtttcccctgtttcaatcgttcctgttaccgactgccaaaaggttggatcatcttggcgttggagcattagtactcgctgagtttttttggcataaatcaccacgagaacagaatagggatttttgtagttcatttttatgtactatacaagagtttttacatcggatatgtgcgctcgacctttatcgtttatggtttttcagcatgtgctagaacattgtaaaatttcaaagagtaaataacaagattagatattgaaatgaattgattagtcaaatcgtgcgatttttttctgagaaataaatgcttaaatttatgctaaagcggtgagattttcataggaatacgatttcaaatttcccttatatcaattttttttgttatcctaacgacaatgtaattgaatagacttatcttgtatgaaatttattagaaaaaatgctgtatcgtgcatcatgttaagtagttttttatctataagcacttatgcaaatcccttgaaaaccatcttacagcagaatttatcaaatgcacttgaagtgaaagaagcacttgcaaacgttgaagctgctcagaatcgtgttgaacaaagtaaatctcaacattttcctattgttagcgtaacaggttcaaaaactttaagacagtatcataagtatgaagataattatggttcaaccaaaatcatccctggtattcaggctgaaatgaatatctttgcttttggcgctattgagaaagatattgaacgcagttataaagagaaggagtactataagcatacctataccgctactcaagaggaaatagcgtatactattggacaactttatttaatggcactgaatatgaaggaagccatttctgtaatggaaaagagcttatttcgccaccagaaaattttacaggatttggatattatcatggagaatgatgaaggacgagaatccgaatttgttcaagctgagacacgtatgttgatggttcaacaagaaattaataattatcgacaaaaattattagctactttgaatacactatcaaaatatacaaggactaaagttgttgaagaacaattaagtgatcctttccttcagttgaaggaagaacagctttctccttctttattttttataaataagaaggagaatgtttattttgtcacatatctatgattaatttattctttctgtattggttaatatggttatgttgacatctactctctactcatatttagttcttgtgggagtgaagctagtaatcatatagataataacttattcattaatatatgtcttctttatataatattatcgataggtagaattaaggacaatgcaaatatattacccaaattatcaaggatctgaccgcttgttagatctcacctctccgaaaattatggggattttgaattttacccctgattcgttctccgattcgggcaaattttttacccttgataaagccctgtttcaagtggagaaaatgctcaatgacggggcggatattattgatattggtggtgagtccacccgttcgaatgcagaaattgttacccttgagcaagagttggaacgggttgtgccgttggttgaagcggttcgcaagcggtttgattgtttgatttcggtagatagctcaaaggcggaagtatttcgtcaatctgcacaagttggggcggatattctcaatgatattcgtgcgttacaagagccgaatgccttagaaactgccgtagaattaggtttgcctgtttgtttaatgcatatgcaaggcacaccgcaaaatatgcaacaaaatcctgaatataatgatgtggtggaagaagtcgcagattttctcaaccaacgcatttttgcttgcacaatggcaggcattcccaaagagcatattattttagatgtcggctttggttttggtaaaacggtacaacataattatcaactgctaaaacatctaaatgcctttgtagcttcgggttatcctgtgttagctgggctttcccgtaagtcgatgatcggcaatgtaatcaataaaccagtcgatcaacgtgtagcaggcagtgtcgcaggggcattgctcgcagtgcaaaatggagcgaagatcgtgcgagttcacgatgtagcggaaaccgctgacgcgttgaaagtgtggcaagcgatgaatgaatgtgaataaaaaggaagacaaaatgacaaaaatctacggcattaaaaactgcgataccgtgaaaaaagcgatcaaatggcttgcggataacgacttaaacccacaacttcacgactaccgtgtcgatggcttagatcctgtttggctggctgaaatggcagagaaatttggttgggaaaacttagtcaataaacgtagcaccacttggcgtgggcttgatgatgaaatcaaaaataatctcaccaaagagctggcactaaaggtgttaaacgaacagccaaccttaattaaacgccctattgtgattgctgatgatgctgcgttgattggttttgatgagaaagagtatcaaaaggtatttatgaaatgatacccaacatattaattatgttgagtaaaagggggcaattttaagggctctctgtttattcaaaggtattggataggatttggatcatgagttatattgtagctcttactggcggtataggaagtggtaagtcaactattgctaatctttttgctgcacttggtgtgccagtgattgatgcagatattattgctcgaaatatcgttgagaaaggcagtcctttactcgctcaaatagtagctcattttggcaaacaaattttgtttgaaaatggtgagcttaatcgtacagcattacgacagcggattttccagacagaatatgagagactgtggttaaatcagttacttcatccagctattcacacagaaatgttaaagcagttgaatgaaagccaatctccctatgtgctttgggttgttccattattgattgaaaaccagctaatggcattatgtgatcgtattttagttgttgatgtattgcctgaaattcagctagaacgagctatgaagcgagataaaagcaatgttgaaatgataaagagtattatgctatcacaggttgatcgtcaaacacgattaaactatgctaacgacgtgattgaaaataatttaccttttggtgataatgaagtccatctgactcatcaagtggcaaaattgaatgaatattatttgactctaagtaaaacaaaagggaaatagatcatgctcgtcgtattctgtccaaattgtggcaaagaagtggcttgggttttgggcaataaatatagaccattttgcagcgaacgctgccatttagttgatcttggcgaatggctcaatgaagaaaatcaagtccttgaaagtgatattcagtctgcagatgactatgatatggtggtaagtgagggtattttctaatgaaataacaaactaaaccgttcaatgccttgccaagcctcatcgctaaattcttgttttacctgtttttccaattcggcaagggattgaatgagttgatagagtttatggtaagttaaacgttgcacggcagcttgataaaacccacggcggttttgccatactttcaagcggtcaaattcggctcgtaaattaccgctatacagaggttggtgactattgataatcggctgtggtgagcgtgtcatttcaagtaataaaagtagctctttttgtacgatgcgtagcaacaccactggttgtatctcttcattctgcagatgttgaagcactcttaatgctcggttaattttgccttctaataaggcatcaacccattggaatggggtgaattgtgccgattgttcgatcacttcttttgctcggtttaatccaatcttttgttcagcaaaacgaagttgtagcatttgcaatgcttgttttagtgccagtagattgccttcgtaactgtaacaaagtaattgaatagcatcaggctcaagctgcaactgcattgttttagctcgatgttgtagccaaataggtagttttgtaatatctggtgtttgacagtttacgactacggcattatttagttgtacaaaccagctctgtttttccattgctttggttagttttggttggtgcagaacaaaaagtaaatccgtgtgagaaaaagccagtagttcagatagctgtttttgctgtgttacagttaggttttcaggcaggttaagaattagaatttggcgattaaaaaaaagcccatttgattgaaccaggtcaaacaacatatcccattgggtatcattggcaatggtaaactcttgtttttcatcaaaatcctgtaaacgagccgcttgcacaatacagtcttttgcttcaccaaccaataagagatcctgcccggtcaataaataaaatggttgtaaacctttattgagggcaggttctaatccttctgggaaaatacgttgcatcatcttatttcgtatttgctaactctttttgtaatcctgcaactttaataagaagctggcgagaggcttgttcatacatttgacgctgaatactttcttgttcttctgattttgctaaagcggcacgagagtcgtcgaagaaagtacgatgaacgctagtttcaatcggatatgcccctttatttgggattgttaccgttgctttcaccgttaaactgaggattttttcagcttcacgcgcttgtttaaagactgacgcaacacgagagctactttctgttgcgtttaagcgtaaactcgcaacatcagcggatttcggcacgatttgaatgttactgagtaacatttggttacgcaaaatgcgtgacatatcgctgtactgatccgcactttcaaaactcaaggtacgcaactcttctgggaagagttcattatttttaaaatgccaaccgcaagcggttaaaaatagcacacaaatgagagagagtttttttaacataccatattcctattttgtagggtgggttttgacccagcatatacgatgtagactagatggtgagttaaaacccaccctactattatgctttcaccgcaaaactcaacatcttaaacggtacatagatctctttcacgatttctacgccttcaagatatttcgccacattttcatcggctttcgcaatcgccttgacttcaccttccgttgcggttgcagatacagtaattttaccacgcactttaccatttacttgcaccacaaccagtttttcatcttctaccattgctttttcatctgccacaacccaaggtgcaaagtcaattgaaccctcattgcctaaggcttgccatagttcaaagcagatatgcggggtgattgggtagagcatacggatcaccgcatttaatgcttcagccatcacggctttgtcttgatcattaacaagcggtgctttggtgagcttattcatcaattccataattgctgcaattgcggtattaaaggtttgacggcgaccgatgtcatcactcactttcgcaatggttttatgtacatcacggcgtaaatctttttgctctttgcttaatgccgtaggatctaatgcaacggtggcaggcgattgtgcatactcataagccaagttccaaagacgacctaagaaacgtttcgccccttctacgccagactcttgccattctaatgtcatttccgcaggggaagcaaacatcataaatagacgcaccgtatccgcaccatatttttccaccatttcttgtgggtcgataccgttgtttttcgatttcgacattttagtcataccgctgtgtaccaacgcacgcccttctttgtcaaaggctttcaaaatacgccctttttcatcacgttcaactgtcacttctgttggcgacacccaaatacgttcattggttgggctggtgtagtaataagcgtccgctaacaccataccttgacagagtaatttttctgtcggttcatcgctagtcacgaaaccggcatcacgcaataatttgtggaagaagcggaagtagagcaagtgcattgttgcgtgttcgataccgccgatatattgatccacaggtagccagtagtttgcttcttctttgtctaacataccttgttgatattgtggcgacgcataacgtgcataataccaagaagactccataaaggtatcgaaagtatctgtctctcttaacgctggctgaccgttataagtggttttcgcccattctggatctgctttgatcgggcttttcacgccgtccatcaccacatcttcaggtaacaccacaggtaaatcttgcattggtacagtcacagtttcgccattttcaagggtaagcattggaattggcgccccccagtaacgttggcgagaaacgccccagtcacgcaagcggtaattaacttgacgtttaccgatccccattccttctaatttatccgcaatgcctttgaaagcgccatcaaaatctaacccatcaaattccgcagagttaatcaatttaccgtgttcagtcattgccgctttgctgaaatcccattcagaaccatcaagcggtgcgatcacctgtttaattggtaaattgtatttttgtgcaaattcaaaatcacgctcatcgtgagcaggtactgccattacagccccagtgccgtagtgcatcaacacaaagttagcgacccagacaggaacttcttcgcctgttaaggggtgaatagcaaacaaccctgttgccattccttttttctccattgtggcaatatccgcttccgccactttggtgtttttcgcttcttgaataaaggcagctaatgcaggattgttttctgctgccagggttgctaatgggtgagccgccgccactgccacatagctcacaccaaagaaagtatctggacgagtagtataaacaggcaaggtttgatcagtgcctttcactttaaaagtaatctcaaccccttcagaacgaccgatccagttgcgttgcattgttttcacttgatctgaccataacggaagacgatctaagtcatttaacaattgctccgcatagtcagtaattttaataaaccattgcggaatttctttttgttccactggggtatcacaacgccagcaacagccttcgtgaacttgctcgttcgctagtactgtttcatcattcggacaccagtttactgtcgatgttttcttatatactaagccttttttatataattcggtgaagaaccattgctcccatttataatattcaggacggcaagtggtcacttcacgatcccagtcaaagccaaaacctaaggccttgagctgatttttcatatattcaatattttcataagtccattttgctggtgcagttttattttttaccgctgccccttctgcaggcaagccgaatgcgtcccaacccattggttgtaacacatttttgccgttcatacgttgataacgggaaaccacatcgccgatcgtatagttacgaacgtgtcccatatgcagacgacctgaagggtatgggaacatagataaacagtaatattttggtttgctttcgtctttaattgctttgaatactttattttcagcccagtactgctgtactttaggctcaatcgcactcggattgtattgttgttgcatcatcttcattcctcaaatttgtcgaaaaattgcggtatagaatagcgtaaaaatggggatttttgaaatgatattaagttcgcagtataaacaaaattaaatagtgaagcaaactccgtagatgtaaattagtcatttgttcgtattttaggctatgtcagcaaagcctaaagccccagcaaaattacctgatcgagaaaatctcagggaaatttttggcttacaacattcaaacgttgcgtgtgcagaaaggttggtcacaggaacgattagagaatgagtgtgagttagatagaacttatgtttcagcggttgaacattgccgctggaacgtttcgctttcaaatattgaaaagttagcaactgcactttcttgcccagcttggcagttattgaaatacccagaaaatagcaatcaaaatactgaaagatatttagatttatttatgctaaaatgcacccgctttttcgtccgcccgattgttagggcgagtaaagcaacttgcaaaaaattttgaaaaactgaccgcttgcaagcggtcttttgttttgaaaaatttacgaatttacccgtagggatacactgcgtgtgtccgctaaataccatcaatataaaatggaacggacacacgcagtgtgtccctacgggaataacataaaccaacaagtaacctttcgtatgggttaccactgtataaggattaacaatgccaattattactttacctgatggctcacaacgccaattcgacaatcccgtttctgtaatggaagtggctcaaagtatcggtgcaggtcttgcgaaagcaacaatcgcagggcgtgtaaacggcgaacgccgtgatgcttctgacattatcagcgaagatgctacccttgaaattattactacaaaagatgaagacggtttagagattatccgtcactcaacggcacacttactgggtcacgcaatcaaacaacttttcccgaacgtgaaaatggcgattggtccaacaatcgacaacggtttctattatgacattgatttagaccgctctttaacgcaggaagatcttgatgcacttgaagcgcgtatgttggaactggcgaaaaccaattacgatgtagtgaaaaaacgtgtgagctggcaggaagcgagagatacctttgaaagccgtggcgagtcgtacaaaatggcgattttggacgaaaatatcagtaaagatgaccgcccagcactttatcatcacgaagaatatattgatatgtgccgtggtccgcacgttccgaatatgcgtttctgccatcacttcaaattacaaaaagtggcgggtgcatactggcgtggcgacagcaagaataaaatgttgcaacgtatttacggtacggcgtgggcagataaaaaacaacttgccgactatttacaccgtttagaagaagcggcaaaacgtgaccaccgtaaaatcggtaaagcgttagatttatatcatatgcaagaagaagcaccaggtatggtgttctggcacaatgacggctggacgattttccgtgagcttgaaaccttcgtgcgtaccaaattaaaacagtacgattaccaagaagtgaaaggtccatttatgatggatcgtgtgttatgggaaaaaacaggtcactggcaaaactacggtgatttaatgttcaccactcaatcggaaaaccgtgaatatgcgatcaaaccgatgaactgcccaggtcacattcagatcttcaatcaaggtttaaaatcataccgcgatttaccgttgcgtatggcagaatttggttcttgccaccgtaacgagccgtctggttcattacacggtttaatgcgtgtgcgtggctttacccaagatgatgcccatattttctgtatgccagagcaagtagaaagcgaagtcacatcgtgcattaaaatggtgtatgacatttacagcactttcggttttgaaaatattcaagtgaagctttcaactcgcccagcaaacagtatcggtacagatgaaatgtggaacaaagcggaagcagacttagcagcggcattaacggctaacggtttagcttacgaaattcaagaaggcgaaggtgcattctacggcccgaaaattgagtttgccttgcgtgactgtttagatcgtgaatggcaatgcggtacgatccagttagacttcttcttaccagagcgtttaagtgcatcttatgtggcagaagataatgaccgtaaaacaccagtaatgatccaccgtgcgatcttaggctcaatcgagcgtttcatcggcattatcaccgaagaatatgcaggtttcttcccagcatggttagcaccggttcaagcagtcgttatgaacattaccgacagccaagcagaatacgttcaacaagtggtaaaacaactttctgacgctggcttgcgtgtgaaagcagatttacgcaacgaaaaagtgggctttaaagtgcgtgaacacaccttacgccgtgtgccttatatgcttgtttgcggtgataaagaaatcgccgaaggcaaagtgtctgtgcgtactcgcaaaggtgcggatttaggtacttacaaagtagaagagtttgtcgaaatgctcaaaaaacaagtgcgtggacgtgagttgaagttacttggggaagagtagtcagtttagatacactaggaggccaatgtagaggagagtaattctcctctcattactaataggcatagtagacaaaagtgttggttttaattattttccctaattattaccaactctttttatttaaaaaatcctttataaacataatcttacgctttttcgttaatccgctatgaaccgataatttctgtttcagttctttaaataacccttccaacctatttgttgttttttctatatttaaatgagtatattcttcaaaagtgagtttaaagccttgtactataaggctttagcccactttttaccaacattgtctactatgcaaaatatcctatctaaatcaccgctttcattagatttccgcctattatttctaacttttttaataattgacaataaaagttgaaaaatgcttgttattttattctttattttatgtaaatgttgttttttttttttttactaatagcgtgcggggacatttgtgcatcctgaaaatgtaaataaaggtttatgattttttattaggaaaaacagcttgtagggtgggtcttgacccaccatgtagccgtaacatattgattttattggtgggttaaaacccgccccacaaaattcaatccatctaaaatagggtttggcaaggagttaacttcccccgcttgcggggaaagtgcccaagcaaaagcgagggcaatgggggcatttgtgcatcctgaaaatgtaaataaaggtttatgattttttattaggaaaaacagtagagaaggttattatgaataaaatatttagagttatttggagtcatactcaacaggcttgggtggttgtgtctgagttagtaaagtctcataccaaaacatccacttgcacggataaaagagctcaagtatgcacctcagattattttttagataaacagcaagataaatttaaattaagtcttttaagtctagtattactaggtatattttttagtccaccggcaggttcagctactcactcaggaacaccatatactgcagatggtggtagtagatcgaatttaggatctgacgacggtactattagtattggtaaagagagtaaggcttcgtatggtgctattgctatcggtcagaggtcaaaagctgaaggtaggcatggtattgcgataggttatcaaacaaatgcaggaacacacgtaaactctgttgcggtaggcaacgatattcgagtaagtggggaggaagcagttgccatcgggagtagttcaaaagcgggaaagggatctgttgtcttaggcagacaagccgatgcggcaaatattgaacaagcagttgtaataggtaaccttgctaaagcaagtaaggcacaatctattgctatcggggcaaataccaaagcggaggggtatggctccatatcaatcggtggagatgatttaaaaacaacgaaatatcaaactggtaatcaaggccaatccaaaacaacaactgcgaaaggtaaggcctctgttgctattgggggtctgtctttggctacgggcgacggatctattgttgtaggtcctctagcatctgcaagtcatactgaaggcattgctatcggtgcgagaagtaagtctaccaatgagtacggtattgcggttggtggtggtgcaactgctggaaaaaacgccgttgctgttggtagggactcgaaaggtgctgggacagattccattgcgataggtaattctgcgaaaacaacaggggcagactctgttgttgtgggtgccagtatcaatgtgacaggtgaaaaattagtggcaattggataccaagcaagtgctaaaagtcgttctactgccttgggttataaagcctctgccggtggtatgcactctgttgctgtgggtgaagaagccaaaacaaatgatggtgctgctagagcaaccgcacttggtaataataccgttgtcaccgtgggtggcggtgtggcattgggttatggctctaaggcagatagagcaggtgatattgaaggggcaaaacagtcttattctgtaacagcagcaagcagtgttgataacggctttaaatctacaggaagtgttgataacaatcctattggtgcggtttctgtgggtaataacaacatcaaacgccaaatcgtcaatgtggcggcaggtaaagaattaaccgatgcggtaaacgtggcgcagcttcaatctttaaccctgaaaattgagggaaatgagaataagcataacggtgtaaatgctaatttaagcagtgctgacagacctaaagtcggcttgtggagtggtacgctcaaggtaaaaggcgacaacggtcttacttcccatgctaatggcgatacgattacggttaaattagagcaagatgtcaaaaataaaattgataagattgacaatttaggttggaacctgaagattgcgaaaggggggggtgaagtaacgactcctaatactccatatcttatcaaaatgagcgatatggcaaccgtaacctttaccgctggaaataatattaaattagaacaagcgggcggaaatattacgatttctacgattggtaagttaattaaagagactaaaatagtagatggtaatttgcaaattacttatacggatggcaagactgatactattactaaggggaaagacggtaaaaatggtgcgaaaggtgataaaggggaacaagggccagcagggcctagaggcgaagctggtcctaaaggcgaagctggtcctgcgggtccagcaggtgctcaaggtccagtaggtcctgcgggtccagtaggtccaactggaccacgaggtacacctggtcctgcaggaccaaaaggagaggcaggagcagctggacctaagggtgagaaaggtgatccaggaccaaaaggcgaagctggttcaacaggtccaacggggcctgctggtccaaaaggcgatccaggacaagcgggtccaaaaggagatacaggtcagaaaggtgaaactggccctgcgggtccagcaggtgcaactggtcctgcaggtccaaaaggagaggcaggagcaaaaggcgataggggcgaaactggccctgcgggtccagcgggaccaaagggtgaaccaggtcctaaaggtgaacaaggtattccaggccctgcgggtccaacgggtccaaaaggtgatacaggtcagaaaggtgaaactggccctgcgggtccagcgggaccacaaggtcctgcgggtccaacggggcctaggggtgacaaaggtgatacgggtccagcaggaccacaaggccctgcgggtccaacgggatcacaagaccctgcgggtccaactggaaattcggaattaaaaggcattacgtcgattgccaatggtaacgacgccaccaaggcgaatggggctaagattaccttgtctgcaggttctacaaataaaacagttaatgttaatgatgcgaaaattaccaatgtggcggctggtacagcagatactgatgcggtaaatgtgagccagttaaatactaaggcagcagcttcaaaaacagaggttgaagcgggtaaaaatgtgaaagtgacttcaaaaacgggtgcaaatggtcagaatatttacaatgtgagcgtgtctggagatttaagcgacattacttcaattagtaatggcgatacgaaagtatctttaggtaaagatcagaaaggaaatccagttgtaaatatgaatggtgccagaattaccaacgttggagatggtagtgctgagggcgatattgtgaatgttcgtcagctcaacaaagtggtttcttctgtgaatacaggatttaatcaattatcaagagatattggtcgtgttgatgttaatgcaagagcggggattgcttctgctggggcgatggctaatttgccacaaatttctttaccaggtaaaagtgctatttctgtttctaatgcacaatatcgcgggcaatctgcctatgctataggttattccagaatttctgataatggcaaatggcttattcgagcgtctgttagcagtaatactcagcgggatactatgattggaggaggggtaggttttgtgtggtaatctagcacctataaattagaatttcatgctcaatgccattgttattttaacaatggcattgtttggcatagtagacaaaagtgttggttttaattattttccctaattattaccaactcttttgtctactatgcctactaatatagagtgctcacaaattcaccacaaatttcccaaccccaagatcatcttctttgcgagtacgattaattacactttgagcggattcaataacacgtaaacccatctgatcttcggttctcaccacttcaccacgcaatgagttggtataaacatcagtaattttaacatccacaaatttgccgatcatattaggtgtaccttggaaattgacaatacggttgctttcagtacgtccggttaattccataatgtctttcttagatgggccttcaactaaaatgcgttgttctgtgcctaacattgcacggctaaattgcattgcttggttgttgatacgttgttgtaagcggtataaacgctcttttttctcatcttccgtcacatcatcaggcagatccgcagctggcgtacctggacgagcagaatagataaagctgaagctcatatcgaaattgacctgctcaatgattttcattgtttgttcaaaatcttgagccgtttcacctgggaagccaacaataaagtcagagctgatttgaatatcagggcgagcctcacgcaatttacggataatggctttatactccaacgccgtatggttacgtttcatcattgttaaaacacggtctgaaccactttggataggtaagtgtaagaagctcactagctcaggggtatctttatatacctcaatgatgtcgtctgtaaattcaatagggtggcttgtggtataacgaacacggtcaatgccatcaatcgaagcaactaaacgtagtaattccgcaaaagaacagataccgccgtcaaaggtttcaccacgataagcgttcacattttgaccaagcaaattcacttcacgcacaccttgttcagccagttgagcaatttcaaataacacatcatcgacaggacggctaacttcttcacctcgtgtataaggtacgacacagaatgagcaatacttattgcaaccttccataatggacacaaatgcagttgggccttcagcacgaggctcaggtaagcggtcaaatttctcaatttcagggaaactaatatccaccactgaactttttccgccacgaatttggttaatcatttcaggcaggcggtgtaaggtttgaggcccgaaaacaatatcgacgaaaggggcacgttcacgaatatgttcaccttcttgtgaagctacgcaaccacccacaccgataattaaatcaggtttatcttttttccagtttttccagcgaccaagttgagagaacactttttcttgtgctttttcacggatagaacaggtgttaagcagtaatatatctgcttcttcaggattttcggttaattctaaaccgtgtgtgctatttaaaaggtctgccatttttgacgagtcatactcgttcatttggcaaccccaagtggtaatatgtaattttgccattttcaaataatagataaatcagtaagtaaaaaataaaagtagagttgtttatcctttggaacagggtgtaccttattttacatgtttgtatatatcatcgctataaaaaagaaaaccacgaccaaaactcgtggtttttattcaagtagtgtaactattttgttaaaactaaaacagtactttcacctgccacaacttctccagacaatttttgaagatttgttacttcatccatatttgaaattacaacaggtgttaatactgattttgctttagattgaagtaattcaagatcaaatttgatgataggatcaccaactttaacctcttgattttcttctgcaagacgtgtgaaaccttcgccttttaactcgacggtatcaataccgaagtgaacaaaaagctcaacaccatcttctgactcaatagagaatgcgtgattagtttcaaagattttaccaatcgtaccgtttactggggcaacaatcatatcaccagtagggcgaatagcaatgccatcacctacgatcttttccgaaaacacaacatctggaacatcttcaatatttacaatttcacctgaaagcggtgcatagattttcacttccttcgcaacagcttcttttttgccgccgaatagtttgtcaaaaaatcccataatttaatctccattattaaatgaacaaaattctcgcatattttatacgagaattttgtgtttgtattcaattttagttaaggttttggtaaaactcatcaactaaacgttcaatatctgctgctgttggttgtgcaagtgctttatctgcaagagctttggcatcagcatagttgatactgcgaacaagttttttcacatgaggtactgaaattgcactcatactaaactcatctaagcccatgccgagtaataaggcagtcgctttgacatcgccagccaattcaccacacattccagtccatttgccttctgcgtgtgaagcgtcaattacttgtttgattaagttcaagacagatggggttaatgggttgtataggtgagcgataatttcattaccacgatctaccgctagggtatattgtgttaaatcgttagtaccgatactgaagaaatctacttcttttgcaaggtgacgagcatttactgcagctgatggcgtttcgaccattacgccaatttgaagattttcatcaaaagctttgccttctgcacgaagctgagctttaagttctgcaataatgccttttaattcacggatctcttccacagaaataatcatcgggaacatcaccgcaagtttaccaaatgcagaagctcttaatacagcacgcaattgagtatctaaaatttcacgacgtactaagccaatacgaactgcgcgccagcctaagaatgggttcatctcttttggtaattctaagtatggtagctctttatcaccgccgatgtccattgtacgaagcaccacgagcttaccattcattgcttcaacaatttctttataggcttggaactgttcttcttcaccaggtaactggttacgatccataaataagaattcagtacgatataaaccaacgccttcgccgccgttacgcaatacgccatccacatcacggatagtcccgatgtttccaactacttcaatgcggtgtccgtctaaggtttccgctggtaaatcttttaatttagctagttcagctttttcttctgcaattttggtttgtaatgcttttgctttttcaagttgttctgcagaaggattgatgtaaacttcattgttaatggcatcaagaattaaaatgtcacctgtattgactaatgaagtaatgttgtttgtacctacaacagcgggaagctctaacgaacgagccataatagaagtatgagatgtgcgaccgcccatatcagtaacaaagccaagcactttatctaagtttaattgtgcagtttcagatggagtgagatcgtaagcaacaaggatagcttcctcttggatatcaccaagatcaacaatattcatacctaaaatgttacggatcaagcggttaccaatatcacgaatatcaccagtgcgctcttttaggtattcatcatcaatttccgcaagcatcgatgcctgcatatcaatgattttacttgcggcaacatcggcagttacaagattttcttcgatgtagcctagaatttcttcttctaattcttcatcttccaagatcattaaatgaccttcaaagattgcttctttttcttcgcctaacgtgcgtcttgctttttctttaattgctgtaagttgtgctgctgctttttcacgtccagtaaaaaatttacttttttcagcttcaatttgagtgggtgtgattttatgtgtgttaagaacaataggttcttctttcagaactaaggctttaccaaatacaatacctggggaagcggcaatacctgtgatcataaattaatcctcggctagaatttagtagatgctaaatagcacgaaagactttaccattgaataaaatggtaaagtcatcaatatcaaaaggacaactactctaaagtagggattaaatctactaagaaatctacagctttctgttcgtcttcgccttcagcagaaagagtgatgatagttccttgcgcaagacctagggtctgaagtttaaataaactttttgcactggcacttttaccattagatgtgacagtaatatctgaagcgaagccttttgctgcttttacaaattcagccgcggggcgtgtatgtaagccattcgggcaagtgattgttacatcttttgagtacattgttggttcctctgttgtatatcaaataataaatggaggactttttagggaagagcctccaaagtaagtcacgggattactttactacaaaatcggtataaaaacacgataaaagagattaaataaatgataaatgtcaattattagtgtgtattttaatcaatttataaaatcgtttgcgtattttatgaattatgtgttttattttcttttttatagaattattgattgcaattacccttaaaatcttgtatttatccatactttcaattcaaacacaacttcaactttttaggagcataaaatgcaaaatgtaggttttatcggatggcgtggtatggtggggtcggttctaatggatcgtatggttcaagagaacgactttgcgaacattaaccctgttttctttaccacatcacaagcgggtcaaaaagcccctgtttttgcaggcaaagaggctggtacattaaaagacgcttttgatattgcagaattacaaaaattagacattatcgtgacctgtcaaggcggcgattacaccaacgaagtctatccaaaattaaaagcaacaggttggaatggttattggatcgatgccgcttctgcactgcgtatgcaagatgatgcgatcattgtgttagacccagtaaaccaacacgttattaccgaaggtttacaaaaaggcattaaaacctttgtgggcggaaactgtactgtgagcttaatgttaatggcaatcggtggtttatttgagaaagatctcgtggaatgggtgtctgtggcaacttaccaagcggcttccggtgcaggtgcgaagaatatgcgtgagttactggtacaaatgggcgagttagaagatgcagtaaaagcagagcttgcagatccagcgtcatctattttagagattgaacgtaaagtgaccgctgaaattcgttcagaagatttcccaacggcaaactttggggcgccacttgcaggtagcttaattccttggattgataaattattaccggaaacaggacaaaccaaagaagagtggaaaggttacgcagaaaccaacaaaattttaggtttaagtgcaaatccaatcccagttgatggtttatgtgtgcgtatcggtgcattacgctgccacagccaagcgttcaccatcaaactcaaaaaagatttaccattagcagaaattgaacaaatcattgcagctcacaatgaatgggtgaaagtcattccaaatgatcgtgaaacgacgttgcgtgaattaacaccagcgaaagtgactggtacattaactgttccagtgggtcgtttacgcaaactagcaatggggccagagtacttagcggcatttaccgttggtgaccaattattatggggtgcggcagagcctgttcgtcgtattttagtgcagttagttaaataatcttttcatctaatgatcaagcggtcagattattgcaaaatcctgatattatgtaacagttgcgtagaggtttcatccgcttgatgaattaatttctgatacagtataattgagtgaaacggcattgtgcttgcataatgttgatagcttgatgaagtgttgtaatcttttcatccaccaatgctaaatgttgtaacacttattttagttctcattgtaactcggtcagttttttcttaaatcaatgtaggttcaaagcaattttcaccgaaaaatatagtatctgactttaaatccacatcacatataacacaaaacttatcaaatagtttatatgatgccatttgtactcataaaacacaaaaaaacagaaatgctaatggaagaatggcaagttttgtttagattatctgagtctgataaaggtcaaaatcaagatatagaaaaaagaagaaaaaaactatcggaaatatttagtgataacattaataataatgagaaagaatatctggctctctatgttcttcaaacatcttatgcgataattgtgaaattaatagcatgtaaagtcattcaaactctttcgtttagtgaagatgttaagtttttctcagatcttagtattattgattctattaaattacaacgttttatggagaaacttgaagatggatatgttttttctagtggtggaattagaaacttactggaaggtgacttctattcttggtattcaaataaaaactaatggaaccaaaaatatataatagtataaaaaatataattaaagagttagagttttattcaagttcaaattttagttatgaatttcagacgatagatatttttaaagatttatatatggaaataatgcctaatgaaattaggcatagtttaggagaatatttcactccatcttggatggctgatcatgttgtatctcgctcacttgagaaactaaacaaagaatcttggaaagctatagatccatgttgtggaagtggggtatttttaatatcattaataaaatcgatactagataaacacgaattatatagtttaactataaaagaaaaacaagagttattattaagaatactatcaagtgtatatggtattgatttaaacccactatcagttttaactgcaagagttagttattttttggctataagaccattaattgacgaacaaaaaatagaaatccctgtctatcttggtgattcagctaatataccacaaaaaattgaactcgataatatagcttgttatacatataccgtagaaacaaaacaaggggattttaatattatttttccttgtaattttgttgaaagtagttctttttttgaaagaatgtatcgtttacaaacaacagtagaagctgaagaccctaaattattataccatcaaattattgaaaatatagataaagactctatcaataacaagatcaaacaaagtataaaaatattgtcaagtaaattggttgaattacataaaaatgaatgggacggtatttggattagaattacatcaaactttatgctaattgcaagagttaaagagatggatctaattttaggtaacccaccttgggtaaaatgggaatttttaccccaaaattacgctgaaaagatcaagagtttgtgtattgatagaaaattattctcaggtcaaagttatatgggagctatatcacttaatttatgtgctttaattgcaaatgttacatcagataaatggctaactaataaaggcttactagcattcttaatgccaaaaacaattatgactcaagattcttatgctggtttcagaaatttttatttatctgatggtagtcgaatgtatttaagtgaaatagatgattggtctaatgccggaaacccttttattgtaactaccgaaaagtttatgacatatttttatgaaaaaatcctgtagattactcaaatgggatacctataaatttattctataaaaaatccaatgtgaaaatcacagaagtaaatagatttcatacatttgaaaaagtaaaagatttctttcagattaaagatggaatggcttatcaattaagcgaaaatagaacgggatttactttactccctgaaagagattatacaattttaaggaagctaaagttaatttctggaacttcagattataaagctaggagtggtgttgagtttacgcctgctgaggtttacttcattgaacctgagaaaagaaccagtaaaaacactttttattttagaaactctgaattcaaaaattcagtttacaaagtggctaaaaactaaattcacattttaaatttatataaagtttggaggtgtttaagcgatttcaatgcgccgccatttgaatgtgaactataagaccgattttgtcctttgccataaattacgtgaagtgccattcaaaactcgtgatttaagcccattacaaggtgaaatcctcgcagatggtgcctaggttaattttaattgtgcaacactaacttcgccaaaaatcgctataaatagtaacaaaaagccgataaacaatggcgaaaatttccaaagttcaggcagactaagcgttgtattatcagtctcaatcaacgagctttcaatgatgattgtggggttcaaatggaactattgtggcgatgaactatactgaaaatgccagaacaattttagcattaaaccaccaattcgtgaaacaaggtggtaatattatatgtgatgaaaatatggcgtatcaaacctatataccaaaaaacataggttaacctagtaaattctcatataatacaagcatctttaactatttatggactatttatgacaacatcatccccccttatagctattgtcgctggtgaaatttcaggcgatattttaggtgccggattgattaaagcactcaaagtacattatccaaatgctcgttttatcggcgttgctggtgaaaaaatgttaaaggatgggtgtgaaaccctgtttgatatggaagagctggcggtaatggggcttgctgaggtagtgagacatcttcctcgtttacttaaaagacgtaaacaggtgattgatacaatgctggcattaaaaccggatatttttatcgggattgatgcccctgattttaatcttggtgtagaagaaaagctgaaagccgaaggtattaaaaccattcactatgttagtccgtcagtgtgggcgtggcgacaaaatcgtgtacataaaattgctcgtgcaaccgatcttgttttagcctttttaccttttgaaaaagccttttacgaccgttttaatgtcccttgtcgttttatcggtcacacaatggctgatgtgattgcgttgcaacctaatcgacaagaggcttgccgtttgttgcaattagatgaaaaccaacgttatgtggcgattttggttggaagccgtggaagtgaagtgaatttcctgtctgaaccatttttaaaaacggcacaattacttaaagctcaataccctgatgttcagtttttagtgccgttggttaatgaaaaacgtcgtgaacaatttgaagcgatcaaagcacaagttgctccagaattagaggtgataaccttagcaggcaatgctcgtgctgcgatgatggttgccgaagcaacattattagcatctggcactgctgctcttgaagcgatgttgtgtaaatcgccgatggttgtaggttataaaatgaagcctttaacctattggttagcaaaaagattggtaaaaaccgattatatctctctgccaaatttacttgcaaacgaaccgcttgtcccagaacttattcaagcggattgttcccctgaaaatttagcaaaacatttgagtatttatttatctcaaatgcccgaagatgtggcgaagaagaatgcgttgaaacaacgttttatggaattacatcaatatattcaatgtgatgctgatgctcaagctgcacaagctgtggttgatgttttgaatagagagtaaaaacgggcaatttttgcccgttttatataacatcaataatctacgagtgatttttgatctgccccttctttctctaccacaggctgaatcatatgctcacgtttcaagcccaattcaagagcaacacctactgccacataaatggacgagtaagtaccgaaagcaataccgatcaataatgccagtgagaagctatgtaatgttgggccacctaatagataaagtgagaataccacaaatagcgttgtaacagaggtcatcaatgttcttgataatgtttggctaagtgaaatatccacaatttcgactgaatttgcccgacgaattttcgggaagttttcacgaacacggtcaaacaccacgatactatcgttcaaagaataaccaacaacggataaaatcgcagccacgaaagtaagatcaatttcaatctgtaagaatgagaaaagaccaatagtcaccattacgtcgtggaacaaggctaaaatcccccctgttgctaaacgccattcaaagcgaagaccaacgtaaatcagcaacattgcaagggttgctaatgtgccgtaaatcgccccttgggttaattcttcaccgacatttggaccaacgaactcaatactttgaattttagcttctggatctaatttttggtgaattaaatccattaccgtattccccaaagatatatcgccagccgaagcaggtaggcggatcattacatctttttgtccaccaaaggtttgaactaaagcactggtataaccattttctgttaatacttcacgaacctttgccaaatctgcaggctgtgaaaagttggtttcaattactgtaccgccagtaaaatccaatccccagttaaaccctttagtcacaatggtaaacacacaaagtgccgtaatgatcaatgaaaatacatacgcaatgtagcggtatttcataaagggaactaatttataaggtagtttaatttctacttctttttctgttgtttgaacagtcatttaattccccttagatccaaagttttttcacacgtttaccaccgtaaacaaggttcactaacatacgagttcctgtaattgcggtgaacattgagatcattacccctaatgcaagagtcacagcgaagcctttgactggacctgttcctactgaataaagaataatcgcaactaatattgtggttaagttagagtcgaagatactggtgaatgcaccattatagccttcgtgaattgcctgctgaatagaacgaccattacgaatttcttctttaatccgttcataaatcaatacgttagcatcaattgacatacctacagctaacacaatccctgcaataccaggcattgttaatgtagctccgattaatgacatcaacccgatggttaaaactaagttagctaataaagcagctgtcgcaaatagaccgaagactttgtaatacaccacgcagaataagatcgttagacctaaacctaacatacttgcgtccataccttgagcaacgttatctgcacctaatgaagccccgatagttcgttcttcaacaatcacaatcggtgcgatcaaagctccagaacgtagtaatacagcaaggttttgtgcttcagccgcactgttaatacctgtaatttggaatgagctacctaaacgagagttaatggttgcaacgttaatcacttcttcgtgtttttcaagaatcactttcccgtttgcatcacggcgacctgaatctttaaactcactataaagggttgccatcggcttacctacagcagattttgtcgcatttgacatcaaatccccgccttgtgcatcaagattaatactaacattaggcaaaccacgttcatctttgcccgaagttgcattaataatatgctcaccacctaaaatggttttgcgatataacaccgtcggcataccatcacgactatatttaatctccgaatccgcaggaacaataccacgagccgcagactctaagttagcattaccattgactaaacgaaattcaagagttgcagttgcccctaaaatctctttcgcacgagcggtatcttgcacacctggaagttcaacaacaatacgatctgccccttgacgttgaatagtcggctcagacacaccaagttcttccacacgcttacgcaaaatcgacaagttttgttcgatagctaaatcacgagaagttgctaacccctgagcagattgagcaaaacgcacaacggttggagaaatataagttgcttctaaattaggattagtacggcgaatataacgaactgctttatctgcagtatcggtatcattaaattctacatctgttgcaaaattttctgcttttttaaccgctttgtattgccatttttccttacgaaaatcgttacgcaaggtatcttgtagctgatcttgctgtttcgccaatgccgtattcatatccacttccattaagaagcgaacaccgccacgcaaatccaaaccacgcttcatcggctcaccaccgattgaagttagccattctggcgttgcaggcgcaaggtttaaagcgacagaataattattgcctaagacttcagcgattttttccttagctggaagctgttcctcgtccttatttaaacgcactaaaatcgaaccattttcaaggttcatcgccttaggcgtaatatttaatgaagcgagggctgattgaacttgcgtcagcgtttcatctgaagcttgttgccctctagtaccggaaacctgtaccgaagggtcttcaccatataaatttggaagggcgtataaaatgccaatggcgaccacaaggatcaccattaggttcttccaaagagggaaacgatttaacacgataagtcccctttcttaaaggaaaaaattaaagagatttgagtgaaccttttggtaacactgcaactacgaaatcacgtttgatagttacttcggtagtatcgttcaatgcgatcacaacattatcattatctgcagttactttagtaattttaccgattaacccaccgcttgttagcacttcatcaccttttgataaacctgctaataattcacgttgttgtttttgacgttttgcttgtggacgataaatcataaaatagaagataagaccgaaaacaaccaaaataaagatcatttccattccgccgccttgttgcatataaagctcctttaaaattattaactaaatttagacttcatctcaacattgagataatcactcactaaaataacataaaatctaccgtttaacgagtggaaattcagacaaatctgctgatcggctttgtttctgttaagttttaggataatctcacaaagtattgtgtcaaatcattgaaattcaatcttaacaaggaaaaaagatgaaaaaatcgtattacaagcggcagtatcttgcctatttcttacaaatgttgctttcgcccataatgtacaattaaaccaaacgttaccaagtgttaccgttcaacaagatggcgaattaattgccaatggtaaaaaagttgattatcgccaatggcaatcttcaagcctagctggaaaggtaagagtagttcaccaccttgctggcagaagtagtgtaaaagagaaaaatcaaccattaatggacgcaattaaaaatgcagggtttgatcgcagtaaataccaaaccacaaccattattaatgcagacgatgcgattgttgcaacgggagcatttgtcaaaaatagtgcagaaaacggtaaattggaaaaccctcactctcaagtcattcttgatcaaacaagtagtgtaaaaaatgcgtggaaactaaaagaaaaagagagttttattgcggtattggataaaaacggtaaagttcagtttgtttctgaagggaaattatctgatactcaaaaccaacaaattattgaattagtgaacagattaatttcccagtgatagataattccacaaatggagaaaaatggtgcaaatcgcttctagtgttacactacaagcgatttgttatttcaattattttacgatttattttgtatccaattgtgggatcacattattctgaacagaaagcaaacctgcctgtgtataaatacctaatttaccacgcgtatccacaatgtctaaattacgcattgttaattgaccgatacgatctgctggggtaaacggtgcatcttctactttttccatacttaaacgttctggttcataggttaagtttggtgattcggtattcagaattgagtagtcattgccacgacgtaattctaaagtcactgtgcccgtaatcgctttcgccacccaacgttgtgctgtttcacgcaacattaaggcttgcggatcgaaccagcgaccttgatagagcaagcgacctaaacgtaacccattgatacggtactgttcaatcgtatcttcgttgtgaatacctgttactaaacgctcataggcaatatgtaataacgccattcctggtgcttcatagataccacgagattttgcttcgataatacggttttcgatttggtctgacattcctaaaccgtgacgaccaccaatgcggtttgcttcaagaataagctctactgcatcttcgatacgtttaccatttaatgcaacaggcacaccttcttcaaaggtcacagaaacgacttcaggcttgatttcaaccgtttcgtcccaaaatgctacgcccataataggtttaacgattttaatgcctgtgctaagtaactcaaggtctttagcttcgtgagttgcccctagcatattagagtcagttgaatatgctttttcaacggacattttatagtcaaagccatttgtaattaagaattgtgacatttctaaacggccaccaagttcgtcaataaaagtctgatctaaccacggcttatagattttgagtttgggattagttaataaaccataacggtaaaaacgttcaatatcattgcctttaaaggtcgagccatctccccaaatattaacatcatcttctttcattgcagcaacaagcattgtccctgttacagcacgaccaagcggagtggtattaaaataaggcacgccacctgtcgaaatatggaatgcaccacattgaattgctgcaataccttcgtgagctaattgctggcgacaatcaattaaacgagcattctccgcaccgtattccattgcttttctagggatagcattgtaatcatcttcatctggttgccctaaatttgcggtataagcataaggcacggcacctttttgacgcatccaaagtaatgcggcactggtatctaatccgcccgaaaatgcaattcccactttttgaccaagtggaagcgtttctaaaattgttgctgacataaaacttcctaatattttttgaatgaaattaaaaaattctcgcaatcttaccgcttgcgttcaaagtccgatattctaacgcaaaagtgaaacacaatctattcaaagaaaaagaatttataggtcacaaaaaaacggtaagatgtattatcttaccgcctgtaaaatgcattatattaactatttaaattataaatagaatttctcaacaaagtttaatttgtcatcaagtttcaacactaacggctgaccggttgggatttcaaaatccataatttcttcatcagaaataccgatgatatgttttgccaacgcacggagagagttaccgtgagcagtcacaagaacacgtttaccagataacaatgctggtgcgatttggtcttcccagaatggtaaaacacgctccagggtgatttttaggttctctgcatttggcacaacatcttttggaagatgtgcataacgacggtcgttatgtgctgaatttggatcttgtggatctaaatctggcggagaaatatcataagaacgacgccaaatatgaacttgctcgtcaccatactgttctgcggttgcttttttgtctaagccttgtaatgcgccatagtgacgctcgtttaaacgccagtttttcacttgtggaatccaaagttggttagattcttctaacacgatgttacaggttttgatcgcacgggttaaaacagaagtgaatgcgatatcaaattcataacctgcatcaagtaattttttacctgccgcttttgcttcttcaataccacgctctgttaagtttacatcacgccaacctgtaaataagtttttagcgttccactcactgaaaccgtgacgaataaatactaattccataagttctcctatataaaataaattgatttaatgtctatttataacaaaaaatacttttttttaaagttaaacacaattaatttgaagataaaaatgatctatgacaaaaaataagatgtaataatttattcctatgttggtaagaatgctactatttgcttattgcgagcatagggtatttaaaatctgtctcacccgctccaaatcctcagccgtatccaccccaacttgaggggcttctttggctaagtcgagatgaattttctcgccgtaccataatgctctaagttgctctagcgactctagctgttctaatgccgttggttgccacgcaacatattgcttaacaaaacctgcatggtaggcatagatcccgatatgacgaagatagttttgttgttgaacaaaagcatcatcacattgagggaaataatcacgtccaaaagggattgttgcacgagagaaatagagtgccattccgtttttatccgttaatgttttaaccacattgggattaaatagctcttctcgtgttgtcaatttaaccgcaagggttgccatattgacttgatgtttatctaaattttcagccacttgtgccacaatcaaaggcggaataagtggttcatcgccttgaatattcacgataatttcatcatctgcaatcgccattttttcaatcacttcggctaaacgttctgtgccagaattatgtttatctgacgtcaagcacacttctcctccaaaccttgtaacaacctgttcgatttcggggtgatcggtcgcgacgattacacgagtggctccagattgttgtgccttttcccaaacgtgttggatcatcggtttacctgcaatatctaacaggggcttacgcggtaagcgtgtagaggcataacgtgcagggataatgacggtaaaactcataaaatctcctaaatgcgactaagatcaaatttcgctaaatcaatatgatttggcgtgccataaaattcacacaaggcttggcgaagttgttctgcacgttttggtaagcctttttctgcatagattttaacttgttcataaacggcttgtttgaaagcagaattatcgccagcatcgcccgttaagttatcagcactggcaaaataacggaaatttgctgccgtagctaacacccattcaatcgcttgcggttttacttcgacttgttcaaattctctttggcgttcagcagagcgtccatcgggttcataccagtaaccaaaatcttctaatttacggcgttctgttccagcaactaaccagtgagcaatttcgtgtaatgcactgctgtagtagccgtgagcaaataaaataacattataagggcgttcactcgctacgttaccttcatcaataaaagcgggtagataaatcggataatctccgccccgctctaaacgagtgttgtaactttctgcaaagcaagcgtcaaagatacgaataagatcttcatgatcgtgatcgttttggttcattgtaaatcctatttgatgtaacttacaaaatcagtaatttcttctgtttggctagcggtggcaatgctatccccctcaagtggcgagccaaccagcagtaatgcgacaatttcatcgtcagcttgacaaccaaaggcctggcgtaaagcctgtcctttaatccacttattggtaatccagcaagtttcaaagccttgaacgttggctgcaagttgcattgcataggttgcacagcctgctgtaaccatttgctcccaagcgggtactttgggtaaatcttttgctattttagcgataatcccgataaccattggtgcgcgtttagctaatttttctgcttttgtaacaccttcatcacccatttcaagttcttgagcggtttctaacaggcaacgacggaaaatttccattgccgttggctcaatcactacgaaatgatagggctttaaacgcccgtgatctggcgctctaactgccgctttaaacatattttctagttgttctgcatttggtacatcttgaccaaattttttacttgaacggcgacgttgtagtaaatctaacgtttccattgagtattcctcgtgataaaaaatgggtcaaaggatagcatattttgtttcgctttgttttgttgattgtagggaaacaaggaggattggctatttatttaaaataattttttagatttagcgatcctaaaattgtttgctgtacactagcagtttgagcacattattgtatagcttcatattgagcttcaaatatcgtaaacgtttgcttaagatccaattttcattatttgatcttgatcacattttttatgtgagattttccgcaagttattctaaaaatagtgtaaacttatcaagtttttcaggtgatgatatagggtgattttaatcatcgattagtcgtctaaacactattcatttttatattgattaattttaggagtcgaaaatggcagaacgtagagaacttgcaaatgctatccgttttttaagtatggacgcagtgcaaaaagcaaattcaggtcaccctggtgcgccaatgggtatggcggatactgcggaagtgttatggcgtgattttttatcacacaacccaaccaatccagcttgggcaaaccgtgaccgcttcatactttctaacggacacggctcaatgttgatttatagccttttacatttaacaggctacgatctttcaattgaagatttaaaacagtttcgtcaattacactctaaaacaccaggccacccagaatatggctatgcaccaggcgttgaaaccacaacaggtccgttaggtcaagggattactaatgcagtaggtatggcgattgcggaaaaaaccttagcggcacagtttaaccgtgaaggtcacgagattgtaaatcactacacctatgcgttcttaggtgacggctgtttaatggaggggatctcacacgaggcttgctcattagcaggaactttaggcttagggaaattaattgctttctacgatgacaacaatatttcgattgatggtcacgttgatggctggttctctgacgatactgcaatgcgttttgagtcttacggttggcaagttatccgcaatgttgatggacacaatgcggaacaaattaaatttgcaattgaaaatgcacaagcagaaaaagatcgcccaaccttaattatctgtaaaaccattatcggttatggctcaccaaacaaatgtaactcgcacgattgtcacggtgcaccattaggtgatgcagaaattgcggctgctcgtgaatacttaaaatgggaacacgcaccttttgttattccagctgaaatctatgcagaatgggacgcaaaagcaaaaggcttgctcgcagagaaagagtggaatgcaaaatttgcagcttatgaaaccgcttacccagagcttgccgctgaatttaaacgccgtgttacaggtgaattaccagcaaactgggcgaaagaatcacaagcgtttattgaaaaattacaagcgaacccagcgaacattgcaagccgtaaagcatcacaaaatgcgattgaagcctatgcacacattcttcctgaatttttaggcggctcggcagacttagcgagttcaaacttaacattatggtctggctcaaaaccaatccgtgcagatcataatgttgatggtaactacatcaactacggtgtgcgtgagtttggcatgtcagcgattatgaacggtattgctttacacggtggctttattccatacggtgcaaccttcttaatgtttatggaatatgcacacaatgcggtacgtatggcggcattaatgaaacaacgttcattatttgtttacacccacgattctatcggcttaggtgaagatggcccaactcaccaaccagttgaacaaactgcggcattacgtttaattccaaatcttcaaacgtggcgaccgtgtgaccaagtggaatctgcggtagcgtggaaagcggctgttgaacgtaaagatggcccaagtgcattaattttcactcgtcaaaacctagctcaaatggaacgtaccccagaacaacttgccaacgtggctcgcggtggttatatcctacgtcaatgttgcgaaaaaggcgattgcccagatttaatcttaattgcaacaggttcagaagttgaattagcgatgaaagcagctgaggtattaagtgcagaagggcataaagttcgtgtggtttcaatgccaagcactaacgtgtttgacgcacaagatgaagcttatcgtgaatcggtattaccaagctcagtgaccaaacgtgtggcgattgaagcaggtatttcagatttctggtataaatatgttggctttggcggccgcattgttggtatgaatagcttcggagagtcggcaccagcaagtgaattattcaaactcttcggctttaccgtagataacgtggtagcgaaggcgaaagagattttgtaattacatagaatgtggcaaaataaggggattttatatccccttattttttagtttctatttgggaaatcagaaaatgaagaaaattcttgttattcgtaacgataaaattggcgattttatgttggcttgggcggcatttgcgatgttaaaaaaatcaatgccgaattgccaaattattgcccttgttcctaaatatacagcaccattagcggaaatctgcccttatttagatggtattattttggatagttcagataaacaaaataaagctgaaaatgatcgtgtattacaagcggtaagatctgagcaatttgatgcagtgattagttttgtgtcggattggtataacgccaaattggtttggaaaagccgtattgtctaccgtttagcacccgcaacgaaactctttcaatttttatataatcaccgtttaacccagcgtcgctctcgttctgaaaaagcagagtatgaatataatgtagacttagtgcgttattttttgaaagataatcaaattacagcggtagagccgacgacaccttacttatcttttgataatgcttgtctgagtacgcaaaaaagcaaattaatggaactattaaagttagatggcaataaaaaatggctttttgtacatagtagtacaggaggatctgcgacgaatttatctttgaatcaatatgcggagttaattttagggattttagcgaaatttgattgccaagtgattttaaccgcagggccgaatgaaagcgaaactgctaaagcattgcaacagttagtaaatcataagaatgtggttatttatgataaaaatgatggattagtcgattttgccagatcgttagcctgtgctgatctctttattgcaggttcgacagggcctttacacatttgtggggcattaaatattacaacggtaggtttttacccaagtcgtttatctgccattccacgccgttggaagccgttaaatgatgccgataaacatatcgcattttgtccgccatctgataaggcttcgcaaaaaaatttaaccttaattccgatggataaagcattaacggagattctgccgtttatgagacaaatcatggataataaaaaattataggatagtaagtagtaatatgttttagttattactagtaattaaatgttattaatatagtattttttattgttacaatctatctacttttgaattagagaggctacatgcaaaaaagaatttttaattttatccagaaaaaatatttatgtactataagttgtgcaaagaataatattccttggtctaatgcattttattatgtatttgatgaagataatctgcgtttaatttttgtgacgagcttaacgacttatcatagtcaagtgatgttagagaatcctaatatttctggtacaatctttgtaccaacgcgttttcatccctctttacaaggtgttcaatttacaggtaaagcaagaaaattagagggggatgaaaaaaatattgctagagaattatataaaaaagaatattcacatgaacttattgataaattgtctatttgggaggcaaaattagagtatgctagattaattgataattcattaggattatttagtgtaatagaatggaatggggaagaatatttctaatatatagttttatactttcaacatcatagattcttttgagaaataaatttattagaacataacagtatgaatataaaaattcttattactggtggtgcaggttttattggatctgcaatgattaggtatattattaataatactcaagacttagtaattaatatagataaattaacttatgcaggtaatttaagctcattagaggagatttctaatagttctcgttatgcatttaaacaaatagatatttgcgataaaatagccttagagcagatatttaatgaatatcagccagacatagtaatgcatttagctgcagaaagccatgtagatcgttctattaagaattcggaagtatttattaagactaatatttggggaacttatactttattagaagtagctcgtaaatattggaatgatttgccagaggaaaaaaaatctatatttcgtttccatcatatttctactgacgaggtttatggtgatttaggaacaagtgagaggcagtttacagaaatcatgccttatgctccttctaacccctattcggcatcaaaagccgcaagcgatcatttagtgcatgcttggaggcgtacttatggggtaccaactatcgtcacaaattgctcaaataattatggtccctttcattttcctgaaaaattgattccattgatcatcttgaatgcaatagaaggaaagaaattaccaatctatggtaatgggttacaagttcgtgattggttatttgttgaagatcatgtgagagctttatataaggtaattaaagaaggtagagtgggagaaagttataatattggtggtgatagtacgaaaagtaatctggaggtggtttatgctatttgtgaaatattagaagaattacttccacataagccaaaaggggtacagaaatataaagatctaatttcttatgtaccggatcgtctagggcatgatactcgttatgctattgattcaactaaaattcgcgaagaattagattggaaacctcaagaaacttttgaaagtggaattcgtaagacagtagagtggtatttaaataatcaaaaatggtggaaaagcataagaaaaaataatttttcgtattcttgttaaacaaaatagatattcattccttagcaacattctgaatgattaaacttaagaatacctttggttattttatcgctgtagagtgaatttgctaattactattttaacaaaagttattgaattttatcttctttcaaatacttatgttataaatgagtaagcctatctattagtggatcttcaaatataaaccctgcagattgtaatttgtgaggcacaagcggttgattatctaataacaattgcgaacgttcacctaataaccattttaagatccattcaggcacagtaaaaaaggctggacgtttaaggtgttgagccaatttttgattgagggcagaattagtcagtagatttggcgacaccaaattaaaagcaccactacattcgaaatgattgagtagaaataaaattgcccgaatttcatcatttagcgaaatccaagcccagtgctgtttaccggatcctagctttccccctaaaccgaaacgataaagcggcaacattttttgtaatgcaccgcctgttttgtctaatacaatgcccgtgcggataagacaaactcttgtcttattactctgagcttgtaaggcggtcttttcccattgaaaacagagctgagcaggaaaagctgtaccacaagcggtttgttcatcgtaatgttttccttccgccaaattgccataaaaacccgttgccgatcccgaaataaaggtgtgaggaggcgtatcgctcgcttgaattagctcgactaaacgctgggttatactaagacgactttgtattaatttttgtttctgtgctgtagtccaagctttgttaaaaatcggctcgccagcaagattgatcaccgcatcgaatgtatttaaatgctggaaagcggtaagatcttggcaaaaacttaccgcttgttgatgaggtagcctttggcgagtcagtacggttagctgatgtccttgcttgattaaagcctgacaaagtacttttccaataaagcctgttccgccagtaatcagtatattcattagagtgagctatcaaaaagttcagtaatggttgcaattaatgttgaaatagaggtatcacgagttggggtaatgaaaatcgtatcatcgccagcgatagttccaagtatgccttctgcttttcccattgagtccagtaatcgagcgatcaactgtgcggcaccaggacttgtacgaacaacaatcaaactttcattatggtcgatatcgatcactaaatttcttagtgggcttgacgtggttggaataccgagttctgctggtaagtgataaaccatttccatttttgtatttcgggtgcggactgccccaaatttactcaacattcgggatacttttgattgattgatatgctcgaatcccatttcttgcaacgcagtgacaatttcgctttgtgaaccaaatttttcttctcgtaacaatgatttaaaagcttcgttgagagagtcgagtttttccacttattatccttttatttttatgcaattgtagccgtaaatatgcagaattgttgcctatttattcacggaaatcaatctaaactcactttttttctcgaaaatttgcggtaagtcgcaaaattgtattttggtatttgaaagttactatgaatttacatacactttcgctattaaatttacataacctatgaggagaaacttatgaaagttgcagtattaggcgcagcaggcggtatcggtcaagcattagctttattattaaagttacaacttcaggctggcacaaacctcgcactttatgatattgcccctgttaccccaggtgttgcagttgatgtgagccatattccaacggctgtaaaagtagttggctatgcaggcgaagatccaacaccagctttagaaggtgcaaatttagttttaatttctgcaggtgtggcacgtaaacccggtatggatcgttctgatctgttcaatatcaatgcaggtattgtgcgtaacttaattgaaaaagtcgcaacggtttgtccgacggcttgtgtgggaattattactaacccagtaaataccacagtagctattgctgcagaagttttgaaaaaagctggcgtttacgataaacgtaaattattcggtgtgacatcactcgatgtattacgttcagaaacctttgtggctgaattaaaaggcaaagatgtcaatgatgtaaaagtgcctgttattggtggtcactcaggcgtaaccatcctaccactactttctcaagcatttgaagaagataaaattgactttactgcagaagaagttgcagcattaaccaaacgtattcaaaatgctggtacggaagtggtggaagctaaagcaggtggcggatcagcgactttatctatggctcaagcggctgctcgctttgctcgttctgtgttaaaaggcttaacgggtgagcaggttgttgaatacgcttatgtcgaaggcaatggtgagtatgctcgtttcttcgcacaaccagtttgtttaggcttaaatggtgtagaagagttgttacctatcggtactttaagtgcttatgaggaagaggctgttcaagcgatgatcccaaccttaaaagcagatattgagttaggcgaaaaatttgtaaacggttagtcttgaatttatcgtaaaatcacgccatgatacaagggctggaaacttcagttttcagcctttttatatactactatggtgtactaatatggattatcttattaacgtcaataacactaattttagtgaagttattaaagctgcagcagaagtccctgtcgtttttcattttatttctccccgtgagcctcgttcacttgaggtggaggcttgttttcgtcgtttaaacgatgaatattcaaaacaatttctccttgctatcgtcaactgtgatgaatacccgatgattgccgcacaatttcgcatacaagcggtgcctacaagttatttctttgcaaatgggcaacctgttgatgtgattgagggtgagataaatgaacaagaattgcgagttcgtctaagcaacattttacccaaagaggaagaacttcaattcgctcaggcgcttgaatttctagaagcagaacagtatgaacttgcgttaccgttattaaaaaatgcttgggaactgacgcataagaaaaacagtgattttgcgttactctatgcggaaacctatattacaatgaagcaagttgaaccagctaaagcaatcttgatgcaaattccaattcaagatagagatagccgttggcaaggtttgcaagatcaaattctattactagaacaagcggctaattccccagaaattcaacaactccaagctgattatactaagactaaaagtcctgagattgccgtaaaattggcaaatcagttacatcaagttggtaggaatgaagaagctctagaattattatatgattggttgaaacatgacctttcagcaggtaatggagaaattaaaaagcaatttctcgctattttatctgcaatggggaattccgatcctcttgttcctaaatatcgcagacaactttactctttattgtattagttttagtaagtgatttttcatatatttaggagaacaaaatggcaacaaaacacgcaaaattattgattttaggttctggccctgctggttacacagcggcagtttatgcggctcgtgcaaatttaaacccagtattagtaacgggaatgcaacagggcggacagctcactacaactacagagattgaaaactggcctggggaatttggcgatattacaggttcagagttgatgaacaaaatgcaaaagcacgctgagaagttcaacactgaaattatttttgaccatatcaacagcgtcgatctttcacaacgcccattcaccttaaaaggcgactttaatacctttacctgtgatgcgttaattatcgctacaggtgcatcagcgaaatacttaggcttgccttctgaagaggcttataaaggtcgaggcgtttcggcttgtgcaacctgtgatggtttcttttatcgtaataagccagtagcagtaattggcggcggaaatacggctgtggaagaagcgttatatctttcaaatgtagcctctgtggtacatctagtccatcgccgtgatacttttcgcagtgaaaagattttaattgaccgcttgatgaaaaaagtcgaagaaggcaaggtgattttgcacacccacagtgttttagatgaagtgttaggcgataatatgggcgtaactggagtgcgtttaaaatgtactcaaacaggtaatgaagaacagattacgcttgacggcgtatttgtcgcgatcgggcattcaccaaatacggaaatttttaaagatcaactagagcttaacaatggttatattgtggttaagtcaggtttagatggcaatgcaaccgcaacaagcgttgcaggcgtattcgccgctggtgatgtgatggatcataactaccgccaagcgattacttcagctggaacaggttgtatggcggcgcttgatgcggagcgttttttggaatattgctcataacttttgacatagtagacaaaatagttgctaatgtttgttttctttaaatattagcaaccttgtctattacatctagatcgtttgttcccagtattttcctcattgtagggagcaatatttcagtcacaattatttgttgtgctcaattttcttaagataagaatatgtgttaagaggcagaaaattaaagtgggtggaatccttcagttgattatttctgatatttattccacaaatcagcatacttcacaaaagtagaatgtgccgacagaacggcaagtaaaaaaccttgcttaccatcaagaaaacctgcttttaaaatatacatttttacaaaacagccgacagcgtgggtaacaccttggaataaagttgcttttttgccagctttggctctttgctctgaccaagccctagcgtaacttgctgattttactagataatggtgaatatctttataagtaaaatgcaataaatcgcctttaagtttaacgactttggcttcttttggataatggactttttcgtgaacaagttcatcgccgtattgtgcaaaatctgtgcgataaagtctcaccacataatcaggataccaccctgaatggcgaatttgtttgccaaaaacttcacttaaacgggggatttgataaaccgtattttgttcgttattacttaccgcttgttgtatgctttgttttaattcttgggtgacacgttcgtcagcatcaagccagagaacgtaatcgctggtgacatattgttgagcgagttggcgttgtttaccaaaaccttgccaatcggtattttcatagaattttgctccgtattgtaaggcgatttctttggtattgtcgctacttccagagtctagaatgatgatttcatccacccaacctttgatagtttctaaacattgggcaagatcttgcgattcgtttttgacgatcattgcgacgctaagcgttggcataggttatcctttttgaaattaagtcagtttcgcctattttagcatatctttagctttaaaatttattctgaatatgctattttctacgccgatttttttagcatagaaaggcaattttaatgtcagtaaatttaacaacaaaacagaaacaatttttaaaggggcttgcccatcatttaagtccagtcgtgatgcttggtggtaatggtttaaccgaaggggtgttagccgagatcgaaaatgcgttagatcaccacgagttaattaaagtgaagatcgcaggggctgatcgtgagatgaagcagttgattattgatgcgattgtacgtgaaaccaaagcggtgcaagtgcagaccattgggcatattttagtactttatcgtcaaagtgaagagaagaaaatcagcttgccaaagatagctaggagcatttaatcaaatcttcaggaatagatgtttgtaagcacagtgatatattcatagggacagagaaattagttaatacttagaatgttgtatgaataatgaacaaaatataagcctgttactcaaacaaaattttgcatcaggattagtcgtttttcttgtcgcattgcctttgtacttaggtattgcccttgcatcaggagcgccacctttagctgggattttatctggggttattggaggtgtcatcgttggcacattaagttcttctcatattagtgtttctggacctgcagcggggttagcagcgattgtattagcagcgatgacagaattgggggctttcgagttatttttatgttctggtgtgattgcgggcgcactgcaattgcttctgggttttcttcgagctgggagtatctcaaactatatacctatttctgtgattgaaggaatgctggcagggatcggtgtgattattatccttaaacagttaccttatgctcttggtagtgatgatacattaattgaaattgttcattctacttgacgggttcatttagggtctttggttgttgcagtagttgcgcttattattatgattggttgggaacagcaacctcgattacgttaactcaaattactcccttctgctttagttgccgttattgtggggattttacttaaccagcttttcatatggttcaacagcccgcttgcaattccaacaaatcaattagttcaactaccagtattaaactctttagatgaagtaagttccttaattcgctttcctagcttagagggtttcaacaatagcatagtctggattacagggggaactattgcagtagttgcctctgtggaaacattactttcaattgaggctgcagatcgtttagatgttcgccgtcgaattacggataataatcatgagttacgagtacaaggttttgctaatatattaacctcttcgataggaggtttacctatgacatcggtcattgtgcgttcttctgctaatgcaaatgcaggagcgactcataaatcatctgcggtatttcatggtgttttgttgcttatgtgtattaactattccaagtgtgctcaaccagattccccttgcaacgctagcggcagtattaatattgattggatataaattgacacatccaaagcattataaacatttttggtgtaaggggagttatcaatttattcctttcgttgcaacaatggtttctgttgttttccttgatttgctgaaaggggtagggattggcttagtgattagtattctattcattctgcatggaaatatgaaaagagcttattacttgagccgtgaagaattagctgatgcggataagattatacttgagctaggtgaagaagtctcttttttgaataaggcagcgattaagaaaactttaaaaaatattcaacctaattcaaaagttacaattaatgccaagcgggctttatatattgcaagtgatgtattggaattactagaggactttaccaatgtatatgctcaagaaaataatattcaggttaaattgcgtggttttaaatatgactatgaacatcaggaagggagagagcatacacatattcgagttgagcatcgaagccggatttagccataaaggagtggtagaggaaatatagaccttagttcttattttgagcaattaatgtttttttctgtaaaaattataaaaagtacttgcgttggtttaggatttctctataattcgcaccacacaacgacgcgctgttgtgagtagttaaatttgacagtgcgtcgttcttttttgctctttaacaacttatcagacaatctgtgtgggcacttgttgattgactttgtttaaaaatatttttttaattttgaagtcttgataggtgcttaacttgaaattcataatgattgaataaattcagtcgtgatttttttatagtcagtacatattgagcgattaaactttttaaattgaagagtttgatcatggctcagattgaacgctggcggcaggcttaacacatgcaagtcgaacggtagcaggaaggaagcttgctttctttgctgacgagtggcggacgggtgagtaatgcttggggatctggcttatggagggggataacgacgggaaactgtcgctaataccgcgtaatgtctaaggactagagggtgggactttcgggccacctgccataagatgagcccaagtgggattaggtagttggtggggtaaaggcctaccaagccgacgatctctagctggtctgagaggatgaccagccacactggaactgagacacggtccagactcctacgggaggcagcagtggggaatattgcacaatggggggaaccctgatgcagccatgccgcgtgaatgaagaaggccttcgggttgtaaagttctttcggtgatgaggaagggtgatgttttaatagagcattacattgacgttagtcacagaagaagcaccggctaactccgtgccagcagccgcggtaatacggagggtgcgagcgttaatcggaatgactgggcgtaaagggcacgcaggcggtgacttaagtgagatgtgaaagccccgagcttaacttgggaattgcatttcatactgggtggctagagtattttagggaggggtagaattccacgtgtagcggtgaaatgcgtagagatgtggaggaataccgaaggcgaaggcagccccttgggaaaatactgacgctcatgtgcgaaagcgtggggagcaaacaggattagataccctggtagtccacgctgtaaacgctgtcgatttggggattgggctttatgtttggtgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatcctaagaagaactcagagatgagtttgtgccttcgggaacttagagacaggtgctgcatggctgtcgtcagctcgtgttgtgaaatgttgggttaagtcccgcaacgagcgcaacccttatcctttgttgccagcgatttggtcgggaactcaaaggagactgccagtgataaactggaggaaggtggggatgacgtcaagtcatcatggcccttacgagtagggctacacacgtgctacaatggtgcatacagagggtgacgaagccgcgaggtggagtgaatctcagaaagtgcatctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaactgaaaggggggcgtttaccacggtatgattcatgactggggtgaagtcgtaacaaggtaaccgtaggggaacctgcggttggatcacctccttacctgaatgaagagatttgcaagtgttcacacagattgtttggtaattgtagacaaggaatagagcaagaaaacagacacaagcggtcagatttgcgataaaatttgcaaattgacaggatgaaggaaagcatctttaaatgttgtccccatcgtctagaggcctaggacatcgccctttcacggcggtaaccggggttcgaatccccgtggggacgccatttaaagatgattttttgtcgaaagataagtgattatcgaatgttctttaaaaatttggaaacaagctgaaaactgagagattttctgtaggggtaaatcatatttgccctgaaacaagaaagtctgagtagtaaaaaatcttaactgaacaaaagcggttaagtgtttagtagttaatatcagtcttaaatgttttttcttttagataaaaatgtttgaggttgtatagttaagtgactaagcgtacacggtggatgcctaggcaatcagaggcgaagaaggacgtgctaatctgcgaaaagcttggatgagttgataagaagcgtttaatccaagatatccgaatggggaaacccgatggatgaagaatccatcatttcattatgaatccatagtaatgaaaggcaaaccgggagaactgaaacatctaagtaccccgaggaaaagaaatcaaccgagattttgtcagtagcggcgagcgaaagcgaaagagccagcaagtgatagcagcaaagacagaagaattggctgggaagccaagcgacacagggtgatagccccgtattttaagtttatgttgtggtactaaacttgcaacaagtagggcgggacacgagaaatcctgtttgaagatggggggaccatcctccaaggctaaatactcctgattgaccgatagtgaaccagtactgtgaaggaaaggcgaaaagaaccccagtgaggggagtgaaatagaacctgaaaccgtgtacgtacaagcagtgggagcccgaaagggtgactgcgtaccttttgtataatgggtcagcgacttatattttgtagcgaggttaactgaataagggagccgaagggaaaccgagtcttaactgggcggatagttgcaaggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaatctatttaggtagagccttatgtgaataccttcgggggtagagcactgtttcggctaggggtccatcccggattaccaacccgatgcaaactgcgaataccgaagagtaatgcataggagacacacggtgggtgctaacgtccatcgtggagagggaaacaacccagaccgccagctaaggtcccaaagtctatattaagtgggaaacgaagtgggaaggcttagacagctaggatgttggcttagaagcagccaccatttaaagaaagcgtaatagctcactagtcgagtcggcctgcacggaagatgtaacggggctaaaatatagcaccgaagctgcggcatcaggcgtatcacaaatacgccttcgattaacaacatcgaatgaagtgaaacggaatgagatgttggtcaagcacccaacacgttgagttggcataaagtgcggatagaaatcagaggaatatttgtgatacgcctgttgggtaggggagcgttgtgtaagtcgatgaaggtgtattgagaagtatgctggagatatcacaagtgcgaatgctgacataagtaacgataaaacgagtgaaaaactcgttcgccagaagaccaagggttcctgtccaacgttaatcggggcagggtgagtcggcccctaaggcgaggctgaaaagcgtagtcgatgggaaacgggttaatattcccgtacttggtaaagctgcgatgtggggacggagaaggttaggttagcagactgttggatgtctgtttaagttggtaggtggggagtttaggcaaatccggacttccataacactgagagatgatgacgagtttctacggaaatgaagtaactgataccacgcttccaggaaaagccactaagcgaaaggctttactaaaccgtactgaaaaccgacacaggtggtcaggtagagaatactcaggcgcttgagagaactcgggtgaaggaactaggcaaaatagcaccgtaacttcgggagaaggtgcgctggcgtaggttgtaagagtatacctccgaaggctgaaccagtcgaagataccagctggctgcaactgtttattaaaaacacagcactctgcaaacacgaaagtggacgtatagggtgtgatgcctgcccggtgctggaaggttaattgatggtgttatcgaaagagaagctcctgatcgaagccccagtaaacggcggccgtaactataacggtcctaaggtagcgaaattccttgtcgggtaagttccgacctgcacgaatggcataatgatggccaggctgtctccacccgagactcagtgaaattgaaatcgccgtgaagatgcggtgtacccgcggctagacggaaagaccccgtgaacctttactatagcttgacactgaacattgaattttgatgtgtaggataggtgggagactaagaagcaggcacgccagtgcttgtggagtcgaccttgaaataccaccctttaacgtttgatgttctaacgaagattacgaaacgtggtctcggacagtgtctggtgggtagtttgactggggcggtctcctcccaaagcgtaacggaggagcacgaaggtttgctaatcacggtcggacatcgtgaggttagtgcaatggtataagcaagcttaactgcgagacagacaagtcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgttggagaattgagaggggctgctcctagtacgagaggaccggagtggacgcatcactggtgtaccagttgtctcgccagaggcattgctgggtagctaaatgcggaagagataagtgctgaaagcatctaagcacgaaactcgccttaagatgagttctccctagctataagctagtaagggttgttgaagactacgacgtagataggtctggtgtgtaagcggtgtgagccgttgagctaacagatactaattgcccgagaggcttaactatacaacctcaagcgtttttgaagtagacgtgagagagttagagagctgaataaaagcaacaaactaactaaacaaaataaaacaaagagactcagaacagcttgtttcgaaattagaatagtgtaggggcaaattacatttgcccttaaagaacagaaagatgtaggggcaaattacatttgcccttaaagaacagaaaaaagaagatagagagaatcatcaaaagattttcccgacgacaatagtgcagttgtcccacctgactccataccgaactcagaagtgaaaagctgtaacgtcgatggtagtgtggggattccccatgtgagagtagagcatcgtcggggttttattaaagagaaaaaccgcaggttagagatagcttgcggttttttgttttctgtatacatatctgatttgattctccgcttttactttttttccaaaaaatgttaaattgatcacatttttaatccattgagataaccactgatgaaagagctgatcttacctaaaataagtcaaaacctagcaagctcatctctttttcaagatcaattatcttatataaaacatcgagttgatatgctcgatcagttccgtatccataatacgttacgcaaccattccgaagctttccaaagcgttttttcattattacccgctttattacactataacattccgagtttgcctgcgtatgttgaaaatgcaccaaaaggtatttttaatttcaacttatcggctactcagaaagcccatttgtcgacctattttcctctgcctgaagatacaaaatatgtcgcttttgatggtttgtatgtgatggggagtattggatcaattacgcaaacttgtttatcagacttggatctatggctttgccattcgcaatcttttagttcagaagaatctgaattgctacagaagaaattgagtttaattcggcagtgggcaaaacagcaggggattgatgtcaatttttatttgatgaatccaaataggtttaaagcaaaaaactacaatagcgatgtgtgtgacgagcataatggctctgcacagcatttcttcttgcttgatgagttttatcgttcggcaattcgtttggcgggtaaacggattttatggctacatatgaataatggcgaacaggattatgagcaatatgttcagaaagcggtgagtttagggcaattaaatccagcggaatggatagactttggcgatttctctgcattagcgattgatgaatatttcggggcaagtctttggcaactttataaagggattgaaagtccttataagtctgcgattaaaattttattgttggaaagctatgcagaaacttaccctgaaacacaccttatttctaagaaattcaagcagttattgctttcaacagcagaagttagctatcattttgatccgtatttggctatgttagagcaagtaacaacatatttagaaaatcgtaaagagtttgttcgattagaccgcttgcgtagctgtttttatatcaaggcttatgatggtcagcacgatagctggcgtaaagaagcattgagagagttggtgacgcagtggcaatggagtgaacgtgaaatccaatgtttaaataattgccgtcagtggaaagtaaaaaaagcaatgacgcatcagcagatgattgttgaacagttattgcaaagttaccgtaatttaattcaatttgctcgcaaatttcatattgatcccagcattttgccacaggataccgacattttaatgcgtaaactctattccgcatttgaagtcgtaccaggtaaagtgcctttaatcaatcaaaatatcgctcgaaatttggctgaagatgaagtgactttcattgaagtcaatgaaggtgtttcaactaaagcaggctggtatctgatcaatcacgccccgttaagttcctatgactcaacaacccgtcacgttcagtatcaacgaacacttatcaaatcagtggcttgggcttattttaatcgagttattacagcctctacgcaaattcacttggtcagccaaagcctccagctttcaaccttacgtcaatttattacagatttacgcctttcatttcctgtcgcaacgccagcattgaaagatgatgatctttatcacccaaatgaaattcgtaacctgattgtcgcgattaatttaattcaagatcccacaaaagctctcccttccttgtctaaaatggagatggcacaactggatctgtttaatttaggctcttcagagcaaggaatgattggtagtgttagcattatttatcgcaatatgtggaatgaaataatgacacagcactttgagggaaatgatgccattttgaaatccctcaagttaatttctaataaaatttatcgtaattctgcacctccacaatctgtcaatgtattttgttatagctgtcagctaagaaatgagttacaaaatgcagtaatgagtttggtcaatcgttgcattaccgtacaaacaggctctattttccaacgccagcaggcacagacattcaaaatggctggaaaaaaatggcaactgatttttaataaaaataataatttacaaaatattgttgccgatgaactcaacgatttgggtgatgagttgtcagagtttacaggcaatattcctaaagagatttatgattttgccagcgaaggctttttacaatttttctttgatgataacgccgacggtagttttaatgtttatgtccttgataaaaataaccagaccgaatgttattgcaactgtgttggggataaagaaaataaaatccgacgtattagccgatcttattcagacacggaaggtaccaaagaaagccttaatagctttaattttcctcagttttatcagctattaaaacaaaatgatatgattaaaattgtaccatttcagagtaaacaacatcgagaatttttagaacaacattaaaaataggaaagtttgtgtcctcaactttagctaaccccgaattgattaaaaccgtggtgttacttgcaacaagtattaccattgttccgctttttaaacgaattggactgggcagtgtattaggttacctcgtggcaggttgcttaattggaccttcaggtgcgggactattccaagatccaaatgcagttgtacatatggctgagcttggggtagtgatgttcttgtttattatcggcttggaaatgcaccctgagcgtttgtggagtatgcgtaaagcgattttcggtcgaggttttttacaggtcgctctatgtgggacattgctcacttttgcaggtatttttattctaggtttaccaaaagaagttgcgttcattgcaggaatgggctttacactctcttcgactgcgattgtaatgcaagtgcttgaagaaaaagggattagtaccacacctaaaggacagcgtatcgtttcgacattaatttttgaagatctagctattgtgccactattagcctctattgcatttttagcacctgaacaagctggagcagagcaagggacaaattggactgcgattggtgcgggcttagtgggagtgctgatcttagttgcttcaggtaaatggttaatgaacccactgtttaagatgatttctaaagctcacattcgcgaaatgatgaccgcagcggcattattagtggtattaggttctgctttgttaatggaattgagtggtttatctatggcaatgggggcattcgttgcaggggttatgttgtctgaatcgtcgttccgtcatcagctagaggcagatattgaaccatttaggggtttattacttggtctattctttatgggcgtgggaatgtccctcgatctttctctcgtactaaataattggttatggttactgggtgtgatattactttatgtggtaggcaaagggttatctatttatgttgttgcattagtcacaaaattaactaaccttgaagctattatgcgtacagcgattatgtcgcacggcggtgagtttgcgtttgtccttttttctgctgccgctaccgcaggtgtttttacagcagataatcaagcgactttcacagcagcagtgattgtatcaatgcttttatctccattggtgatgatcgtcattcaacgtttagtgaatttgaaagtgaaaaaatccacaggagaagctcagccaaatttagagggcattgaatttgcagaaaatttagaaagtagtgttcttgttattggctttggacgttttagccaaatcatctgtcaagtattgttagctcgcagaattaatgtttcggtgattgattctgatgttgagaatatccgtatggcaacccgtttcggctttaaggtttactatggtgatggagcaagaattgacgtattaagagccagtggtatagcacaagcagactgtgtgattgttggtttagctgaacctgatcgcactttgcaaatattagaattaattaaacacgaatatccattagtgcctgtttttgctcgttcttacgaccgattcaatactgtgaatttaattaaacatcatgttgattaccaagtgcgtgaaaccttcgaatctgctttattgctgagcaaggtgacccttgaacgattaggtgcaacagaaacagaagctcaagatgtaattaatcttgttcgccatttagatcaggagcgtttgaacgaagaagtactacacggtttttccgatgaaattgcgaaaaaatattggcgagttgaacccttcgtaaaaccagcacacgaagcgacagctttaaatgaagaaactgcagatattttagaagaaattggcgaaagtattgaggtggttgaagttgaacttgatgatcagagtgaaatggaaaagattaagttcgcgactgatgaaaagaaagaagatgaattaagttaaaacaatttttagctatttgaaagttaaattactttataatttaactttaatatgaaatgtaagatagattaagacaatgattgaagctgacagaattatcagtgcctcaacaaagaaagaggacgaaaccatagatcgtgcaattcgccctaaaatgcttgccgattatgtcggacagccgtcagtgcgagagcagatggaaatttttatcaaggcggctaaattacgcaatgatgctttagatcacctgttgatctttgggccaccaggcttaggtaaaacgacactggcgaacattattgcaaacgaaatgggcgtgaatatccgcacgacatcagggccagtgctggaaaaagcaggggatcttgccgcaatgctgacaaacctagaaccctacgatgtgctttttattgacgaaattcaccgcttgtcgccagccattgaggaagtgttgtatccagcaatggaagattatcagcttgatattatgattggtgaaggccctgccgcacgttctattaaactcgatctccccccatttacgctcgttggggcaacaacgagagcgggctctttaacttcgcctttgcgtgatcgttttggtattgtgcaacgccttgagttttattccgttgaagatctcacctccattgttagccgtagtgccagctgtttaaacttaaatcttgccactaatgccgcttatgaaattgcacgccgttcacgcggaacgcctcgaattgcaaaccgattgttacgtcgagtacgagattttgcagacgtacgaaacaacggcattatttcctctaacattgcaaaacaagcattaacgatgttagatgtcgattccgaaggctttgattttatggatagaaaattactttctgctgtaattgagcgatttgatggcggacccgttggattagataaccttgcagccgccatcggcgaagaacgggaaaccattgaagatgtgctagagccttatttaatccaacaaggctttttgcaacgtacgccaagagggcggatagcaacgtcgaggacttatagtcatctggggttggtaaaatctgaatagtgtaaatcggtagaatttttaaggttctgccgattgttttttgttttattcattgattttctttactcaagtcacatttttacaaataatctctataaaagtaacttaaaaactttacaaaattgattttttaagttactaattaaaaatttttaacacaactaaaagcggagatcatttatgcaaacaactttcacccgttctttattagccagtgcagttgcacttggtctttccgtttctgcatttgcagctaaagtgcctgaaggtacggtgcttgcagagaagcaagagatcattattaacaatagctcagaaccatcaagttttgacccacataaaacagaaggtgtgccagaagctcaagtttcttatcagttacttgaaggtttagtcaccaaagattctgcgggcgaaatcattcctggtgtggctgaaacctggaaaagttctgatgatttcaaaacctggacttttaatttacgcaaaaatgcaaaatggtctaatggcgaacctgttaccgcacacgattttgagttctcgcttaaacgtttaggcgatccgaaaacggcttcaccttatgcaagttacttaaactatcttcaagttgaaaatgctcaagacatcattgatggtaaaaaagcaccgagtgagttaggagttaaagccgttgatgattacactttagaaatcaaattaagcaatcctgtgccttacttagtcggtatgatgacgcaccaaacgatgttacctgtgccaaaagcggtcgttgagaaattaggtgatgcgtgggtgaaaaaagagaactatgtaggtaacggtgcttataaattagttgagcatgtgattaatgaaaaaatcgtgtttgaacgtaacccattgtattggaatgataaagaaaccgtgattaataaagcgacattcttagcgattccaaatgcaagtactgatgttcagcgttatcgtgcaggcgatttacatattaccaactacgcattgccgccagagcagttcccgacattgaaaaaagaaattccaaatgaagtgtttgtaacccgtacgctttcaacttactactacgagccaaacaacgaaaaagcaccatttaacgatgtgcgtgtgcgtaaggcgttaaacttggcattagatcgtagtgtgattacggataaagtattagggcaagggcaaacgccaacctatgtgtttacaccgccgtacattacagaaggtcacttaattcaacaacctgagtactcaaaacaggatatggcatctcgtaaagcagaggcgattaagttgttagaagaggctggctttagcaaagcgaaccctcttaaatttacgcttttatataacactaacgagaaccataagaaaattgcgattgcagcacaatcgatcttaaaacaaaacacgggcggtttagtggatattaaacttgaaaaccaagagtggaaaactttcttagatacacgccgtgcgggtaactatgatgttgcacgtgcaggttgggcggctgactataaccaagcgtcgactttcggtaaatacttcttgtctaactcaagtaacaataccgctcgttataagagtgcggcttatgatgctgaaatcaatgcggcatataaagcgggtaacgcagaagaacgtgcggcagcttatgcaaaagcggaagctcagttagcgaaagattatgcgatcattcctatctataactatgtaaatccacgtttggttaagccatttgtgaaagggtatgagggtaaagatccgcaggatgatattttattaagaaacctttatatcattaagcagtaatttttaagcggtgcgatttttaaaaatctttgcaaattttgccaaaaatcgttccgcttgttttcttttgttgtgtggatcggagaactgagcaatgttgaaatttataataaaaaggattttagaagcgattccaacgctttttattttaatcacattttcgttttttctaatgcggttagcaccaggtagcccatttacctctgagcgtgcttatccacctgaagtgatagcaaatattgaagccaaatatcacttaaatgaacccttatataaacagtattttatctacctcgagaacttagctcagggggattttggcccctcttttaaatataaagatcaaaccgttaatgatttaattgcctctgcttttcctgtttcatttaaactgggtattgttgctttttgctttgcggtaactcttggcttgctggcaggaacggtggcagccttgaagcaaaatagtaggtgggactactttataatgtcctttgcgatgacggggattattatgccgagcttcgtctttgcccctcttttagtgttaatttttgcgatttatctcaaatggctacccgctggcggttggaatggcggtcagctctattatatggtgttacctgttttatcgcttaccattgcctatgtcgcagggattgcgcgtattacgcgtggttcaatgattgaagtgctacactctaattttattcgtacggcacgagctaaaggcttgccgatgggtaaaatcatttttaaacacgctttacgcccagctatgttacctgtgattagctatcttgcccctgcgtttgtggggattattacaggatcaatggtaatcgaaagtgtctttggtttacctggtatcggacagcttttcgtcaatggggcattaaaccgtgactattcccttgtgttaagtttaacgattttggtcggcacattaaccattttctttaatgcggtggttgatattctttatgccgtgattgacccgaaaattcgttattcataaggagtgtgagatgttaattaataataagaaaaatcaagaacttgcagaaaaattagcggaacagaccgctgacatcgccgtggaaggtcgcagtttatggcaagatgctcgtcgtcgctttttccgtaataaagcggcggtaagtagtctgatcattctcttttttgtggtgttattcatcacttttgcaccgatgttaatgccatttagctatgaagacacggattggaatatgatgagtgcggcacctgattttgcatcagggcattatttgggtactgatgcttctggtcgtgacttgttggtacgaattgcaatgggcggacgaatttcgctgatggttgggattgcaggggcattgattgctgtggtgattggcacaacctatggggcaatttcaggctatgtgggcggcaaagtcgatatggtgatgatgcgtttgctcgaaattttaggctcgttcccatttatgttctttgtgattttattggtgacattcttcggtcaaaacattctgttaattttcgtggcaatcggtatgattgcgtggttaagccttgctcgtatcgtgcgaggacaaaccctcagcttaaaaaacaaagagtttattgaagcggcgattgtctgcggtgtgccgaaacgccagatcatctggaaacacattattccgaatgtattggggatcgtggtggtttacgcttcccttgaagtgcctgctttaattctatttgagtcctttttaagtttcttaggtttaggtacacaagagccgatgagcagttggggggctttattaagtgatggtgccgctcaaatggaaacatcaccgtggttattggcattcccagcctttttcctctgtttaaccttgttctgttttaactttattggcgatggtttgcgtgatgccctcgatccgaaagacaaataggaagttgcacaatgaaattattagaagtcaataatttagatgtctatcttaaaaccgatcaagaattggtacacgcagtgcgttcggtttctttcagtgtggaaaaaggacaaactttagcgattgtcggcgagtcaggatcagggaaatcggtcacttcaatgtcgataatgcaattgttgccacataacattgttacctatggcgaaaattcttcgattatttttgaagggcaagatattttacgtttctcagataagcagatgcaatcattgcgaggtgatcgtatcggtatgattttccaagagccgatgacatctcttaacccatttatgcgaattggggaacaggttgccgaagcggtgagtacccataatccattgctgagcaaacagcaggctcacgaaaaagcattggcgatgttacagaaagtaaaaatcccggacgctgagaaaaaaatggtctgctatcctcacgagttttcaggcggacagttgcaacgcataatgattgcaatggcaattatcaatgaaccagatttattgattgcagacgaaccaacaaccgcccttgatgtcactacgcaagcggaaattttagacttaatgcacgatctacaagcggatatgggaatggcgatcattctgatttctcacgacctccgtttagtacataaatatagtgacgatgtatgtgtaatgcaaaatggcgaaatcattgagcgagggaacacagaagaggtctttaaaaatcctcagcacccttacaccattgaattgctaacgccgatcccaagtgatctaaaacatcaagtcgcagaaaatgccccacaactgatcactgcagagaatgtggatatagattacattttaaaacgcaatctatttggcaaaccgaccaaagtgtttaacgccgtgaaaaatatctccctagagctaaaagtaggcgaaactttagggatcgtgggcgagtcggggtcgggcaaatcgacactcgggcgagcgattatgcagatcttagcctatcgaggaaaaattgcctttgcagatcaagagatcgccgcattatctaacgaacagcgtcaagccttgaagaaagatatgcaaatggtattccaagatccgtttaactcactctctccacgcttgacggtgggggagatcatcggcgagggcttgtctgtgcattacccacaaatgagcaaagaagagcgtcgccaaaaagtgatgaaaaccttggaagaagttaatctttcgccatcaatgatcaaccgttatccccacgagttttcaggcggacaacgccaacggattgcgattgccagagcgattattcttgagccaaaattcgtcttacttgatgagccaacctcagcccttgaccgttcaacacaattaacggtggtagaattactgaataatctccaacgcaaatatggcttaagctacatttttatcagccacgatttagcggtggtaagagcattgagtaacagagtaattgtgatgagcaaaggggaagtggtagagcagggcgaagccaaacagatcttcgagcaaccaaaagacgagtacaccaagcggttaattgaagcatcgaatttgtaaatcagcaaggcatagtagaacaggggaatttatctttttctactatgccccaagttttaggcaactgtattaacaaatgccattcttaatattctcaagctcttcccaacgctcaaacgcttgctctaacgccatttccgtatccgctaatttttgtaactgagcttgagtatagctcggatctttagcaaagaaatccgcactattcacttcggcttgtaaggcttcaatttctgcttcaagctgttccattttttcaggcagggcttctaactctcgttgttctttataagaaagtttgaccttctttccctccccctgcttgcggggggaggtgtccgcaggacggaggggagcattctcgctttctacaagcggtgctttctcaacgtttttttgcaaagctccactaccctccccctgtttacggggggaggtgtccgaaggacggtagggggcttttgaggcaaaataattctcctgttgttgcttcgcatcgtgatagccaccaatatatttattcacaaccccttcgccttcaaagatgtagcattccgttgcggtattgtcgataaattgacggtcgtggctgacaataatcaaagtgccttgataatccgccaacatctcttccagtagctctagggtttctacatcaaggtcgttggtgggttcgtccaaaatcagtaggttatttggttttagcaataatttagctaataacaagcggttacgttcaccgcccgataaggctttgactggggtcatcgcccgttttggtggaaataagaaatcttgtaaataaccaagcacgtggcgttttaccccattgacttcaatatcttgtttgccgtccgccacgttatccattaccgttttttcaggatcaagctctgcacggtattgatcgaaatacgccacttctaacttagtgccacaacgcactgtccctgcggttggctgaatttcgccaagcaatagtttaattaaggtggttttaccaattccgtttgcaccgataaaagcaattttatcgccacgcaaaatcgtagtgctgaagtttttcagcaaggttttacctgccacttcgtagctggcattttccacttcaaacacaattttgcctgaacgagcggtctgatcgagctgaatttttaccgtgccttgtacttctcgacgtgctttacgctcttctcgcaaggctttcaaggctcgcacacgcccttcattacgggtgcgacgagctttaatcccttgacggatccaaacttcttcttgggctaattttttatcaaacagctcattttgtaaggcttctacacgcagatcttcggctttggtttcaaggtaaacatcgtaattactaggataggaaaccagtttgccccgatctaaatcgacaatgcgagttgccattttgcgaataaaagcacggtcgtgagagatgaaaataatactgcctttaaactctaataacagattttctaaccaagcaatcgtgtccacatctaaatggttggtcggttcgtccaacagcaacacatcaggatccgccaccaacgcacgtgccaacgccgcacggcgaacccaaccgcccgacagctagcacaatcgtttttctggatcaagctctaacagcttcaaggtatcttgaatacgattttcaaactgccaaccgttagcgtgttccagttgagcctgaacttgcgaaagttgcgacatcagcgtatcgctgtaatcggtcagcatttgttgcgaaatgtggtgatattgctttaaaagatcggctaaatgagcgatcccttctgcgacataatcaaacacagtatcttcaatatgttggggcggatcttgttctaaacgggtgacaacaatatctttttcaaaaatcaatttgccatcgtctaactgaacttcgccagccagcactttcattaaggtcgatttgcctgccccgtttcgtccgacaagacagacacgttcgccctgttcaatatgtaattcggtgtgatcaagtagtggatgatcgccaaagcctaagtaggcgttagaaaggttaattaaagccatagaatatctgttgaaataaaaatttcgcaaattttagcagttttcctaccgcttgtaagtgatttaataaagtgaagtaatgaaagtataaaagtggtttgagattgcattaaacttagtgagattgtactgatttgggaggtaatggaaagagaagctattactgcccataggtaatactgttctttttgtgtatgaagtttattacaaagtttgctacaatccattcccatcatagatacggaggcaaaatgcaagttgttacaaagctcatacctaccaaactgatttccagtaaatctacacaaaacacacgttcagcaaatcaaaatattgaacgcagtgagcttttaaaaaaacttgccgatgttccgcactaccctttaactgtcgtgattgcccctgctggctatggcaaaacgacattaatttcccaatggaaagaacgcttattagcgaaaaatgagcaagtcgcttggtttgctttagatgaaagcgataataacgctgaacagttttgtcactatttttcatcggcattaaccaaagccacaggcatttcactgcaagggatcacctataaaaataacttggtggattattttggacagctcttggtcttactggataatgttccccgtcggttttatctgattattgacgattaccacctgattgataatcccgaaatccacgatgccctgcgtttttggttgaaacatcaacctgatacaatgagcctagtgctactttctcgccttacgccaccattaagcattaccaacttgcgtattcacgaaaaactgctcgaaattgacgtgcatcagctagcctttaccccagcagaaacccgtcaattttttgaacaaaaactcaatgaaacattgagtgacgaagtgatttttgcgttatgtgaacgtgtggaaggctgggcaacggcattgcaactgatgatctttgccattaaacaaaatgcagaactgttacatttccctgaaaaattactgaccaagctcaatcagcaacatatcgctgactatcttaacgaagaagtttttcattatgtcgatcctgacatcaaacgctttatgcaacgttgtgcggttttacgttcaatgaatgaaaagttggttgtagctcttactcaagatgaaaatggggtcaagcggttagatgagctagaaaaattgggattgttcatcacacgaatgacccacgatgatgacgaaatctggtggaaatttcacccgattttagctgcctatctctcacaaagttgtcgcttggaattaccaaatgaatggcaacagctacaccaaactgccgcaatgatgtggctaaaactgggctatggctcagaagctctctaccacgctcaaatgctagaagatccacaaacgctctaccaaatactgcaagaacagggctgggcattattccatcaagggcaactcaaattattggaagactgtttaagccacttgccatcagaacagatatggcaaaatgaaaatcttgttctactcaaagcgtggttagcacaaagtcagcaccgtcaccaagaagtaagcggtattttgcaaaaattccaaccaaagttaccgcttactgagagtttgcaagggcgttttcacgcattaaaagcccaagtggcaatcaatgcaggggacgaagaacaagcctatttaattgccaaccaagccttagctaatttgtctgatgaatttgattatgcccaaattgtggcgaaatccgtgattggtgaagctcaacattgtcgtggttatctcaaagaaagtttagccttaatgcaacaagttgaaaaaatggcaaccagtcagcgagcgtatcaccactggctttggtctaaactacaacagtctgaaatcctatcggcacaaggcttttggcaatctgcctatgatttattaaaagaaactaccttacaaaccaaagaatttcatcaaattccgatgaatgaatttttgctacgcttaaaagggcaaattttatgggaatggcaccatcttgaccaagctgaagcaatggcaaatgctggtattgaagtgttagaaaaggaagaagaacgtattcaaagccttgccttattagccaaaatttccctaaccaaaggggatttaaacaacgcagaacgtctaattgagcagtgccgaatgctactggctcgttgttcaccccataaagactgggtaacagcacttgatgaaatccagctgatctattggcaaatgcggaatgaaactcgctatttagaaggctggctggctcaagccaatttccctagccaagagcataaccactttacccaacgccaatggcgaaatatcgcccgttgttacctgctacaagaagattacgaacaagcattgcgtattctcaacagtttactgcgtaccacagcgatttttaatttagtgagcgatagccaacgtgcattaattttgcgtaatcgagtttacactttacaaggcaagcctgatttagctcaaagagatctcattcaagccctaaatttaagccaacagaccaactttatcagtgcatttgtgattgaaggcgaaataatggcacaacaaattcgccagctactgcaacttaatgtattagaagaactttctacccataaagcccaatttattttgcgtagtattaaccagcataaccgccataaaacagcacattttgatgaagagtttgtcaaaaacttacttgctaacccacaagtgccagaactgctcaaaatcagtccgcttactcaacgagaatggcaagtgctagggttaatttattcaggttacagcaacgaacagatctctcaagaactggttgttgcaatgaccaccatcaaaacccatatacgcaatctctaccagaaaatcggcgtggcaaatcgtgctgaggcgattgaatatactcgcagtttgttgcgaatgatggggtatatctagataaagtagaaaatcaacaatcaatttagaatctattcttcatatatatttctttttatttaagttgttttagtgtaaagtttggatgtatatgaatgtggatattattttatacaataatattttctattaatctaattaatgtttattggtaaatcactattatgattttttcaaatgtgatttgatataagagagaaatataatggctaatttgtcccctgatgaagcaattgagcttgcatatgatatttttttagaaatggcttcagataatttagagcctgcagatattttactttttaatttgcaatttgaagaacgtggagcggtggaaatggttgaaactagtgaaaattgggagcaagaaatcggtgttttaattgatccagatgcttttgctgaagtttggattggtttgataaatcagaatgatgagatggatgatatttttgcacgttttttaatttccaatgatgctgagaatagagaatatcatgtaatttggaagagttagaggatgtaattgaggggacggagccaaggtaaccattaatttattttagtctaatctttttaatccagatataataaaggcagcttttgagaagctgcctttatagtcattatttttcgatctcttgtggcaacgccaacaccgtttctacaggtttcgcttcgacattaacctctttcagatcttcttgttttaatctattcgctaattcgacatcgtgggtctgttctgcgacatacagtgccataatgcgatcttttgccacgcactctttatgctcaagcagttgcacaaagtaaggtttcgctttgtcgaaattccctgctctggtgtggatgtaacccaatactcgtgcgtaatcgtcactgtaacgttcttccgctttgctgttgcgttttaagagaactttgaatagtttatgctcttcatcaacttgtaagcgtgttagttccggatagagtaacgcaagctgttcatcttgatattttttcacggtttcaagggcaatttcttgagcagactgatgatcgtctgtgtcaattaagcgtttaatcaagccaacacgaacgtaaatagaacgacggcggcggcttggttggttatcccaccattttaataagccctcttgaccttcttcattcataatttcatctaataagccgtcattgacttgctgttcaagtctttcgtactcttctgccgataagaaactacgttgtccgatttgttctaatacatcatcaagtgctttgtaagccttcgatttttggtagatttcaatcgctaggcgtaaggcttcaacgttgtttggtgcaagctctaataagctatcgactgcactgcgtgccgcagggagtttgccttgtagcagtaaaattcgtgtgcgagcaatttcaacggcaacgttgtttggccctgcgattttagcagcttcaattaaatacttgttcgcattgagttcatcgcctcgttgttgagcagcttcggcagctttgatgaagtttaacactggctcggcggcgtgttttgcattttttgcaattaatctctccgctttagagtaatccccttcggtcattttcattaagccttcgagggtttgctgttgtgcttttttacgtttgcgatcgccaaaccattgataagcacctcggcttaacccgaagaaacggcggaaaatccactctattgcataaaccaccgccattgccaccgcaaaaaagaccacgagcattacgaggctcatttcaatcactttgcctgcggtttcaatgcgtacataaccttgatgccccgaaatataaggccctaaaattaagcctgcaaggacaattagcattaaaaagagaacgcgaaacataatctatctcctattgttgctctgtagcaggttttgcttcggttggtgcttcttgagctggtgttgcttgctcaagggatttgtcttgttccaactgaattttgctaatcggtttaggagctttattgagcagttgatctaataaacctaaactgtgcaggcgatttggtgcgtcaatgtagatagattgttcaatcatctcgtcaatttcttttaagaaggttttgacttgttcattttgcacatcaaagtaacttctcacccaagtgctaactgcctcaagcgattgtttatagagttcattttgctgacgtggaattgccaaaatcgcaatttgtaaacgcaagcggatattttctcgtaagtaaatctcttgatttggtgcaacaaaagctttctcttttgccgtcgctttatcgctgatacggataaagtgatttaagaaagagtttgcacttttttctaggttttgttgccagtcttgcactgagttactcacttcgccggtggcaacactttcttcttccaccgtgttgtcgatcatcggcatatcatcaagcaaattcgctaattgcgttaatcgttgcattaaattattttgatcaacattgtttacactagcaagttggctgaggtcttgtttaatcgcttcacgaatgttaagaactcgattatcgctcacttggcttaatacgttatccgcttcaataagcaagctacgagctgtatcaatatcgttatctaacactactttgcgtaaggcattgttaagtaagaaatcagcgtcagataatagccattcactttggtctgcttttggtgtcgcccctaatttttgaatttggctttgtagggcgttgatttgctgagtataagccgtttgtacattctctaactgtgcaattttatctaatgattgttgataatcttgagtaagtttggcaattttgactttttcttcatcaaagttagggatttcagcaactgtttgttcggggtgattttgggttgcttttgcttgtaatgcttgaatttgtgtatcaagttgagcaaatttttggttgccgaagaaataccctgttgcccccacgcctaaggcaatcaagatagccagcagagagagtgcttttccccctgatgattgttttggttgttctgattgaataggttgagcaatttccacttgtttttcctcttcttcagtttttggatcaatagcggtgacttcctctgtctcttttaccatttctggctcagagactaccgcttgttctacatcgactttcacatcttcagtcacgactggctcaaggttttctgcaacgttttttgttgcttcaaccgcttttggctttttgctctgtttcgacataatgttcacctattttagttaaaatttcccacagttgagtattgtttccagcagactatgattatccgctttcattgaaatttgaatttgttcgcttttccagcctgattttcgggcaagtgtggcgatacgtttgccaaccacaattaaacgacattggtagagccaaggcagatccgcttctgcggtctgttcgataaacgtggttaaaatctcaccgcttgtcacgacaatggtatctgttcctgctcgttttgcgaggcttatctgttcgcttaaattatccgccaacattatacggcgataacattcgaggatctgcacttcagcacctcgtgaagttgcctgttcagcaaaaaattctcgccctgtatctgcgcgtaaaatcagcacattttttccagacaactgagccatttcaggcagtgccagtagcccttcactgttttctgattgaatagggtaacgtaccgcttgttcaatttgggaagcgaaatggtttgccgaacgttgtccaacggcaaaatagagtaaatcacttcgccagtgaaatcccgtttgctttaaggtttcagttgcaaaatcaacagcattttttgacacggcaaaaacataatcccccgaatttaaacgagataaactgcttggcaaagtcggtaaatccgcccctgcttcaacttgaaacagcggttgatgaatggcaaaaatttgctgttctgccaacatttcaactaattgttgccctcgttgatcgggacgtgtaactaaaacattcatactattcgctttgataaacggtttttaaaatgtgatcagccccttttgcaagtaacgcttctgccacttcaacacctaatttctctgcctcttttatgttgccttttgctgacgctcttacaatggttgaaccgtctaacgaaccgacgagggcatttaattcaatttcatcacctgttaatgttgcaaaaccgccgataggcacttggcaaccgccttgtaaacggctgttcattgctcgctctgcttgtacacagtaagcggtcggttggtgatttaattctgcaagataggctaacactcgctcgtcattcaaacgggtttcaatcccaactgccccttgcccacaggctggcagtgatgtttctacagggataaaggtgcggatacgttcgcttaagcctaagcggattaagcctgctgaagctaaaataatcgcatcatattcaccattatctaatttgctcaggcgagttccgacgttgcctcgtaaggatttgatctgtaaatgcggatattttgccattagctgacattgacggcgtaggcttgatgtccccacaacagcccctgctggtaaggcttcaaggtttgcatagtgattagatacaaacgcatctcttggatcttcacgctcacaaatgaccgcaagccctagcccttcaggaaaagtcatcggtacatctttcattgaatggacggcaatatctgctcggttttcgagtaaggctaactctaactctttgacaaataagccctttccaccgatttttgctaacggtgtatctaaaatgatgtcgccttttgttaccattgtaaccagctcgactgataattgtggaaaacgctgttctaatgcgtctttaacgaaatttgcctgccaaagtgctagaggactttgacgagtagcaatgcgtaaaatctctttcattcgtttacttttctttaaataaagatagccgttatcctaccactatttgccctttcttgccaaaaaaattgaacagtgatcttgacgacaataaaagaaacattaaaattcgcaacgctttaaaaaagcagttcggatgaagatagctggagagtggggaataaccctacaccgacgaggtaaaatctttcaggtgcgacagcgaggacagctattggacgaacccttggagagatccactctgcatagcagaaaatggacgccgaaggcgaaagcaatgaatgcgaaacgctcaggcaaaaggacaggggagaaaagtaaccatcatttcaagcggtgggattatatttattgcttttgtgtgaaacagcatggggtccctacagaatgcaaaaaattcatcacatcattccgcttgtcttattgcttttctttccttgtaagttatttttacgaggaattatttatgtcaattgacactattcttagctcaattaatagtatcgtttggggaccaccactgttgttattgatttcaggtgtggggatctatttcacccttaaactcaagttactgcaatttttccacttacctcgagccttttcttatatgttcaaatcagaaaaaggcgataatcaatcaggggatatttctgcctttggagcattagccactgcacttgccgccactatcggcacaggtaatatcgtcggggtcgccaccgctattcaagctggagggccaggagcggtattttggatgtggatcattgccctgtttggtatggcaactaaatatgccgaatgtttattggcggtgaaattcagaggcaaagataaagacggctatattgctggcgggccgatgtactatatcgaaatgggtatgggacaaaaatggaaatggctggcaaaactgtttgcgatatttggggtaatggtcgctctctttggtattggcactttccctcaagtcaatggaattaccacatcattgcaagatactttcaacattccgattagcattaccgccgttatcttaacgcttaccgttgcggcaattacgctcggcggtgtaaaacgtatctcaaaaatttcaatggtgatcgtgccttttatggcggttagctatgttggggcttccctgctgattttagtgcttcacgccgataaggtgccagacaccattgtctttatcgtaaaagcagcttttaacccagaagccgcattgggtggtgtaattggctttactgtcttacaagctattcaagctggggttgctcgtgggattttctctaacgagtcgggcttaggctctgcacctattgccgcagcggctgcacatactaaagagcctgttcgtcaagggttgatctcaatgactggcacattccttgataccattattgtctgttcaatgacaggcttagtgattgtattaactggggtatggacaggtccaacacaaggggcagttttaactaacttagccttctcagaaggtttagcaagctctatcggagcaatgattgtcaccatcagccttgtattttttgcattcaccacaattttaggctggtgttactacggcgaacgttgtttagtctatctgacaggcggacgcaccaaaggaattaaattctaccgcttgatcttcattatgctgattgccgttgcaccatttatcaagctcaatacgatttggacaatggcagatattgtaaacggcttaatggcattccctaacttagtcgctttgatcggcttacgccacgttgtgattgaagaaaccagaagttattttgagagattgaagaaggggggagtagttatgatagattttaaatatctataggaatttaaagtcttatgtgaaacgggctgtattaagggaatacagcccgtttattataatctaatcaattagtttacgcttttgcctgcgcacgtttacctaaaatcaccgtaatcacaaacgcaatacttgccgaaattgccataccaacacagtacatcgcaaggctttcaggtttaattgatggaatacctggtaaacctgctgcacctaatgcgattgcttttacattgaatagtgcgataaatgcacttgatgtacccgctgcaatcattgctgcgataaatggataacggtaacgtaagttcacaccgaacattgctggctctgtgatacctaataatgctgagatacctgatggaacagccataccacgcactttcgcatctttcatcacgaatgcggcacctaaacacgctgcgccttgagcaatgttagacattgcagcgatagggaagataaatgtaccgccagtgttcgccacttctgctaataattgtgtttctaccgcaataaaggtttggtgcataccagtgataacgattggtgcgtagaatgtaccgaagatcgcaccgcctacaaagcctaagctatcgtataaccaagttaaacctgcagagattaatgaacctgcttcacgacctaatggaccaatgatagtgaacgctaagaaacctgcaatgaataatgagaataacggcgtgattaagttatccaagaatgaaggaacaactttgcggaagcctttctctaaagttgctaatacccacgcagaaactaaagtagggataacagtaccttgataacctactttctcaatttctaaaccaagtacattccagtactggattttgccatttgcaagggttaatgcatagttccaaccgtctgccaatgcagggtgaactaataacatacccagtgcagcccctaagaatgggttaccaccgaatttacgggttgcagagaaacctaaaagaactggcaagaacacgaatggtgcatttgcgaaagtgttcattaagtccactaaatctgcaatacctgggtacatatcaacaacgttcacaccttctgcaaagaagccttttgcagtaagcattgagtgaatacccattaacaaaccgcctgcgacgatagctggaatgataggtacgaaaatatccgctaaaccttttacaacgctttgtaagaaaccttgtttgtctgcagcagcactagcaacttcagatgtggtcatatcaccaatacctaatgctttggttaattcagcgtgaactttatttactatgccagaaccaaaaataatttggtattgacctgcaaccgagaactgacctttaacgccttcaatgttctcaatgccttctttatcgattaaagtttcatctttaaccaccatacgcaaacgggttgcacagtgtgctgcggcagagatgttatctttgtccccgagtttatcaatcacttgttgagcgatttgaggaaagttcatagttaccacctattttttgtgtatagaaatactaaaaattaaacagtgatattttaactaaaacggtttagctaagaaagtaaattttgctaaaacgttttagttttgtaatctagatcacatttttagcaagtttagctattatgagaataatgcgtctgatagcatatgaaggatttgttataattgaacattctcagtgttacaaattagagagaacaaatatattttttaggaaatatggaacttatttttaaaatgcttctctaatttatgcagaagttaattctattttcttatagaacaggagaaacaatgaaaaaatcattattaagttacagtttatcgttaatcttaggcttaggagcgatggcttccttgcctgtttttgcaaattctgcaacccaacctaccgctatcacaaatactcaacagcagttaggctttgaactaatcaaaacaaccattaataaaagcccaacggataaagctatctatcaaggtattcgccttgcgaatggaatggacgtgttactgatttcagatgacaaagcaaataaatcgctaatgtctgtcggcttgcctgtcggttcaatggacgacccagttaagcaacaaggtttggctcactatttagaacatatgattttgatggggtcaaaagccttccctgaaaccaacagcttagatggctttttaacgaaaaacgggggctacaataatgcctttactgcgtcagatcgtaccgtttattatcttgaagtaaataacaacgcctttgatgaagcggtggctcgccttgccgatgcttttgctcaaccgttgttatctgagacgaatgctaaaaaagaagtgaatgcggttaatgcggagatggtgcgagcaaaatccaacgatggctttttaatgcacgatgttaatcttgctaccgctaacccgaaccacccgattaccaagtttgccgttgggaataaggtcacgctatctgataaagctgatagtaagctacaagatgaattagtgaaattttatcaacaatactattccgcaaacttaatgaaagcggtgctttattctaatcaaccgattgaaaaactggcaaaacttgcagaacagactttaggtaaggttgaaaataaaaagctcaccgcgccgacggtggatatgccatttttccgtgcagaagataaagcggtgatgatccattataaaccggtgaaaccaagcaagatgttggcgatttcctttgatatgcctgaagataaagctcagtttaagcataaaacaggggcgtatctcgcttatgtgttcaataataataccgatggcacactgtctgattatttgattaagcaaggactgtctgacagcggtgttcaatcggtagcgaatcatgatgttagtcgcaaccgtggtgattttaccttttatattgaattgactgacaaaggcttagcagaacaagacaaaattatctcgttggttttccagcaaattgaagcggtcaaaaaagcaggtattcaacagagctattttgatgaattaaaagagagcttaagccaagagtttcaacatctgcagacggaaaaaagtggcaactatgtcgccgatttggtgagccaaatgatgagttatccgctcgaaaatatcatcgaccagccttatgctattgaacaaatggatacgcaagcgatcaatgcaaaacttgctgagatgacattagctaacgtgcgtattttgctcgttgatgataaagcgaaaaccgataaaaaaaccaaatattttgaagccccttatgccgtacataaaatcagtgagcaacaaaaggcaaaatggcttgattttagccaaaatcctgagcttaaattgccagcgttgaacccgtatttcgcaacggatttcagcctaaatgaaagtgataaatctcgcttaaaaccgcaactgattgaagcagagcaaggcacgcaaatctatgcaatgccaagccattattttgctaacgaaccgaaagcgaaaatctcgttagtgctaggtattacgccaaaagtggaagatcttaaacaagccgtcagtgcagtgttgctgggctatatgggcgatttagtccaaagcaaaattgatttccaagcctctattgcaggaatgagtgcgagtgtatcaatggcagaaaatggcgttgtattacaagcggatggttacacccaaaatttagcaaaattgctgaaagataaaatggtgttattccaacaatttacgttaagtgaagataccctagctcaagcaaaacagcgttatcttgaagccttagatcgtgcagaaaaagagaatgctttacgccaagcaaatgaggtaattactcgtttctccagttatccctattttgaaatggcaaaacaacgagcaatgatcgagcaggtcagcttggcggatattcagcaaatgcgtgaaaaattgctgaacaaagcgacatcattacgcgttcttgcggtaggaaatctttcagataaccaagtgaaacagattgcaacagaagtcgaaacggtctttaacaatcaaaatagccagattgatttaggacgttatctcgacattaatcagagccaacgcaagctaaatcatattaaacagatttctcacgaagataacgccttaacaatcgcctatttcccaaaaggttatgatgagttacagggattaagccgtgccagtttattaaaagatattctctcacgttggtattttgatgatctgcgtacagataaacagctaggttatgtggtttatgcctataacacccgtatcggcactacatcaggcttgcaattttcggtacaaagcccgaccgcttcaccaaaagagataatgcaacataatgaacgcttcttcaaagaaagtttggctaaactcaacgcaatgagtgccgaagagtttgaaaaatatcgagcaagcctacttgaagtgttacaacataagccagagtccttagatcaagaatttgctgaatttgtcaccgatttttcacgaggcaacgggcagtttgaccgtaaggcaaaagtgattgaattgattaaacagctcactaaacaagatattcttgatttctatcagcaggccattatcgaccaaacaggttttgtttttgccagccaagccgttggtaaaaatccgaaaattagccaagtcgcagaactaaaaggctttgagaaggttgagagtgtggaagcattgcagaaggggtttgagattaagcggtattagtgttttgtaagcctttaatggcacatgtttgattaagtaaaacatgtgccattgtaagataggtatagttatcaaagtgttgggaagaaggaaattttctttacaacgagcccattttaatattattacggatactactctttaattaaaaggatttatataactgtcgagtatgttctaatagcttacggcgtgaaaagaaaaattgccaacggctaccgcccatttgttgccacaaaatccctgcacggatacctgccaataacgacgctctcactcgattttgaatatcagggcgagagagataatcgtgcatacccaaaacgtgaatgcgagaacctagagggctgataatatcgctataaatactcgcaatatttgcaatcatctgttcgtgcaaaatatcgttatcatagagagcaagctggcgttcaagttgttgcaaacgttgtgctaaattcgcttttgcttggggatttttagctaacttttggcttaatgctaatatgctgatccaatagcgaccaatttctgtgtcgagcttgccattcgccccaccaaattgagccaatgcggtttctaacccttgcttcaaatgggctaaatcgcccccaaaaacatcaagtgttgagtcaggttgggtaataagtaagctagaaagagagtgtctaaatgcatcacgatccgcaaagcctttatgtgcaaattgttgaacaaggcttgcagactggcatacgccagctaatgcgatggaaatatcttgatagtgagccattttcttgaaaaaatttacaaaattagctgggaatatagcattttttcattaagttttgaacgcttttattttattgcattttccccttgtatttcctaaatctacccccataatgtacaaattctattttaggagagcaatccaatggcaagaaaaaagaaacctattgaattaccattacttccactgcgtgatgtggttgtgtttccttatatggtaatgccgttatttgttggacgtgaaaagtcagtccaagccttgcgtgcagcgatggataccaacaaacaactgtttttagtgacacaaaaagatccaaacaaagaagatcctacggcagaagatatttatgatgtcggggtgatggcgaatattatccaaatgttaaatcttccagatggcacggtgaaagtgctggtggaaggtcaagtgcgtggcaaaattgagcatattcgtgatgatgaaagtggtttttgggctggcgtttccccgatgccttctgattatcaagatgataacgaagagttaaaagcgattgccaaaactgcactcaacgaatttgaaaattacgttaaaagcaataaaaaagtccctgcagaaattttgccgaaattgcaaaaaattacctttgaagaccgcttggcagatacgatgtctgcaaatttgattgcttcggtaaaacaaaaacaggcgttgttggaagagcctaatcttattgctcgttttgaagctttgttgttagcgatggcaacggaaatggatacaatggaaaccgaaagccgtatccgtaaccgtgtaaaacagcagatggaaaaaaatcagcgtgattattatttgaatgagcaaattaaggcaattcgtaaagagctgggtggcgaagaagaagcggaacagagtgaattagataagctcaaagagaaaattgctgaagcaaaattaccaaaagaagtgcaagaaaaggtggatagcgagtttaataagctgaaagcaatgccacaaagttctgctgaagcgacagttgtgcgtagctatatcgactggattttacaaatgccgtggcataagcggtctgttgtgaagaaagatttgcaaaaagctcaagaagtgttggataaagatcactacggattagagcgtgttaaagaacgtattttggaataccttgcggtacaaagccgtttgaacaagctcaaaggtccgatcctttgcttagttgggccaccaggcgtggggaaaacgtcacttggtcagtcgattgccaatgcgacaggcagaaaatatgtgcgtatggcattaggtggcgtgcgtgatgaagcggaaattcgtggtcatcgccgtacttacatcggttcaatgccgggacagttgatgatgaaaatggcaaaagttggcgtgaagaacccgcttttcttactcgatgaaatcgacaaaatggcacaagatatgcgtggcgatcctgcgtctgcactgcttgaagtacttgatcctgaacagaataaagcctttaacgatcactatttagaagtcgattacgatctatctgatgtgatgttcgtggcgacatcaaactcaatgcacattccacctgcattgttagaccgtatggaagttattcgcctttcgggttatacggaagatgaaaaaatgcacattgctaaagagcatttgattgcgaaacagcaagagaataacggcttgaaagctggtgaacttgtgattgatgatagtgcgattttgggcattattcgttactacacccgtgaagcaggtgtgcgtagccttgaacgtgagattgcgaaaatctgtcgtaaagcggtaaaagcgttagtgatggataagaaacttaaatcgatcaccgttagccaagaaaacttaaaagattacttgggcgtacagcgttttgattacggcaaaatggatagccagaaccgtatcggcgaagtgacaggtttggcgtggacggaagttggcggtgatctattgacgattgaaacctcttctgtggctggtaaagggaagttctcttacacaggttctcttggtgatgtaatgaaagagtccattcaagcggcaatgatggtcgtgcgtgcaagagctgaaaaattaggtattgcgagcgatttccacgaaaaacgtgatattcacgttcacgttcctgaaggtgcaacgccgaaagatggcccaagtgcaggtattgcaatgtgtactgcattaatctctagcttaacgggcaatccagtgcgtgcagatgtggcaatgacaggtgaaattactttgcgtggtaaagtcttgccaatcggtggcttaaaagagaaattgttggcagcacatcgtggtggtattaagacagtgattattccaaaagagaatgaaaaagacttggaagaaatccctgaaaatgcaaaacaagccttagaaattcacgctgttgaaaccattgatgaagtactggcgattgcgttgcaaaatccacctgaaggggttgaggttgtgtcaaaatctattctaccaattaaagtgaagaaaacaaagactcgtccggctatgcaataaatagttgatactagctaaggtgactatgcctcattatttagagtgtaatagacaaattttctgctaaaaatggtttaaagccttgtactatacggtattataggctttaagccgttttttagcagtcattttgtaaactatgccaaacaatttcaaaattagaaaatcgctctacgcaaaatttgaatttctactatctaaataatcttatttactaaaaacgtcaaaacttcataatgcgccgtatggggaaacatatcgaatagttggacttttttgagttcataatggctgagtgaggcaaaatcttttgccattgtttctgcattacaactggaataaatcaagtagggtgagccgagttgattgataaattcggctaacggttttccgattccccgccttggtggattgacgatcacaagatcgggctttgttccttgttcattcaaggcaaattgagccgagtccaacgaagcgaatttgacattttgtaagccaagttgttgggcggattttgtggcactggcgatggcagaggcagaaatctcaatgcctgtaagtgcgacattcggattattggcttgtaatgtgtgggcacaatgtagcccaaagcccccaacaccgcagaacagatcccatagttgcgtaatcggcaatgcttttatccacgcttgagcagtgtgataaagttggctggcgacagttggattggtttggaaaaatccttgcggacgaataaatagtggaatttgattaaagcgttcttctaacacttgctgttctgtcagaaaaatctcttgttcaccttccaaaatggcggaatgttgcggttgtatattcaaactcaccaccgatttttcaggcagttgagccagtaacatcggcaattcacgctcaacaagcggtcgttttagctcacttcttaacacaaagcggatcatcaaagattgattatgctgactttgggtaatcaagatgtatttgagttcgccccgtttttttgccacgttgtaaggtacaagcccagcccgtccgataaaggttttcagaataggaaaaagtgacgtaaaggcttgcggatagagcggacagtctgttaaatcctcttcatttaaaatccctaaaatcgggcgttcaacactgcctgtgactaccattttggctttgttacgaaaatgtgccaacggcgatgtaaccgccggtaaaaattcggtactttgcaaaagataaggcgaaactaaccgcttgagatcagcggttttctctgctagctgttcggtgtagcttttattaagccattggcacgaattgcaacggttctgttcaaaatggtggcagttgagtttaggcattttgggctttccattccaaccattgatcttgaagtgtagcaagttgttgatgagcctgttgccaacgtgggctggcggtcaattccgaccagctaatttgcttccgtttcattaggcttaagtagcgttctttctgtgttggggtaggttgatatttcaaattatctaacacttgcaccacaccgtcaggctcattgcagagtagtaataaatcacaacctgcttgtaaggctttctcgcttcgttccacatagttccccataaaaccagcccctttcattcctaaatcatcagagaagatcacgccattaaattgtaactgtttgcgtaaaatcttttttagccagtaacttgaaccactggcaggttggctgtcacattgggtgtaaataacgtgagcaggcataatcgccgataattttcctttggcgatcagctgtttaaacggctgaatgtcgtgattgaagatcgtttcttttgggcgatcatcaaagggcgtttcaagatgagagtcggcaataacgtgaccgtgacctgggaaatgtttgcctgtggctgccataccgatttctcgcataccgtcaataaaggcttcagcgacaggtagcattgtggctatatcttccccaaacgagcgatcgccgattgccttgctacaatgcccgagatccaacacaggggcaaaacttaaatcaatatctaatgcaaacatttctgcggacattagccagccagcttcttgggctagttgcaagcggtctaattgtaaaaaagattgcattgcaggcaatttggtaaatccttcacggaaacgttgcactcgaccgccttcttgatcgacggtgattaataatggctttttcactcgttggcggacagatttaactagagcttgtaattgggctttatcgtgaaaattgcgtgtaaagagaataagtcctgaaaccagtgggtgttcgagtaactcttgttcttcttgagtaagttcgtagccagcaagatcgataagtagcatgataaacctttgtaaaaattattatttttcttttaagaaagtcagtacttttgccaaatcccttgtccgtttcgacggtggtaggcttttcaaaaaagtcgagccgtattgtcgcatcacaagacgagagtcacagataatcaccgcccccctgtccgttacatcgcggatcaaacgccccacaccttgttttaaggtaatcaccgcttcgggaatttgaatatcattaaacggatcgccaccttgcaacttacaatcttccattcgagctttcagcaatggttcatcgggtgcggtaaaaggcaatttgtcgataatcaccaacgacaacgcatcgccccgtacatcaatcccttcccagaaactttgcgttgctaccagtacactatttggctctgcaacaaacttctcaagcagacgacttttactggtttccccttgcaacagcacgctcaacgaactctgttctcgcaagaaatccgctaaaccacgcatcataaaataggacgtacaaagtaaaaaacaacgcccattattcgcttcaatcacaggtttgagcaactgccccaattctgtcagtgtatgggatttattcgtatcaggcagataacgtggcacacagagcaacgactgacgagcataatcaaacgggctttgcaacaccatctgttctgcattctcaatgcctagtcgctggcagaaatggtcgaactttccgccgacttcaagggttgctgaggtaaaaatccaaccaacttgatttgctctcatctgctcaccgaatttatcggcgaccgtcagtggcgtaatgtgcaagccgaaggaacgcccattgatttcataccaataacaatagccgacaacactagtatcgcccaatctttttaactgtgctttgacttcagccaaacgttcaaagattttatccaaggtttctgaacgaccgagcgattttttcaccacttcgcttaaaaaatcaatgttctcattcagcttagcaaagccttcgactactttcggatcttgcaaaatttcacgcaaattcccccgcttgttaccgtcccctagcaacaaacggaaatcctgcaccactttttgtagatgatcggacgctttacccaactgagcaagatctttcaactctgtacgataaacaatgttactgtctttgcaaatatcaaataattgacgagatgtcagcgattgcccaaagtactggctagcaatatcgggcaactgatgtgcttcatcaaaaataatcagctctgcatcagggattaactcaccaaagcctgtttctttcacagccatatcggcacaaaataggtgatggttcaccacaaccacatcagcttccaacgccttgcgtcgagcttgtaccacatagcactctttataattcgggcaatccgatcccaaacagctttctgctgtcgaaactaattgcggtaaaatcggactatcttcggcaatggtgatacattcgctcaaatcccctgtttttgttcccgtgtgccatttccgcaccttcgccaaatccgccaacaccgatttatcgccaaccacgcccattgcgatcacctgatctaaccgctctaaacagagataattagcacgcccttttaataacgccacttttcccttatatttcaaggctttttgaatggttggcaaatcacgattaaacaactgatcctgcagatttttggaacccgtagaaatgatcgtttttttgcccgatagcaacgctggcacaagataagcaaaagtttttcccgttcccgtccctgcttcaatcaccgcacttttggcaaatttcacggctcttccaaccgcttgtgccatttctaactgagcatctcgcggacgaaaaccgtgaatgttttggcttaacgtgccttcggggctaaaagcgtcggtgattttttcggatagtttcatttgaataagtaacgtaaagaatcttacatccatgtaagagatttaacgatagctgaagaatggaaaatacatcaataatctgtactcagaatattaaattaacactattttgtaccaaaaatcttatcgccagcgtcgcctaagcctgggataatatagccgttttcatttaaatggctatcaattgcagcggtatagagttcaatatcagggtgagcttcttcaagtgctttaataccttcaggtgcggcaacaagcactaacactttgatttgtttacagcctgcagcctttaaaagatcaagggtagcaatcatcgatccacctgttgctaacatcggatcaaccacaatcgctaaacgttcacctacatcgttagctaattttttgaagtaaggcacaggctctaaggtttcttcgttacggtagatacccacaacgctaattctcgcacttggaatatgctcaagtacgccgtccatcatacctaaacctgcacggagaataggcacaacggtcacttttttacctttaatacgttcaatttcaactggaccattccaaccttcaatggtaactacttccgtttccaaatctgaggtcgcttcgtaagttaaaaggctaccaacttccgttgctaaggcacggaaatctttagtgcttacatcagcggcacgcattaaaccaattttatgtttaataagcgggtgttttacttcaacaattttcatttttggtctccggttatgtttaaaaaaatcggactattctagcagaatttaacaaagaaagtttaatctagatcagataaaagttcccaaaatgcacgaatgattggttcttgcaaacggcgttgctgaacacaaacacctaactcaaatgcatcaatcggagtttctaattgaatatgggaaatctgatttgccacagggctttgttgaacaacaacatcggggatcatcgcaacaccacagcccaaggcaaccatcggcacaatcgcttcgtgtccttccactgtcgcataaattttaggctctttaattttttgcaatttaaaccaatgatctatccgcttgcgagcaggtccatcaacgggcaagataaaaggcatattctgccaatcaatcggtgttttctgtaacaattgcgttgcagtacaagcaatacgcggggcaactaacgataattgaatatcatcaatatagtgaaaaataatgttattgggtaagttttcaggcttccctgcaagagaaatatccgactgcaacgattgaacgctatacagcgctttagcaggatcgcctgtactcaatttgatctcaatcttaggatagcgttttctaaattttgctaaaatgcgtggtaagtggctgtaagaagctgttacagagcagaaaagtttaagctcgccttccaattcagtttgatctggagaaaaatgtcgttgaatttgttgccattccgcccaagtctgctccgcaaaatgtgaaaaacgttcacctgcttccgtcaaaatcacttgccgattatcccttaaaaacaacggctgcccaatctcttgttccatacgttgaatatggcgagaaagggtagaagcactcatatagtttttttctgcagtgcgaataaaactacgggtttgagtgatgtctaaaaaaagtttaagggattggaggtccatttatttatatttcaacatacaatgttatacaaatatacataaaaataatcattttctatgtcaaatacatatgtaatatttttcactatttaaattcaacagttcttctacgaattttttcaacaaatcttctaaattctttagctatactatttagtatatttttttctttctatactcaccaattttcttaaggcgaattgctctatcagtttcaagataacttggtaaggctgatacttcattattataaaatctttcttgaatgcacaaggcaggatttaattgaaaaacagttagttctttatttaagataaaataattaaataagagttcatcaatagcgtctaatgaatttggtggtaattgcttgattaactcaactgctttaactgcagctctcttagagattatatatccagcagctcctacatacgatctgtttaacttgaaaatctctctatctaatacagaatagcggggcgttcctttaattacttttttaggaaatgattctaattttataataaattcttttcttacatctaaatgctcaaaccagtcataattatttaaatatttattactattttcacctaagataatatcatcttcaaatatagtaaaataatcataattttcattaataccttttaataaaagcatataatggctcataaaacaggctttttctacttcagtaagcgaactttcttttaaattaggaagatagttatcgatatgctcattaagtatctcagatgggtataatgcatcaaagaatgcaaaatctatattatgtattttaaattcagaaataatatgctgtcttcttttttcagaatcttttaaactaatgacataattaaccattataatttccttcaatatgaattaactctatttgttattcaagtaattattaaaacttttccataatcatagaaataaggaagaactttaaaatatagcatacttgtaaataacatatttttatgctatcttagcataaagtttattttaacggaagagttttatggtaactaattatataattagtcttatatcagctgatataagacgctcacatattaataaagagttttcgtctaagaatattaaatttgaattttttgatgcatttcaaccactaggaaaagagaatataatagaaaatatattgccacaattaaataagaacactgttctcacagttggagagaaaggttgtctgataagccatttattactatggcaaaagtgtattgatgaagatatgccttacattagtatttttgaagatgatgttatcttaagtgaagatgcggaatattttctaaatgactattcttggatttcaggttctatgattaaacaagataattttatagtacgttttgaaacatttttgatgcctgtaatcagtgaaaaagctcaaaatatcgctcctattaatggtagaaatatatgtattcttaaatctaaacattatggtacggcaggatatattatttctaaaaatgcaattaattatttattaagattaattaaattcttggaagcagaagatattaagcctatagatcaaataatttttaatcaattgttatcagatcagaacttatttatatatcaattatctcctgctatttgtattcaagaactacaattgaataaagaagaaagctcattatatagtcaaattgaagaagatagagcaaaacgttttataactaagcctaaagaaaaaatgagtatattaggtaagattctaaaagaattagatagatataaaaatagagataaacgcaaaaaacagagaatagaagagatagagctagaaaatcagaaaagtattattccttttgaataacattaaacctcaagtcttttactataaggcttgaggtattctttttttgtgtgtttttgattagtatatcccaaattttattcgatctttaaaatcattttttaatttcttgaaaatttggcgataatcattctgagctaccttatttaaccaatgttgtggtttattattaattgaattaaatagcttaataaataattgagacttagtatgattgcatttactatgccaaggcttatcttcaccacaataatggaaaatagagattgggaaatttggtctttcttgatcactcaattgctgtttttttaatattcgatatctaaggtaaggttggaaattatatttggtgttaattatcttaaccttatttttaaaaataatattcaaaatatcctgatcttgaaattcaatatatggatattcttttatacatactatggctttagtatataaatcaaaattttttaacttattaagatctattaataatactccagcgttaaagtaactattagattcatcaaagcctatttttgctttataattatccaaaccatattcaacaaatgaatcaaaacaagccgcaatatgatatttatctagatttatattccataaatcaataatgctacctgctattaataagtctatatctagataaataactttatctacattctttacataatcagctatttttaatcttgcatatgtcgttttagagatatgtgaaattgtttggggaaattcactgaaatcatcttcatttataggaataaactctatagagcctctatgattatctactatgtttataatacattctttactttcactagatatacctaaatccaatacataaaaattcatcataattttatgatggtttagaatgcttaatatatttactgcaagatagggggaatatttttcatcgcaacaaaaaacaatattcatctataactcctattatatattacttatatatttatatggtctaagcattttttttattatcttaactttttgtttaaaagtaaaacatttggcattactagtaaaaatggttctgcatatggtgtatgaatctacttttgcagacataaagcaatcgaataatatttttttaagattttctatatctttataagttagtctattccaaacatctttttccagcaagagcttattaagtacactaaatttgatattatcaaaatctattatattaacgaagcctagattttccatatagtaggtaataatctctcgtctaattttttttgcagtatttatttgtgaggcattatgatttgatgatgtttgttctgaatgtaatctataataaactagagcttcaggataatttgccatctttcctaacttacttacttcaaaccagaatttataatcttcagcatgtatataattaagatcatatattaaaccatattttttatgtactaaacttttcataatcattgtattattatgaataggattatagaataacatatcattcttaatatgagcatctgttagtgcatttttccaaatatctcctgttttatagtatttacccagctttccattgacagatatgatttctagatagcaacccattgcaataattgtaggatcttccaacattttctctaaaatgtttttaatccaatcaggtttggctacatcatcagaatctattttagcaatatattctccttttatatgttgtatccctttatttaatgaagatatatatccaatgttcatttcattatttatgatactaattctattatcttgattagctaacttttctatgatatgttttgtattatctgtagaaccatcatttacaataactatttctaaattagtatatgtttgatttattacagagtttatacactgttcaatatatttttccgtattataagcacaaattaaaactgagactaaagggagatgcataagatcctctaaatataaatttcatttttgagaagctacactatctatcgtaggcacttctctcatttgagattggattatattattaaatttcaaggggatggtaaatcccgttttcaatgatttattaattttttcaattataaaaatctctcatatttaaattcataaaattagtaaagtttttacaaaaaatcatttaccatgatcccattattttacttgtaatcttatccttatattttatagatgaaaaaatcttattttttgattattacagctaattctcttcttaccacaaccctaaacacattcccaatccgatcgtcaataaattcaacattaggatactcttttaatactcttaatataccacttcctagccctctataaggaagtgctctaggagcgaaagaggcgagaattgggtttcgtatattggagttgcctcgttttatattttcaattgtaagattattcggcaaatgcccagggctaataatctcaatacgatcattaaatattaaaattcggattggagcagaaataaaataatctcgatgaatgatcgcattagcaattagttcttcgaacacaattcttggaatttcaggttctccaagagagttaaaactttgtccattttgtttgtgttgaatattcgttaagataaaacttatggcttggcgaaattgttccgtgatattacctcgaatatctttactatcaatatagtgttgttctgtaatatcatttcctaaaaatgaaacagcttttatgataaatgttggtaagtatctacttggatctttagtaaatagtaacgccccacaaatattaaattcaccctttttcattacgttcatattttcaagtaattgagctttagaaaaatgttggctagttacgggttcaccataaaacttctcaaaaaagtgatcaaaataaacttcatcaagatcttgaatagatgatccagtaacaggtaattcatctgcgtgtacaagggaagcttcacgaaacattcttagtaattcttctctggcagttattttacgtttatcagatccattttttgtccagaaatatccttgagaatccatatatggtttgctaattccctcgcaaatatggacaacgataacaattccttctggaaacataatattttcagtaagtggagaaattgatggacggacattttgagatgcgacattagcaataagttgattaagcctaaatacatcatcattagttaagccactcaatgtgccgttatcgtttacgccaataagtaagattcctcccagcgagtttgcaaaagcaaccatctcggcggctaaagcatcagggtgagtaacattagctttaaactgtaatttgctatcttcccctttttgtatcaaagcaagtaattcagtatctaacataatcttagcgtaattttcaaacataaaaaacctccactattgtggaggttttcccgaaaaatttcaaattattttgtgcttggaatgctgaagcgtttgttgaagcgttcaacacgaccaccagtatcaacaacacgttgtttaccagtgtagaacgggtggcagttgccacatacgtctaagtttaaatctttacccgctgttgagcgagttttgatcacgttaccgcaagaacaagttgcagtaatttctacataatttgggtgaataccttgtttcattatagaaaacctctaacgaagccatatcgccactagagcatactactcagctgtctagtaccatatgtatgaataaaaaactaggcagaagcctagcaccaaaaagggtgagcattctactcgaaatttttgaaaatgacaatattgaatcaagattgtagatgatacttgtcagggcaagatcgcatctttctcaaatttatgatctaatacaccttaattatccatatcaaatcaggttgtaaaatgagcgtttttcgtttttttgaaaatttatccgacccacgagcctataatcaaaaacaccactttttagacatcgtttttctcgtcgtcagtgccgtgatttcgggggcaaacagctggactgaaatcaaactttttggcgaattacatttggattggttgcgaaaatatcgtccttttgagtgtggcattcctgtcgatgatactatcgcccgtgtaataaaacgcattgagccacaagcatttaatgaggtttttcttaattttatcaatgagatacgcacacaacaaggacgtgaagtgattgcgattgatggcaagacacttcgtcatagtttcaatccggaaacccaaagtgctttgcacagtgtgacggtgtggagccagtctcgtggtttgattttatcgcagaaaaaatcctcgggtaagcaaaatgagcagcaggcggtgatggaaattatcgatagtttttgcttaaaaaatgccgttataacggtggatgcgatgaatacacagaagaaaattgcggagaaaatcatcgaaaagaaaggggattatgtgatgccgttgaagaaaaatcaccgtcaatttcagtcggaagtggaggcgtattttcacaaaatccgccgagattgccccgaaatgcttgagacgtatgaggaggtaaatgcggaacgtagtcgaattgatgagcgttactaccgtaagctgaaagtgagtgattggctgagcaaagcggaggaatggaaggggataaaatcggtgttggaggtgtgtcgcaagcggtcagataatggcaaagaatcacaagaaaaagtcttttatatcagtagtttggatgttgatgttcaaatattggcgaagtgcgtgcgagggcattgggaagtggaaaacaaagcccattgggtgctagatgtggtctataaagaagacgaatgtgctgtgaccgatgaatggggtgcggaaaatctggcaattttgcgtcgattagcgttgaacttggctcgattgcacccgaaaaagcagagtatgaaagggaaattgaccgctgctggttggtcagatgaatttcgagatgagctgttgctcggtgtgtaggttgaaaaatggacaacatatgcggttgccctgtgatacttgtacttttttgactatttttaggtaagtgtttttgcttatcaagaaaattttcattaaaatctcgccgcttatttactttatttgaaaagattatgattgattttcgtcctttttatcaacaaattgccacctcgccgttatctgtttggttggaaacattacctttacagctcaaacaatgggaaaaacagacgcatggagattatgccaaatgggcaaaaatgctagaccatttacctagcttgccttgtgaaattaatttggcagataaggttgaagctcgtttggctgagccgttgtctgcaggtgaaatgcaacgcttggtacatcacctaaaacagcttatgccgtggcgaaaaggtccttaccatctgtatggtgtacatattgattgtgaatggcgttccgattttaaatgggatagggttttgccccatttatcaccgttaaaagaccgcttgattttagatgtgggctgcggcagtggctaccatatgtggcgaatggtgggcgaaggggcaaaaatggtggtggggatcgacccgacggaactctttttgtgccaatttgaagcggtgcgaaaattgttaaataacgaccgcagagccaatttaattccgttaggcattgagcaaatgcaacccttgcaagcctttgatacggtattttcgatgggggtgttgtatcaccgtaaatcgccgctagaccatcttgcccaactgaaaaatcagttagtcaaagggggagagctggtgttagaaactttggttatcgacggtgatattaatgatgtgctggtgccagcagaccgttatgccaaaatgaaaaatgtgtattttatcccgtctgtaccagcgttgattaattggcttgaaaaagttggctttaaaaatgttcgttgtgttgatgaagccgtcaccacattagaagaacagcgtaaaacagattggttagaaaatgaatcgttggttgatttcctcgaccctcaagatcattccaaaacgatagaagggtatcctgcaccgaaaagggcagtgattattgcgacgaattaaaatatcataatctctctagcatccaaagttttccccattcttcagaacggggatttctactagaatccagtaaatctaatgcgcatcttttataacccagctttcaaactcgcttcaataaacttgtctaaatcaccatctaacacagcttgtgtgttacggttttcaacgcctgtacgcaaatctttgatacgcgaatcatctagcacataagaacggatttgactgccccaaccaatatcagacttactctcttccatcgcttgtttttctgcatttttcttcatcatttccatttcgtagagcttcgctttgagctgtttcatcgcctgatctttgttttgatgttgcgaacgtccgttttgacactgcaccacaatacctgatggcatatgggtaatacgcactgcagactccgttttattaacgtgctgaccgcctgcaccagaagcacgatacacgtcaatacgtagatcggcagggttgatttcaatgtcaaaatcatcatcaacttcaggatagacaaaggctgctgcaaaagaggtgtgacggcggttattggagtcaaacggacttttacgcactaaacggtggatccctgtttccgtacgaagccaaccgaaagcatattcgcctgacacacgaattgtcgccgattttaatcctgccacatcgccatcggatacttcgatcaactcggttttaaagcctttgctttccgcccaacgtaaatacatacgcagtaacatttccgtccagtcttgcgcttccgtgccgcctgaaccagcttgtaaatccacatagcaatcggccgcatcgtgctgaccgctaaacatacgacgaaactccaacagggctaatttttcttctaactggttagcttcttgttgagcttcgttaaaagtttcttcatcttccgcttcaacggcaagctcaatcaagccttcgacatcttcaatgccttgctcaagtgttttaatcgtattcacaatagtttcaagagcaacacgttctttgcctaacgcctgagctttttcagcattattccagacatcaggctgctctaattcggcattgacttcttctaagcgttcgacctttagatcgaagtcaaagatacccccgaagtgtacgggttcgttcggctaaatcatctaattgggttctaatcggattgagttcaaacatagttattccttgtagttttaaaagcggagcattatagcgaaatctaggaggatgacaaactaggggatttatccttgtataagaatcatgtatttacctttaccctttaaaccctagatataaaacacaaatgttgtaagctagcggccaatgtctattagccgatcaataacctttggctttcaacacattgtgcggtattattgagagataaattaaggagttttatatgcaaacacttactcaacaactattaaatgatgtccttaatattgccgttcaagcaggagaacatctcaaacgcttttatcagcgttctgtggaaattcagattaaagcagataaaacccctgtgactgaagctgatctttttattagccagtttgtgattgaacaattacagaaattgaccccaaatgtgccgatcttgtcagaagagaactgtaaaattccactttcggagcgttcgcaatggcaagaatattggatcgtcgatccacttgatggaacacagcaatttattgatagaacagatcaattttcagttgtgattgggttggttcaacaaaatcgccctgttctgggtgtcattcattcgccgatcttagacaaaacctactatgcaatgcgtgcaagcggtgcttttgttagagaaaatggcgagatccgtcgtcttaattcgaatagccaaaatgacgataaatcacaccgcttgcaagtgactattggtacgtcaagtagcgacaaaattcgccaagttgtgcttcccccttatcaagtggattttcttcaattcggttcaagtagcttaaaagctgggttggttgctgaaggtaaggcggattgctatgtgcgtttaggggatactggagaatgggatacggctgttgctgaagtgttactcgcagaaacaggcggtcaggtcttcgatcttcacttccaaccgttaagctataatcaacgtgaaacctttgtaaacccttattttataatggtggcaaataaacaacgtgattggcaacagattttttcttttaattgattttacttattgttatattttgttatgaaatctaacaatttttttacattttctaggattgcaaatgaaagcagacaataattgtattgtgatttttggtgcgtctggggatctcacctaccgcaagttaattccagccctttataatctttataaaatcggcagactttctgaacatttttctgtattaggggtcgctcgttcccctttgaccgatgaaacttttcgtcaaaaaatgcacgacaccttagtcaaacttgaaaatgcaagcggtgatgtgttagaaaaattttgcgaacacctttattatcaatcggtaaatacgtctgatgcagtggattatgcaaaattattgccacgtttagatgaactgcacgacaaatatggcacaggcggtaatacgctatattatctttctacgccacccagtttatacggcgttatccctgaatgcctttcagcacacggtttaacaacagaagaatttggctggaaacggatcattgttgagaagcctttcggctacgatattgaaacggcaaaagcccttgatattcaaattcacaagtattttgaagagcatcagatctaccgtatcgaccattatttaggcaaagaaaccgttcaaaatttgctcgttttgcgtttttctaatggtctatttgaaccgctctggaaccgtaattttatcgattatgttgaaatcacaggggcagaatctattggtgtagaagatcgtggcggttattatgatggctcaggtgcaatgcgtgatatgttccaaaaccatttattgcaagtgttagcaatggtcgcaatggagccacctgcgattattaatgccgattcaatgcgtgatgaagtagcgaaagtactacattgtctgcatccactttcaaatgatgatattaaaaataaccttgttttaggacaatataccgcaagcaccattaacggcgaagaagttaaaggctatctacaagaaaaaggtgtgcctgaagactctaacactgaaacctatatggcagtacgttgccaaattgacaactggcgttgggctggtgtgccattctatgtacgaacaggaaaacgtctaccagctcgtgttacagaagtggttattcactttaaaaccaccccacacccagtctttagtcaaaatgcccctgataataaattgattattcgtatccaacccgacgaaggcatttcaatgcgtttcggcttgaaaaaacctggtgctggctttgaagcgaaagaagtatcaatggatttccgctatgccgatcttgcttcaccaagcctattaacggcttatgaacgtctattattagatgcaatgaaaggcgatgcaaccctattcgctcgtaccgatgcagtacacgcctgctggaaatttgttcaaccgattttggactataaagcggaacgtgggcgtatttatgaatacgaagcaggtacttgggggccttctgaagccgataaattgatcgccaaacacggcgaagtgtggcgtaaaccaagcggtttgatgaagaaaaaagtgtaatcgtagggacacactgcgtgtgtccatatacattattgataacggatacctgtgtcccacaaggattttatgaactacatcacattcccgacagcacaaagtgcggtggaaaaaatcgcacaagaatttgtgttatatagccaattaaaccgccccgtacatatttccctatcaggcggaagcactccaaaactgctgtttaaaacccttgcgcaagagccgtataaaagccaaattcaatggcaaaatctccatttttggtggggcgatgaccgtatggttccgccacaagatcctgaaagcaattatggtgaagtacaaaaattactgttcgatcatattcaaatcccaacggaaaatatccaccgtattcgtggtgaagagcctgtggagcaagaactggtaagattttcacaagaactgaccgcttgtgtacctaatggcgagtttgattggattattttaggtatggggacagacggacataccgcctccctattcccacatcaaacaaatttcaatgatccaaatttagcggttattgccaaacaccctgaaacagggcaaattcgtatttccaaaactgccaaattgattgaacaggcaaaacgagtgacttatttggttacaggggcaagcaaagcagaaattctcaaagaaatccaaacaacaccagcggaaaacctgccttacccagcagcaaaaattaaagccaaaaatggcgtaacggagtggtatttggatagcgatgtggcgaagttgttgtaaaaatatatcttaatttttaagcgattaccggagctaaatatggatttaatcaacagcagttatcttttagaaattaagcaaattctttctaatgcacgccaaaaggcttataccgctgtcaattcagcaatggttgaagcctattggaaaattggcgaacgtattgtgttggaagaacagaatggagctgatcgggcggcttatgggaaagagattattaaaaatctttcccttgaattaaccaatgaatttggaacaggttttggagaacgtaatatccgaaatttccgtcaattttatctgatgttccaagatttagagatttggaaatcagtgatttccaaattgacgtggacacatattcaacgcactttaaaaatcagtaacgacaaagctcgtctttactacctaaaagaagccgctgaaaataattggtcggtaagaacccttgatcgcaacatttctacgctgtattacgaccgcttgttggcaagccaagatcaaagcatcgtcaaagcggagatgctggaaaaatccgtgccattacaagccagcgatttgattaaatcgcccaccgtattggaatttttgaatttgccgactaacttggcatacaccgaagcagagctagaaaaagcgttgattgataatctgcaacaatttatgttggaactgggcaaaggctttgctttcgtagctcgccaacaatgtatccgcaccgaaacgtccgatttctttattgatttggtcttttacaattacattttaaaatgctttgtgatcgttgagttgaaaacagaaaaactcactcatcaagacattgggcaactggatatgtatgtgcgaatgtacgatgatttgcaaaaacgccctgatgataaccccactatcggcttgttactttgcaccgaaaccgatagcgtagtggcgaaatattcggtattgaactacagctcgcagcttttcgccagcaaatatatggcatatttaccgtcagaagaagaattggtgcgggaaattgaaaatcagaaaatgatttttgagcaaaatcatagttaggaaaaataatgtcaatactggcttacattttaaccacccttgtcgcccttgaacatttctatattatgtatttggaaatgtttgcattaaacagcccgaaggcaaggcagatttttaatttagatgaacaaacagcaagaaatcctaaaattcagttgttgtttgctaatcaagggttatataacggatttttagccgctgggcttattttttccctttgtattcaacaaagtgcggttacttatttctttttaagttgcgtgatcgtggcggcggtttatggagcgataagtgcgaagaataaagggattttgattaaacagggagcgcctgcggtgttggcgttggtggtgagtttgtttacgtaaatatgtaggggcaaattacatttgcctcataaatctcgaaataaatattttatgacaaaatataatgcaagtattcatcatcgaaaatccattcgtttaaaacattatgattatcgcaaagatggattttatttcattacgatttgttgtaaaaacaaagaatgtttatttggacaaattgtcaatcaacaaatattgctaaataatttaggtcattatgtgaaaaaatgttgggaacaaatcccagaatttttcccacaggcaagagttgatgaatttgttgttatgcctaatcatttacacggcattattgaaattaccgaatataataagggcaaatgtaatttgcccctacaaaaagggacatcgcaaacaatcggttcaatcgtgcgtggttttaaatcaggtgtaacatcttgggcaagaaaaaatacaaatatccttgatgtttggcaacgcaattattatgagcatattattcgagatgaaaaatcctatttgaaaatttatgaatatattcaaaataatcctattttgtgggaattagatcaattatatgtaaaattgtagaggctaatcacattagccctaaaataaattggtgcggaattcggggcaaatattgatttgcccctacgatgtgtattagacataaaaacgtaggggctaatcacattagccctaaaataaattggtgcggaattcggggcaaatatgatttgcccctacgatgtgtattagatataaaaactgtaggggctaatcacattagccttaaaataaattggtacggaattcggggcaaatatgatttagcccctacgatgtgtattagatataaaaactgtaggggctaatcacattagctctaaaataaattggtgcggaattcggggcaaatatgatttgcccctacgatgtgtattagatataaaaactgtaggggctaatcacattagccccaaaacaataaagtattcaacaacccaacaggagcaaaaaatgtcagtaaaaggcgatatcggcgttatcggtttagcggtaatgggtcagaaccttattttaaatatgaacgacaacggctttaaagtcgtggcgtataaccgtactacgtcaaaagtgtacgagtttttagaaggtgcggcgaaaggtacaaatattatcggggcgtattctttagaagatttagttgcgaaattagaaaaaccacgcaaagtgatgttaatggtgcgtgcaggtgaagtggtcgatcaatttattgatgcattattaccgcacttagaagaaggcgacatcatcattgatggcggtaactcgaattaccctgataccaaccgccgtgtgaaagcgttaacggaaaaaggtattcgctttatcggctcgggtgtgtcaggcggtgaagaaggcgcacgtcacggaccttcgattatgccaggtggtaatgaagaagcatggcaatatgtgaaaccgattttccaagcgatttcagcaaaaaccgacaaaggcgagccttgctgtgactgggtgggcaaagaaggtgccggtcatttcgtgaaaatggtacacaacggtatcgaatacggcgatatgcagttaatctgtgaagcttaccagttcttaaaagacggtttaggtttaagctatgatgaaatgcaagcaatcttttctgaatggaaaaaaactgaacttgacagttacttaatcgacatcacgaccgatattctaggttacaaagatacagacggcacaccattagtagaaaaaatccttgataccgcaggtcaaaaaggtacaggtaaatggacggggatcaatgcattagatttcggtattccattaaccttaatcactgagtcagtgtttgctcgttgtgtatcttcattcaaagatcaacgtgttgctgcatctaaattgttcaacaaaaccattggcaaagttgaaggcgacaaacaagtttggatcgaagcggtgcgtaaagcgttattagcatcaaaaattatctcttacgcacaaggctttatgcttattcgtgaagcgtctgaaaacttcggttgggacatcaactacggtgcaacagcgttattatggcgtgaaggttgtatcattcgtagccgtttcttaggcaacattcgtgatgcttacgaagcgaacccagatttagtgttcttaggttcagatgcgtacttcaaaggcattttagaaaacgcattaagcgactggcgtaaagtggtagcgaaatctatcgaagtgggtatcccgatgccttgtatggcaagtgcaatcactttcttagacggttatacctctgagcgagtgccagcaaacttacttcaagcccaacgtgactacttcggtgcacatacttatgagcgtaccgacaaaccacgtggcgagttcttccataccaactggacgggacgtggtggaaatacggcatcgacgacttatgatgtataaataaaatttgtctattacacctatatctgttactacgtatagatagtctaaataaaaagccaatcatagatatatgattggctttttatatgtttcttaaattagttggcggaatggacgggactcgaacccgcgaccccctgcgtgacaggcaggtattctaaccagctgaactaccactccgcagcaaacgaggcgtatattaatgatttcgttctctaccgtcaaacacttttttgaaaaaatttattgattgtctttttactatacaaaacgctctctttttaattcaatgtcgtgttttctgtcgccaattctctcgtccaaaggcaatttccttttgattttttatttatcaactcaagatatttaagatgttctgccaattccttttcatcaggggctaatacaatcaagttagaggtgtcgatagttaatggctggtaaacttgctctgctgaagatgtttttacttgctcgtgttcgtcttcaccaataagggcaatttgaccgcctgtcatcatcaggaacacatcagccaagatctccgcatccagtaacgcaccgtgcaggacacgtttactgttatcaatccccaagcggtcacataacgcatctaaattgttacgtttccctggatacatcttacgagcaagctgtaagctgtccgtgacggtacacatctgtgctactttttcagggggattcggcaaaaaggaaaactcgtggtcgataaatcctacgtcgaagggcgcattatgaataattagttccgcccctttgataaattcaataaattcatcggcaatttcagcaaatgcaggtttatctgccagcatttcgttggtaataccgtgaacttgcattgcttctgcatcgacttcccttggcggtttgatatagacgtgaaaagtccgcccagttaaacggcggttaatcacttcgactgcaccaatttcaatgatgttatgtccaatgtgcggagcaccattgaaattcatccccgtagtttcagtatcgagtacaacttggcgtaatatttgctgttcgctcattgtattttcctaagttacaagcggtaggatttgcaaaatgttttactaatcttaccgcttgtcgttcaaattaactatccgcttttaattcatcaatcgctttttggtcgaagaaatattgcgtaccgcaacactcgcactgcatatcaattaccccttgtttttcggctaacatctctgcaatttcttctttaggcagtaacaaaatcgccgcccctgaacgctctcttgagcaaccacacttaaactctgtggactgtggttgataaacttctactgtttcttcgtggaacaaacgatagagtagttcttctgccgttaaaccaaatagctcttcatctttgatcgtcgaagttaatgtcgccaaatgctcaaagtcgtctggtgaaccagtgccatctggaacgatctgtaataatgttccacctgcaacggctttaccttgatattcaccaacacggatcacaagctgtgtagcgagctgctctgagcgagcaaaatagtcttctaaacactcactaacagtaggtttatctaaggctataaccccttgataacgttcacctttttctggaataatcgaaataacgagaacaccatttccaaccatttcagcaagtgttgcattgtctgcaatatcagcttcaacacgagctaaagcgcgaaattgttgttgatgattgccgtttaccaccgctaattttaacgctccgtcaccttgaatttgcacggtaattgtcccttcaaatttgagtgttgccgttaataagctggttgcaaccaacatttcacctagtagattttgcactgctgatggatagtggtgggtatttaaagtttccgtaaaggtgtcgtttaagcgaacccattcgccacgcaccgcacggttttgaaataaaaagcgataaagtttatcgttatcttgtgtgtaagttgtcattaaaaatccttcataaaatacaagcggtgagaaaaatcaccgccattacaaaagctatatggggacgatttaagtaattacaaatcgttctcttgatatttaaatttaatcaaatcccgtcgctcttttttatttgggcgacgatctgggtgtggcatcgacaacgcatttgctttacgggcaaaggcgattttttctcgttcttggatacttttttccgtttcttgataaagcagttgtgcttcaggtgcaccacgacgttgatcactcaaggctgtgacaacaacttctttttcatcgtttccttggcgtaatttaatcgttgcccccacttcaaccattttactggttttagcccgctgcccattgtaatggactttaccaccttcaatcatcgcctttgcaattgaacgagttttgtaaaagcgtgccgcccatagccacttatccaagcgaacttcattgatattatcagccatttttccccttttttttcaactattttaccctttttcacacaaacaagcggtaataaggcagaaaaaatttgcaaaattttccttttcgctgtattctccgccaccacaattcatacaaacaaatctgaattaacctgttttaatccaatctttaaataacacgattattatttctatgcatcttacagagttaaaaaatacacccgtatcggaacttgtccgtatcggtgaagaacaaatggggctagaaaacttagctcgcttacgcaaacaagatattatctttgccattttgaaacaacacgcaaaaagtggtgaagacattttcggtcaaggcgtgttagaaatcttacctgatggttttggtttcctccgttctgccgatagttcttaccttgcaggccctgatgatatctacgtttccccaagtcaaatccgccgtttcaatcttcaaactggtgacaaaatcgaaggtaaaatccgcccaccaaaagaaggcgaacgttactttgcattgctaaaagtcgatttagtcaatgatgataaacctgaagtttctcgtagcaaaattctctttgaaaacttaacgccactgcacgctaactcacgtttgcgtatggaacgtggtaatggttcaaaagaagatttaaccgctcgtatcttagatttggcttcaccaatcggtaaaggtcagcgtggtctgatcgttgcaccaccaaaagccggtaaaaccgttttacttcaaaacattgctcaaagcattacccataactatcctgagtgtgaattaatcgttttgttaattgatgaacgtccagaagaagtaactgaaatgcaacgttctgtgaaaggcgaagtaattgcttcaacctttgatgaacctgcaactcgccacgttcaagttgccgaaatggtaattgaaaaagcgaaacgtttagtcgaacataaaaaagatgtggttattttattagactctatcacacgtttagcacgagcttacaacacagtaacccctgcgtctggtaaaattctttctggtggtgtggacgctaacgctttacaccgcccaaaacgtttctttggtgctgctcgtaacgtagaagaaggcggtagcttaaccattattgcaacggcacttgtggatacaggttcaaaaatggacgaagttatctttgaagagttcaaaggaacaggtaatatggaattacacctttctcgcaaaattgcagaacgccgtgtattcccagcgattgactttaaccgttcaggcacgcgtaaagaagatctactcacaagcccagatgaattacaaaaaatgtggattttacgcaaaatccttaacccaatgggtgaagtggaagcaatggagttccttattgataaattgatggtcgcaaaaaccaacgatgagttttttgagattatgaaaagatcttaaccatagaaatagaaacggcacttaaagtgccgtttttattatagctagtttgccacagtagcgatacccgcaaacatggtataagaaataatattcaacgttatttttgtaatgaatgtcataaaacttttctttgtgaaagaaaaagttttatggcgggacgaacaaaagtatctctgaatattatttttctttccatacttttggatattgttcttaaggcaaaaaggacaggttttttattcatatttcaaaaagaaggcttaaagtcttgtactataaggctttaagctactttttagcaacaaatttatctattacgcctgtaataggcatagtgaccattttgtctactatgccttaaaaagttgcttacataaaatagtcactaatatttacaaaaatagacgcaaaacaacaatctttcagtatattgttaaattttaaaccgattatttaataccatacttctcgcgatattctctcatttttggcaaatagtcagtatattgcgctgatctttctaagaagctaacaagatcatcaaaatcaataatagagaaaacctgacagccgtaatcacgttctacttcttggattgctgagagttcgcttttgcctttttctttacggtttaacgcgatcatcacacccgctaaggttgcattgttggcttgaatgatttccattgattcacgaattgccgtgcctgcggtaattacatcgtccaccaataaaactctgccttttaacgggctaccgataagatttccaccttcgccgtgatctttaacttctttacggttaaagcaacaaggcttatctacatcaaattgatttgctaatgccaccgcgacagtagttgcaatcggaatgcctttgtaagcaggtccgaatagtacatcataatcaatttggctagcttggatcgctttggcgtaatattcgcccaatttggcaagatctctgccagtattaaataatcctgcattaaagaagtaagggctttgtctgcctgatttcagggtaaattcgccgaatttaagtacatttcggcttaaggcaaattcgataaagtcgtgtttgtattgttgcatagggcatccttcttatctagctgtaggggcggaccgatgtgtccgcccacaatattatctacattttaataagggcgaacacatcggttcgcccctaaaaacaattgtatagttataaaaatagtggggctgtattagattagtcctaaatttcacaccattttctcaacgttttaagttgctcttttggtgttccaaagtgaaaccgaaattcacattctttcaagaataaagggaaactttttcggtcaattccattatattttcggagtatccgcttggcttgactccaaaaattttcaatgccgttgatgtgattttgtttcactgcaaacagctccgaatggctaattcgttcgtggtgaaattcgcttacatcaagggcatcataactatggtaagtatctgtataaacctagctgtcaggcttgattttccttgctataacaggcattggcgttgttgtcttcgtatcattgactaccacagtaaatacttttccttgccgtttcaatatccccaaaacagccacttttcctgccgcaccacgacctcgttttcctttacgatgtccaccaaaatagctttcatccagctcaatttgtccgtcagatacttcatctgcttcaagtgctaaattatagctgataacctcgcggattttgcggtaaaacagtgcagcagagttatcatttatctctaacaaatttgccgcagaacggacagtgacttctaatacaaaaaattcaaggagatttttttgtatggatttctttaatttacaatgagttattttcatttttataaactaacatacttgctaatctaatacgcccccttacattattggtatttaaaacatcaagcgttttagaagaacggtcagataaatcgaacaaaaagagttattatccttataggcatcggaatgtaagaagtgcttatcatagttttaaacattatatggattatttacctatgaaaagtatagtgatttaaatatcgaaaaaacgacaaatagacttgaaaatttattcggacaacttaaagagaaattatcgcatcatgcaggattaacgaaaagacataatgttatgtttataaaggattttttaaataaaaagagttgctaagaataatttaaaatattcattagcaaccatacactactcacagttgcgttatgcttgggattcaaaacgtctggctgcttcgtcccaattcaccacattccaaaatgctttaatataatcaggacgacggttctggtaacttaagtaatatgcatgttcccatacatctaaacctaaaattggataaccagacacaccagctacatctttacccattaatggagaatcttggttagctgtcgatactacagataactttccatcttctagtactagccacgcccatccagaaccaaaacgagtggtagcagccagctcaaattgttcttggaatgtttcaacagaaccaaaatcccgtattatggtctctttgagttttccttgtaaggtcgtaccagtttttaaccctttccaaaacaacgtgtgattaacatgtcctcctacattattacgcacagctactcgtttttctacaggaacttgctcaagatttgagatcagctttcctggacattgtcctagtaaatcaggatatgcctctaatgcgatatttgcattattaatataggtttgatggtgtttggagtgatgaatctccattgttcttgcatcaaaatacggatctaatgcatcataggtataatctaactcaggtaatgtgtatgccatattatgttcctcaaaaataatcagtaacaattgagtgtaaactctcaactatagtaacaaataataagaagataatatatatttttttgatctatcgcaaattacagcgacctcgtaatagctatttttaaatgtagccttgttgcttatcaaactcctttatagcttggtaaataaaaaataccattcaaatatatagaaaaattaagaatctaatctaaatcaccacactcttaacctgcaaatacgccatctgccctatttgcaagcacagatcatcaaacgcccacaaactgatactcgcccaaatttcttgagcttccacctcaacggcaatatcatagcggtcagattgaggctcgattttacaaattcgcccttgcagaatattccgaatagaactttgctcaggtttagacagggtaatagaaacattttggctaccaatgctaattcgcattaaatcccctaattgatagcgaggctgttccgtaacccaaattaactgttgtcccaatgccagcccttgcatacggtaaggattttgagcgacaacaggcagctcaagtaaactcaatcgctgagcttcaggctgccacgcagaaaaggctgggctatgccaaacattcaacgttttatcaaaagcaaccaccttcccctcttccaacaacaacaaattatccgccaaacgaataacctcatcaaggctatggcttacatacaaaatcggaatatccaccgtttttgccaaccgccccaaatagtccatcaactcattcttacgcggtaaatctaaagctgaaagaggctcgtccatcaacaaaatatctggctcgctcaacaacgcacgcccaatcgccacacgttgtttttcaccaccagacaagctgatcgggaaacgatctaacagatgttcaatccccaacaatttaactaattgtgaaaaattcgcctgatcaaaccgcttacagccatattttaaattcgcctcaactcgataatgcggaaataagcgatgttcttggaaaacatagcccaccttacgtttttcaggcggcaaatttatcttctggcgatcatcaaacaacactcgcccatttaacacaattcgcccttccgttggtgtaactagccctgcgataagattaattaaactcgacttccctgccccagagcgaccaaaaattgccgtcacccctttagcatttaacgccacatcaacagctaaatccaagtttcctaaacgatgtttaactttaagttgcaaagattgtgccattactgtcccttaatttgttggaaacgttgctgacgttgtgacaataactcagaaaaaaataacgccactaacgaaatcacaatcgcaatcacacaaagccgagcagccgccatttcaccgtcaggggtttcaataaacgtataaagtgccgcaggaatagtttgggtttgattagggatattggacacaaaagtaatggtcgccccaaattcccctaacgaacgagcaaaacctaacaccgcccctgcaataatccccgaaaaagagagcggaagatgaagtgtaaaaaacactcttaatggacttgcccctaaggttctcgccgcctgctccaattttggatcaatagcatcaaaggctaacctaatagagcgaaccatcaacggaaaagccattaccattgaagcaagcaccgcccctttccaagaaaaacttaacgaaaactcaaaccactgccacaaatattgcccaatcgcccctttctttgccattaaaatcagcaaaagataaccgatcaccacagggggcaagactaacggcaaatggataatgccattaaataaatgcttaccccaaaactcttttcgagccaacaaccacgcagccccaatggcaaaaggcaacgcaaataagaccgctatactggcaatttttaggcttaaataaatggcattaagttcttgttgggaaaaagaaaatattaacatttcattcactatcatagtccgtattctacaatatttattctttttatctatctatttagaaaaataataagagttatggcattatcgctttcttctttcatctactttataatagaatatagagaataccttattcaacctgtaacgtatgaaactcaacattccgacctatctgactttatttcgtgtggcgttaattccgctgtttattgtttcgttttacttgcctattcaatattctgctgaaattaccacgttgattttttttattgcttcaattactgactggtttgacggctatttggctcgcaagtggaaccaaactactcgcttaggggcatttttagatcctgtggcagacaaagttttaatcgcgattgcattggtgtctgtggtcgaatactaccatacttggtggatcactattccagctggcattatgattgcccgtgagattattatttcggcgttgcgtgagtggatggcggaattaggcgaacgtgcgagtgtagcggtgtcgatttggggtaaagtgaaaacgactgcacaaatgttggcattgggtggtttattatggcgacaaacagcgtggatggaatatgccgcctttgctttgctctatatcgctgcgattttaaccatttggtcgatgttgcaatacttgaaagcatctaaaggcagtttattaaaatcttaaatccccctttttcaaagggggaaatgttgattatgtcaaaattcaattccaaacaatttcttgtcgatacgccacataaccctggtgtttatcgtatgtatgatgataaaggcacgatcatctatgtcggtaaggcaaaagatttaaaaaagcgtctatcgagctattttcgtagcaatcttgccagccgaaaaaccgaagcgttggtctcgcaaattgctcatattgataccaccattacccattcggaaaccgaagccttactgttggaacacaattacattaaggaaaatcaaccgaaatacaatgtgttgctccgtgacgataaatcttacccttatattttgctcacccaacaccaacacccacgtttagccagctttcgggggagcaaaaaaattgctggggaatattttggaccttacccaaatgcaggggcggtgcgagaaaccttaaatctgctccaaaaactgtttccgatccgccagtgtgaagacagctactacaaaaaccgttctcgtccttgtttgcagtatcaaatcgggcgttgccttgccccttgcgttgaaggggtttattcccagagagaatacgatcaacaggtggaatatgtccgcttattcttacaaggcaaagatcagcaagtgatcgaacatttgatcggtaaaatggaaaaagctgcggaagatctggattttgaagctgctgcccgttttcgagatcaaattcagcagatgcgagtggtcactgaaaagcaatttgtatcgaatgaacgtctagacgatctcgatattatttcgattgcctaccaacacggtatcgcttgcgtacatattctgtttgtacgacaagggaaaatgttgggtagccgaagttatttcccaaaagtgccgaaccataccgaacttgccgaattgagtgacacttttatcgggcaattctatttgcagatgaaccaacatcgcaccattccgcatcaaattattatcgatcactccgtgagcgaagtggacgccttagaaaaggtattatcggaacaagcaggacataaagtgagtattaccgataaggtgcgtggtgaaaaaagccgttatcttgcgcttgccaaaacgaacgcaatggcagcattgaccttacagctcaagcaagatgctcgaatccaaacccgttatgaagctttacaagcggtgctttctttgccaaaaattgcaagaatggaatgtttcgacatcagtcatacgatgggcgaacaaacggtcgcttcttgtgtggtgtttgatgaaaatggaccgttaaaatccgactatcgccgtttcaacattgaaggtattacagggggcgatgattatgccgcaatggaacaagccctgctcaaacgttatgataaaccgctaccgcctgaaaaaatccctgatattatttttattgacggcggaaaagggcagttaaatcgagccttagacacctttgccaatctcaaagtggaatgggataaatccaaaccattactcatcggtgtggcaaaaggcgtagaacgaaaagctgggctagaaaccttgctgatcagcaaatgggacaaggaaatccacctaccacccgacagccctgcgttacatttaattcagcatatccgtgatgaatcccataaccacgccattagcggacaccgtaaaaaacggcaaaaagcctttaccgaaagtggtttagaggcaatcgctggcgttggggctaaacgccgccatttgttgctaaaatatctcggtggtatgcaaggcgtcaaatcagcaacacttgatgaaattaaatcggttcctggaatttcagtatctttggctgagattattttcgataccctaaattatagtgaataatattatctcactataaatttctcaacgcttcaatacgtttttctaacggtgggtggctcataaagaactcttttgctttaccgttgatcatcatcgcatttaatgaaccaggtaattcttctggatcgtgaacacgttgtaaacgttgcaacgccgcaatcattttctctttacccactaattgagccgagcctgcatctgcacggaactcacggtaacgagagaaccacattgcaatgatggttgctaatacgccgaaaagtatttccagaaccattgatactaagaagtaagtgccactactttgggtttcttcgccatcatcattacggctactggatactgccgttgcaatcatacgagagaggaagataacaaaggtatttaataccccttgcaataaagtcattgtgaccatatcgccattagcaatatgtgctacttcgtgtgccacaactgcttctgcttcgtcttctgtcattgtgtttaacaaacctgtactcactgcaactagcgagttacttttggttgcccctgttgcaaatgcgtttacatcagctgagtggtaaattgcaacatctggcattggaatacccgcttgttgcgattggcgtttcactgtttcaaccaaccaacgctctgcattgttgcgtggttcagtgataatttctgctcccactgattttaatgccattgtttttgacataaataatgagattaaagaaccagcaaaaccaaaaagcacagacataattaaaattccacccgtactgtttccagcaatgccagtaacacttaaaataatccctagcacaatcattactgcaaagtttgtcgcaaggaaaagtgcgatacgcatcatatagataattctccaaagttaataaattgttgttattcggtaataagcgattaccgaatgcttaacataatgattatttaacaaaaatcaaggattagacaaaaattattcccataaatttaattgcttcgtaattttttcttcaggaaaatgcacattcaatccgatcaaacgaatttttcgcccctttcgtcgttgccaaatctgttgtaatagctgtaaaaaatggtgttctgcgataccgtctgtggttcgctctagtgtagtttgggtgaaatcatcaaatttcagtttaattccgatcttttttaaatcgctcagtggcttatcgccccagttgcgttgaagccgaaagagtaaggtttgatagtgcgatttcaccacatcttccgcctcagtgagtgtatcaagatcagaaagtaaggtattttccactgcaagcgattttcgagggcggtgaggctcgacttctcttggatcgatgccgtgacagaaatcccataagcgttgcccaaacttaccaaactgttgataaatcaaagcctgatctgcttgttgaatatcgccacaggtgataaatccaagttgtgccagcttttcttgggccactttgcccacccctgaaattttctttaacggcaaggttttcacaaaatccgcaacctcttcggggcaaataacaaattgtccgttgggcttattttgatcggaagcgatttttgctagaaatttcagcggtgcaatacctgctgatgaagtaagttgtagctcttgccaaatatcctgacgaatggcttgggctatccaagttgcagagcctgaatgttgcttacaagcggtcacatcgaggtaggcttcatctaaagagatcggctcaatgatgtcggtataacggcgaaaaatgcaatgaatttgctctgataccgccttataaagcgacatattgacaggcaataaaattaaattcgggcaacgttttaacgcttgagaagtggacatcgcactatgcaagccgaatttacgcgcttcataattacaggttgtcagcaccccacgttgattagcttttccccctactgcaacaggctttccttttaaacttggattattgcgaatttcaatagaagcataaaagcaatccatatcaatatgaataatttttttgttgtaattcattgctcgcctatatttgtaaactgtgagagaaatctgaccgcttgtgtattcttaattatacaataaaatactgtaaataaaaacagtttatcttcgttaaattatccattacattccttactttattggcaaaaggagaaattatgctatacggactaatgatcgcctttgtcccactttttttagggtatcttttccaaacgacaaatcaacagatactcaattgggtcaatcgcattacgctttactgcttatacctgattttattgattatgggaatttcgcttgggcaattagatgaattaacgaccaaactgccacaaattggagcaacggcatttggtttaagtgcaattctacacctttgcaacattgtctgtttgctcatttttgataagtgttacccgatcaaacgtgaggcacatagccttgaagaattgccatctcgttggaaggttttgcttgagtcggcacaactctgtgcaacggtttttgtcggggtaattttaggctttacaactaaaaatgtggttgatttccctttacattcaagcacctatgtcctagtggtaatgattttctgtatcggggttcagcttagaaacagtggcattccactgcgtgatgtattcttaaacacccgtggcattttgacttccatcgtctttatcgcaagcggtctgattggcggtattctttgtgcttatctgcttgatttaccgataattaaagcccttgcctttgcttctggttttggttggtattccctttcaagtgtattggtcaatgatgcttgggggggcaatggacggtagcattgcctttttcaacgatctctcaagagaaatcttctgcttatttgcgataccgttttttatgcgtcactttccctcaacagccgtaggacttggcggagctaccgcacttgatgccacattgccaattattcaaaaatcaggaggtattcagattgtgcctcttgcaatcagtttcggctttattatcaatttggttgtgccgattttattggcgttttttattgggtttacttaagaatatacctaagtagtaagtcgtaatatccccactcaaaatactgcccagggtcgatttttcgttctggggcaatttgattatgtcccacaatacgttcaggcgtaatttgcggataggcttgcataatcacttgagtaaggctagctaaggtttgatattgcgcttcggtaaaaggctggttattactgccttctagctcaatcccgatagaaaactcattgcatttttcacgcccttcaaagcaagaaacgccagcgtgccaagccatatcgttaaaattaacatattgggtaatttgcccttcccgattaattaaacagtgggcggaaacccgtaaatctttgatttcatcaaaataggggtgaaggcttgggtctaacgtgcctgcaaaaaaacggtcaataaaatcaccaccaaattcatcggggggcaagctgatataatgaataaccaaaagggaaatatcgtcttgatagggtcttggattaaagtgcggtgaaggtacttgtttggtatttaacagccaaccattttcaatctttaacgttttctgcatagtttaaaacgactaaataagctaaaatagtgccattttacaagaaagagaataaaaatgctgagttatcgtcacagttttcacgcaggcaaccacgccgatgtccttaaacatatcgttttaaccctcattttgcacgccttaaaacagaaagaaaaaggctttttctaccttgatacccattcgggtgtggggcgttatagcttgcaaagtagcaaagcggaaaaaacaggggaatatattgaaggtatagctcgcctttgggagagaaccgatctccccgaagaagttgccttgtacctaaatgaaatcaaaaaaattaataaagataagctacgtttttacgcaggttcgccgttacttgccgtgcaacaattacgctcacaagatagagcgttactcacagagttacaccctaacgacttcccactacttcgcaatgaatttgccaaaacacctaatgtggtgacaaaacgtgaaaacggttttcagcagttaaaatctgccttaccgccaaaagaaaagcgtggtttggtgctgatcgatccgccttatgaattaaaagaagattatgaactggtggtaaaagccattgaagaaggctacaaacgctttgccacaggcgtttatgcgatttggtatcctgtggtgcttcgccaacataccaaacgtatcgtaagaggcctagttgaaacggggatccgcaaaattttacagattgaattagccgttcgccctgactcagaccaacgaggtatgactgcaagcggtatgattgtaattaatccaccgtggcagttagaaagtcaaatgaaaaagattttaccctatttaactgatgtgcttgtgccagaaggaacaggcagttggacggtagagtggattaagccggaataaatattttggggccgtattagattagcaagtatgttagtctataaaaatgaaaataactcattgtaaattaaagaaatccatacaaaaaaatctccttgaattttttgtattagaagtcactgtccgttctgcggcaaatttgttagagataaatgataactctgctgcactgttttaccgcaaaatccgcgaggttatcagctataatttagcacttgaagcagatgaagtatctgacggacaaattgagctggatgaaagctattttggtggacatcgtaaaggaaaacgaggtcgtggtgcggcaggaaaagtggctgtttttagcatattaaaacgacaaggtaaagtgtttactgtagtcgtcaatgacacgaaaataagaacgttaatgcctgttatagcaaggaaaatcaagcctgatagctgggtttatacagatacttaccatagttatgatgcccttgatgtaagcgaatttcaccacgaacgaattagccattcggagctgtttgcagtgaaacaaaatcacatcaacggcattgaaaatttttggagtcaagccaagcggatactccgaaaatataatggaattgaccgaaaaagtttccctttattcttgaaagaatgtgaatttcggtttaactttggggcaccaaaagagtgacttaaaatgttgagaaaatggtgtggctaatctaatacagccccttaaattattattgaattgatatgttaggtattcattcatctaaaccctcaccccaaaccgcttcggcacgataaaaatcgcaggcagtgcaaacaacaccattaaccagaggctacctgtcggcgaaacttgatagactaagccagcgataaaggtgaacaacgccataaaaatacagcttgcaaagctaaaatagagtgcttgtagttttgccatttgttccgtgggttgggttgaaaggtagcggatcattgcataatgtcctgctccataagagatcgaatggaacatctgcattgccattaagatcgccatattggtggtggaagccagtaaaatccaacgcaccattgagctaatggcagataagatcattaaatggctgattttccacgttttaaatacacggttggcaaagaagaaaaacagaatttcagaaacaactgccaatccccataacaaactcgcactttgggtcgaaatgcctgccgatgcccaataaatcgtactataagcataataagcggcgtgagaagattgaattaaggaaatggcaatcaacattttgaatgtggttggcactttcattaattgcagatagtttaactctgattgggctttttcttccgtttgtacaaaggtttgggtcggattgaccgttaagccagtgcctaaaaagactagccagccgatcaaaatgccgataattgcactttcccctagccagccgactaaatagcctgtgctaactgagccgaccacaaaggcaatcgagccaaacaaacgtgttctgccataatcaatcccgacttgctgttgccaagtggaagctatggtatcagctatcggcattgctccgccgttgaagatatggaacagtgcgattgcagggaataaaatccaaattgtttgtacccgaaaggcaactaaaaacagagtggcaatggcgagccacgttagccaacgagcaagagaaagtagctggttggggtgggtaatgcgtttagaaaaggtcattgcccctaaaaagcggaatagataacctgaagcgattaacaaaccaatcattcccgaatcgtagccgtgatggttcaaccaaacaggtagaaacggcaaacagcacgccataggcacaataaaagccgaagaagttaaacgacgaccattgaaaaggggtaaattttatcatagggatttttccatctcttctgcacgcttaattgccgcattcatcgcttgttcaacggttgcatttagctcacgttgttcaaataccgccaatgcttgagccgttgtaccgccttttgaagtgacattttcgcgtaaggttgctaaggcgacttctggattttctaccaccatttttgccgcccctaatgccgctgattgcactaaataacgagcattttgttcgctaaagcccattttaattgccgcttcttgcattgcttccataaacttaaagaagtaagcagggctagaacctgtgatggcaataatttggttgatctccgcttctgtatccacccaataacatttgcctaccgcagacattagctgttctgcaaattgacaagcggtcggatctaccgatttttttgcaaataatcctgcaatgccttcaccaatgagcgatggcgtattcggcattgtccgaacaatgttgcttgctgttggtaacagttgctcaagacgggcaacagaaattccagccgcaacggaaatcacccattttgcactaaaatccacttgagaaaactcactgcatacttccgccatcatctgcggtttaaccgccaaaatcaccacgtcagcttggatcacagcatcgaggttagacaaatccacctgaacgcccattgctcttagctgcgagcggcgagtttcattgtttttattacgagcgataatttgctcggcaggataaccgcttttgattaatcctgaaatgatcgcaaacgccatattaccagcaccgataaaggcgatttttttgtgttgcatttgttcctccaatcatcaaaatcttccagatttattgacgtgaaatatccacataccatataaatagatagcaatattattgctttataacattttccatactctgttcatagaaggtaatttcttgcgaagaaaatcaagcattacttgtttaatttatatataaaaatataatttattaatagagaagaaagagagagtatgttagaacttaattcaactataaaaggttattatcatttaaaaatcacatggcattgactaccagaagatacaaatagcattcagtaacaccttaactttaattccgtgaaatatctgcctctaggagctattttctttaattaccaagaagcagataaccttaacattcattaaggatttctctactattacctttttacagattatttaaacgcacatcaattagcatttgatttgcatcacctgctttttctttagcttgttcataagcacttttcgcagccgccttgtcgccttttgcggctaacagatcacctgttaataactgcttacggaaatcccaagcggtgtctttgatttgagaaagtgttgctaatgctgcatcaaactcttttagctgataatccactgtagcaagacgaaaacggatcacgttttgtaatgttgcatcggttgtcgaacctaaagactgtgttaataacgtttttgttgtcgcaaaatcgcctttatctgccgcttgttttgcttcttcgagttgagcaaataccgcatagcttgagtctttattctccgcaataaatttttgtataagcggtgcgtttttctcaggattttgcaaatagctttccatcacttgttgatagcttgctgatgtggtttgagctacttcaatttggtgtttttgccagtagttccagccaaatgttgcaactgcaactagaaaaattgccacaacaatcggtgtgccattttctttaaaccagctttttgcttcttcaaactgctgttcttcggttttattaagataatcgctcatttctgctccctatgcaaaacgcgttgttaattcgttgattaaatcagcttgggcaatggtcatttgctccgcttcaccaaataggtcttttactaccactttctgctcggcgacttcactttcacctaacaccaaagcaattttcgcccctgatttatcggcacgtttgaattgttttttgaaattcccaccgcttgtatgtaacattgtgcgaagttgtgggaacgcattacgtaaggtttcagccaaacggaatgcaactgccgttgtgccttcacctgaatgaactacataaatatcaacggctcttggtaattgcacattcgggtttacttcttgcactagcaagactaaacgctccaagcccatagcaaagccaacaccttccgttgcgtgtccgcctagttgtgcgactaagccatcataacgaccaccgccacaaactgtgccttgtgcacctaatgctgtggtgacccactcaaatacggttttattgtagtaatccaaaccacgcactaacttttgattgacttcgtaggcaatacccatttcatcaaggattgcacaaagtctggcaaaatgtgctttcgattcatcatctaagaaatcgtgaagttttggtgcatcgtttaatactgcttgtaacgcttgatttttggtatccaaaatgcgtaatgggttggttgttaaacggcgttcgctgtcaggatcttgctttaatacgtctaaatgattttgcaagaaagcaactagagcttcacggtatcgagtacgcacttccaatccgccgattgagttaagctgtaaagtgacgtgttcacggatacctaatttttcccataagcgagcggttagcacaattaattccgcatccgcttcagcattttggatcccgaaaatttcaacgccagcttggtggaattgacgataacgacctttttgcggacgctcatagcggaacatcggaccgatataccataggcgttgttcttggttgtaaatccaaccgtgttcaatcgccgcacgcacgcaacctgccgtaccttcagggcgaagggtaaaactttcgcccgcttcttcgctacgggtaaaggtaaacatctctttctcgacaatatctgtcgcttcaccgacaccacgtttgaataagtcggtagattccataatcggactacgcatttctgtgtagccataacttgcgaaaatatcacggatattactttcaacccactgccataatggtgtttcagttggggaaaggtcattcattccgcgtaaagcttgaattgtttttgacacgttgttgttcctaaattctcaaataaatagattttacatcaataattttatgtggattttaacactatcattttagaacagtatattttcaggcgcaatcattatctccctaaacataccgtaagctctaaaggttagcttcctttatttgatggcaccactcaataatacaaaacgacgatatttagaaaaaataaagagatcctacataggatctcttttgtatgaaaattaagcttttgctttagtgtacttgtgaatagtattaatctttcttacgcagaactaactgacttaataccactaacgcaagtgagaatacaatcataatagtcgctaacgcattaacttctggggttacccctgttttaaccagtgagaaaatcttcaatggtaacacttcatagcttgcacttgttacgaaagaagaaaccacaacgtcatctaacgagatggtaaaactcaataaccagcctgaaacaatcgcaggaagcaacaatgggaataagattttacgcaaaatggtaaattcattcgcccctaagtcttttgccgcttctaacattttcgcattgaagtcgtttaaacgtgaggataccgtcacaaccacataaggtaagcagaacgtaatatgtgcaaataataaagaccagaagcccaacgctacaccgactaacataaataaggcaagtaaagatactgccattacaatatcaggtgacatcattaccacaaacaacataccaccaacaaattgttttccacggaaacgatagcgatagagtgcaatcgccgttaatgcaccgattaatgttgcaaaagtcgctgagaaaaaggctatggtaattgagtttgttgccgcttgagttagcgtatcattgttaaataaacgctcataccagttccagctaaaacctttccagcttaaaccataacggtcagcattaaaggaattgatgattaaaatgatgattggaatgtacaagaatgcgtacacgacaaacataaaaaagcttttcaatacgcgattcattattctaactccattttcttattcatcagtttatttgcacggtagtacacataaatcattaatgccatcaagacagttaatgcaatactgattgcagagccaaatggccagttacgcgtgacaaggaactcacttttaatgatattacctacaagcaatactttcgcaccgcctaataagtctgccacatagaacatacccattgcaggaagcaaaactaataagcaacccgccacaattcccggcattgttaatggaataattactttaacaaaacgttggaacgcatttgcacccaaatcttttgctgcttctaataaacgtccatcaattttttcaatcgaagaatagagtggcaaaatcataaaaggcaataatatgtaaaccaaaccgataatcaccgcaatttcggtatttaatatacggattggctcgctaatcatacccaaagatagcaaggttttgtttagaacgcctttaacgccaaggaaaatcttcattccgtaaatacggataagcgagttcgtccagaatggcaacaccaccaaaaagagcaaaaatggacgatatttcgcaggcaatttcgcaatcataaaggcaaacggatagcccaccaccaaacaaataatggttgcaatcccagccatacagagcgagttccacaatacttgtgagtaaagtggatcaatcaaacgaccatagctttcaagggaaaacgtaaattcaatcagattactactgtctttggtcataaaactggtgaataacaccagtaagttcgggattaatacaaagaaaattaaccaaccgaagataaccgctacagtaatattttgaaatttcttactagcagtcttcatcgtcgagtacaacctcccaaccttcgtgccacgttaatgccactttttgtcctacagagtgatccatatgcggatcgtcttcattgaagaactcgctcactaacactttcatttggttatgatctaacaccacattagactcaagggtcatacctttataagtacggtcgctaacgtgtccaatcaccgcttttgcactttcgttttcatcaagctcttcaatcacaatatcttctggacgaagcaatactttcagtttttgatttggatgaacaggtaatttcgtatgaatttcgcaaatacgaccttccacattggcttttaccgttttttctgtcacacgctcaatcaccgttgcatcaaacacattgatttcgccgataaaacgcgctacgaacaagttacttggttcttcatagatctcacgaggcgagccatcttgttggatcttacctttgttcattacgataatacgatccgacattgttaatgcctcttcttgatcgtgggtaacgaaaataaaggtaatacctaattgacgttgcaactgttttaattcgtgttgcatttctttacgcaatttatagtcaagagcagaaagcgactcatctaataacaacactttcggctgattaaccaccgcacgagcaatcgcaatacgttgttgctgacctcctgaaagctgtgacggcttacgcggtgccatttcttccaaacgcaccatacgtaacgcttccattacacgaggcttgatttccgcttctggcactttttgcatacgcaaaccgaaagcgacattatcaaaaatggtcatatgagggaaaagtgcataactttggaaaaccgtatttactggacgttgctctgcatcaacattcgatacatcttgtccgtcaagaataattgaaccatcagttaaatcttcaaaacctgcaattaaacgcaataccgttgttttaccacagccagacggaccaagaatggttaaaaactcaccgtcattaattgtaagatctaagccatcaataattgttttttcaccataacgtttcgttatagaacgaagctcaataattggtttttgctctaacttttccattgatttttgttttccccctagggcataaattgagaaaatgcaaaaaaagctgactaaaaattcagcacctagcaacataataaatatgttcttgaaatagcttgcaatgatatagcgaatggggggggaatgaaagcaaaaatttgcaattttaaggaaattattgaagtatcttctcataatttcagaccaactttgtctaaagttttccatagtaagtttaatattaggcttagatgcattacaaaatcgctagattgttgcataatattattacaagatggaagtatagaaacttaatataaataattattgagtttaattgcataattatgcataataatcaccaagacaagcggtgagaaaccgccttttatttgcaatttaatttataaaggatactggatatggcactttggggtggacgtttcacacaacaagcagatcaacaattcaaatatttcaacgattcattacgttttgactaccgcttggcgttacaagatattgacggctcaattggttgggcaaaagccattcattccgtagggatcatcaatcaagcggaattagtcgaattaattgcggcgttaaagcagttgcgtgcagaagttgcccctaatttagccattgtgctacaagaagatgcggaggatattcatagctgggttgagctacaactgattaaaaaagtcggcgatctcggtaaaaaactgcacacaggacgtagccgtaacgaccaagttgccgtagatatgaaattatggtgtaaagcccaagtgctttcactacaagagtctatccgtgcgttacaagaaaaattggtggaaaccgcagaagctaaccaactttctgtaatgccgggttatacccatttacaacgggctcagccgatcacctttgcccattggtgtatggcatattacgagatgttagaacgagattacagccgtttaaccgatgcttataaacgaatgaatacttgcccactaggttcaggggcgttagcgggtacggcttatgcaatcgaccgtgatttactcgcacaagatcttggatttgaaaccgctactcgcaacagcttagacagtgtatctgaccgtgatcacgttttagaacttttagctgcggcttctattagtatgatgcacctttctcgttttgccgaagatctcatcatctttaacagtggtgaatctcactttgtcgaactctcagatcgtgtgacttcaggttcatcattaatgccacagaagaaaaaccctgatgcctgtgagcttgtgcgtggtaaaactgggcgtgtgtttggtgcgttaagcggtttattagcaactttaaaaggcttgccgttggcttacaacaaagatatgcaggaagataaagaagggattttcgatgcgattgaaacatggcaagcgtgtgtcaatatttcagcattagtgttagaagatattaaagtcgatactgagcgtaccaaagaagctgcacagcaaggttatgcaaatgcaacagaacttgcagattacttggttgcaaaaggtattccgttccgtgaggcacaccacattgttggtgaagcagtcgtttatgcaattagccagaagaaagcattagaagagctaaatttagataagtttaaacaattccattctgtgattaatgatgatgtttatccgattttatcgttagactcttgtttgacaaaacgctgtgccaaaggtggcgtgaacttagagcgtgtagctgaagcgattgctgcagcaaaacaaaatctaaatcaataataagaatagggatgtatcgttacatcccttttgtctatataaaaggagcaaatatgacaaaacaacttaccccagagcttgtattggtcgattacaaccaaattccagtacttgaaattgctcacccgaaagtgaaagcgaaggtggctttacaaggtgcgcatttattgagctggcaacctgttcacgctgagcaagatgttttttggctcagtgaagttgagccgtttgagcaaggcaatgctattcgtggtggcgtgccgatttgttatccgtggtttggtggtgtaaaacaacccccacacggtaccgctcgtaatcgcttgtgggagctatctcactatcaagtccaaacggatcaggtcaaacttgagttcagtttgtttgatgaaaaccagcaattagaagcaaaaatggagatggaactaggactaacttgccagttgcgttttacccatttagctcaaggcgaagcacaagtggcattacatagttattttaatgtcaaaaacattgagcaggtggaattgtttggcttaccagaacagacctttaattcccttattcagcaacagcaagcggttagttcgccacgcaaaattgcagaattagttgatgagatttatcgtgctaaccaacaaccaacgctgatccaagatcttggctattcccgtcaaatgatggttgaacatcaaaatgccagagaagtagtggtttggaacccgtggcataaggcaatgagcggaatgagtgaaacgggataccgcacgatggtgtgcgttgaaactgctcgtattcatcaattagtgcaatcaggtgaacaagttagcgtgaagattagcgtcaaatccctgtaatttatgatatgatttaccctatcaagcccgatagggcatttttattttgagagaatagtatgacaatgttaaaaaatgatcgttatttaaaagcattattgcgtgaacctgttgatatgacacctgtttggatgatgcgtcaagcagggcgttatttgcctgaatataaggcgacccgtgcagaagcaggggattttatgtcgttatgtcgcaatgcggatttagcgtgcgaagtgactattcagcctttacgtcgttatgcgttagatgcggcaattttattctctgatattttaactattccagatgcaatgggattaggcttaagttttggagcaggggaaggccctaaatttgctcgtccgattgagcgtaaagccgatgtcgatcatctgcctattcctgatcctgaacaagaactgcaatatgtgatgaatgcggtgcgtaccattcgccgtgagttgaaaggcgaagtgccattgattggtttttcgggcagcccgtggacattagcgacttatatggttgaaggtggaagtagcaaagcctttaccaaaatcaaaaaaatgatgtatgccgagcctgcgttgctacacgctctgttagacaaactggctgacagcgttattctttacctgaatgcacaaattaaagctggttctcagtcggtaatggtctttgacacttggggtggcgtattggcacaccgtgattacaacgaattttccttacgctatatgcacaaaatcgtcgatggcttaatccgtgaaaacgacggaagaaaagtgcctgtgaccttatttacaaaaggtggtggtctatggttggaagctatcgctgacacaggttgtgacgcagtaggattagactggacggtagatattgctgatgctcgtcgtcgtgtcggacacaaagttgcattgcaaggcaatatggatccaagcgtactttatgcaagccctgaacgtatcgaacaagaagtcaaagcgattttagctggctttgggcaaggctcaggacacgtcttcaatctgggacacggtatccatcaagatgttccgatagaaagtccgaaagtgtttgtggatagcgttcatgccttttcacagcagtatcacaaataaggataacgaatgagaaaccctattcataaacgtatcgagcgttttgaaacttggcaacatcttacctttatggcgtgtttatgcgaacgtatgttgcctaactttcaactcttttgcgaggtcagtaagcggtcagatgatgctaaaacttttcaaaatattctcaatttagtctgggaacatttaactgtcaaaggggcgaaaatcaattttgagaaccaactcgaaaaattggaagcgattattcctgatgtgaatgaatttgatttttacggcgtattccctgccgaagatgcttgccaagcattagcagaagttttacatagtattatcgccggagaaacattagagcaggcaattaaaattagccaaatttcactttcgactgtggcaacctatttagaaacacaagctgatcgcagtttaaatgaacaagaactgaaaaatgcaccagaaattcaagacgaattagatgtgcaatggcaggtttatcgtttgcttaatgaatgcgaagaaagggacatcgaacttatcttagggttaaaaaatgagattagaacgagtggaattagcaatgttgggttaaattttagtcaaaaaatgtgatttagctaacaatttttgcattatttgctttgagaatcgggcagtttgaattaagctacacaccgcattttgcaattttatttggcaattaatgccatcttaactgatacacatctttagaggataaaactatgaacaaaactgagttagtcgatgcaatcgcagcaggtgcagatttaagcaagaaagatgctaaagcagcattagaagcaactttaaacgcaatttctgaaagccttaaaaaaggtgattctgttcaacttatcggtttcggtactttcaaggtaaatcaccgtaaagctcgtacaggtcgcaatccaaaaactaacgaagcaatcgaaatcccagcagctaacgttccagcattcgttgcaggtaaagcattaaaagacttagtaaaataattcctttacaaagtgttttgctagaagcctagagaatatctaggcttttttgcgtttatcagattgtgattttccgttacaatagcgatatttgaaatacagataaacaaaacaatgaaagcatctattattaataaactagacagcctaagcgaacgccacgaagagctacaagccttattgggcgacgcaacaatcatcagcgatcaagaaaaattctgtgcttattccaaagaatactctcagttggaagaagtggttagcacctttaatcgttggaagaaattacatagcgacatcgaagaagcacaaatcttacttgatgatcctgatatgaaagagatagcagctgaagagattgaagcaaacaaagctgaaatcgaacagcttgagcaaaacttacaaatcttattactaccgaaagatccgaatgatgaatataactgtttccttgaaatccgtgctggcacaggcggtgatgaagcaggtattttcgcaggcgatttataccgtatgtacagccgctatgcggaaagcaaacgctggagaattgaagagctaagtgctaacgaaagcgaacaaggcggatataaagagattatcgtcaaaatcagtggcgaaggcgtttacggacagctcaaattcgagtctggcggtcaccgtgtacaacgtgtaccaaaaaccgaatcgcaagggcgtattcacacttccgcttgtacggttgcagtaatgcctgagttaccagaaagcgaaatgccagaaattaaccctgcggatctgcgtattgatacctaccgttcatcaggggcgggtggtcagcacgtgaataccactgactctgcggtgcgtatcacacatattccgacaggcattgtggtggagtgtcaagacgaacgttcacaacacaaaaacaaagccaaagcacttgcggtacttgcatcacgcattgtccaagttgagaaagagaaacaagctcaagagcaagcggatactcgccgtaacctactcggctcgggcgaccgctcagacaaaatccgtacttacaattacccacaaggtcgtgtaacggatcaccgcattaacttaaccgtttaccgtttagacgaagtgatgaacggcaaaatcgacgagttaattcagccgattattaccgaatatcaagcggatcagttggcggcgttgtcggatcagaattaattaaggaattgtatgagttatcttacatttatggatttttgctctggtattggaggagggcgattaggattagagcttaatggtatgcagtgtgttgggcatagtgagatcgatcctgaaccagatactacttatcagattttctttaatgatcggaacaatcttggggacttgacacaaattgatatccaaaaacttcctgactttgatgtaatgctggcaggatttccttgccagacattttcgatagctggaaaaagagaaggttttgaagatgatagagggcagattatttatcatctcgcggatattttaacgtggaaaaaagttccttattttattctagaaaatgtaaagggattagttaatcataataaaggtcagacactaaaatctattattcagttattagagcaatgtggttatgatgtttattatcaagtattagatagccaattttatggggttccacaaatgcgagagcgtatttattttgttgggatccgtaaagacataaagcataaaccttttgaattccccacccctgaaccaattaaagatattgctgaatgtttaattgaagaacgagattatatatttgatgaaaataatccgacttttcaaaaataccttcataataaatataataacaataaagtagaactgaataatatcttgcaaaaagattatcaagttattgattggcgtcaatctgattttagatgctatgaaaagaaatccccaaccttacgaacagggcggcacgggatcttatatacaaaagatggtaagttacgtaaattaagtggctatgaagccctgttactgcaaggatttcctaaacacattgcaagtaaagtcgtagaatataatatccctgaaaataaaattttatctcaagcaggaaatgcaatgacagttacggttattcagaaaattgctgaacaattattaaaggtaattgaaaaatgaatttagttgaattaggttcaagaacggctcacaatggttttaaaaatgaacaagatattgcggaacgttttaatcaatggcaatcttcattagaagcacagcaatggctaactataatgggctatgatttaacaaaaattatgtcggttaaagctattgtattgcatggctataaagcagatataaatgtaaaaatttttgtatttatgcaagaggctgttgatatacgtaatatccaagtaaaactagtgagtaataagaaaggatttaatcaaattgataaaagatgggttagaaattatcaagaaatgtggaattttgatgatcggctcttaattttattaaaatattttacaggagaattaccaccttatttaagtggaactaagagtaaaaaacgaatgtttattacagaattttctcttgaagaacaacatttgattttgaattggtttcaacaaaataaaattcttgtgctaactgatattattcggggaagaggagatttttctgctgaatgggtattagtagcccaaaaaatacagaataatgcacgctgggtattaaaaaatattaatgatgttctacagcattatggacaaggcgatattagtatttcaccaagaggctcaataaaatttgggagaattactattcaacgtaaaggaggagataatggtagagatacagctaatatgttgcagtttaaaatagatccaaccgaattatttgatatttaataaagaatatgacctaccaacaatggctcacctttgccgaacaaaccttgcttgaaaacggatcacaagatccgtttttaaacgccaaagccgatgccaacattctgctacaagcggtaacaaaacgttcaaaatctgcaatttttgcttttgccgaaacagaactgaacgaaagcgagctacgccaacttgccgagctactcgctcgccgagccaaaggcgaaccgatggcatacatcttgggcgaaaaagagttttggtcgttgcctttggcggtatccacggcaaccttaattccccgccctgatacggaacgcttggtagaagttgcgttggaatgggcatacaagcggttagattcaagtaaaaatttgcaaattcttgatcttggtacaggaacgggggcgattgctttagcattagcgagtgaattgggaatgaaagcagagattatcggggtagataaacagcctgatgcggtgcaactggcagagaaaaatcgccagaaattaggatttgaaaatgtccgctttttacaaagcgattggtttgaagccttgaaaaatcaacgctttgatcttattgtgagtaatccgccttacattgataaagacgatgaaaatttaacacaaggtgatgttcgttttgaaccattaaccgcactggttgccgaacaaaacgggctgagcgatttgcaaaaaattatccaaaacgcaccgctttatttaaccccaaacggggcattaatgttagaacacggctggcaacaagctgcgagtgttcaagatattttccaacaaaatcaatggaatgcagtcactacgttccaagattatggcggtaatgatagagtaacagtagcaatatggacaacataattaacgatattttccaagagattaaaaagcctaaaagcgtggtaaataaagttcagcttcagaaatttctttaccgtgagttagttcgcttaaccttgatgattgacgataacctgtctgaaccgcaggtgttaggcttgatgtcggcacttgtaaaaagagctcgctatgatgtgaatggggaaagcgatgaagaacgtttacaccaactattgagattggtttatcaagaatggggctttcattgtcatcacgccgagtatttctatacagataacttattgattaataaagttattcgcaaattccgtggaatgcctgtttctttaggggcagtggtgctttatttagcagcttcactgaatttacctctatatccggtcaatttcccgacacaattaattttgcgtgctgaattgaaaaatgagcaaggcagaacagaggtgaaatttatcaatccgtgggacggctctgagctaagccgtgaaaaattggaaaaatggctcgaaggggaaatgggttatggcgtagaattaaaccaagagtatttgcgtattgcggaagaagatgagctattagagcggttagaaacggtatttaaaatggctttaactcgtgaaggtaaatatgaagaagcactgcgtttaatcgaatatcgattggctattagtcctgaagatccgtatgaaatccgtgatcgtggaatgattttagcgagtatggattgctatcaagcagcttttgatgatttaagctattttatcgatcaatgccctgacgatccttctgcaatgatgttaaaacttgaaattgcagggcttgagaaacagagtaaggcgagtgttttacattaaatacaaacattctctcccgcttgcgggagagagacagctcaaaatagcgtgaggctattttgagcagagagagggcgcaagcggttagatttggtgaaatatttgcaaagccctctccctccgcaaattctgcgaatttgctccaccctctcccgtaaacgggagagggaaatcatatttagtttgcgaaattattaaggatttcttatgcaacaaaaaacaatctctctcggcaatatcgacattgcaaataacaaacctttcgtattattcgggggaatgaacgtacttgaaagtcgtgatatggcaatgcaagtctgtgaaaaatatgtcgaagttacgcaaagattagacgtaccgtatgtctttaaagcttcattcgacaaagcaaaccgttcatctattcgctcttatcgtgggcctggtatggaagaaggtttaaaaattttccaagagttgaaagacacattcggtgtcaaaatcatcaccgacgtacacgaaatctatcaatgccagcctgttgcagaggtggttgatattatccagctacctgcattccttgctcgtcaaacagatttagtcgaagcaatggctcgtacaggtgcagttatcaacgtgaaaaaaccacaatttttaagcccaggacaaatgggaaatatcgtagaaaaaatcgaagagtgcggtaacgataaagtgattttatgtgaccgtggtacaaactttggttacgataacttagtcgtggatatgcttggttttaacgtaatgaaaaaagtgtcaaaaggttgcccagtgatctttgatgtcacccactcattacaatgccgtgacccatttggcgcagcgtcaggcggtcgtcgtgatcaagtaacagaacttgctcgtgcaggtatggcgattggtttggcaggtttattcctagaagctcacccagatcccaacaaagcaaaatgcgacggtccatcagcccttccgttgtctaagttagaagcctttgtttcacaaatgaaagcgatcgatgatctcgtgaaatcttttgaagagattgatacgtctaattaagtttatctgtaggggcacactacataagcggtcacttttaggaaaaattttgcaaatgtgaattgggagaataaaaatgaaacagtccattcgccacaataaaattatcgaattggttaatcaattaggctatgtcagcacggaagagcttgttgctcaattgaatgtgagctctcaaacaatccgacgtgatctgaatgaacttgccgaaaatagcttaattcgccgacatcacggcggtgcaggtgcgccttctaccagcgaaaatagcgattacattgaacgtaaacagttcttctctctgcaaaaagagtgtatcggaatgaaagtcgctgagatgatccctgatggtgcttcactctttattgacattggcactacccctgaagcagttgcctttgcactactttcccataaaaaccttcgaattgtcaccaataatttaaacgccgctcatatccttaaagaaaaagaagattttcaaattacaattgcaggcggtggtttacgcaccgatggcggtattattggcgaagcaaccgtcaatttcatcaatcaatttcgtttagattactgtattttaggcattagtgcggtagaatctgatggttcaatgatggattatgattaccacgaagtacaagttaaacgtgcgttaatgcgaaatgctcgcaatgtggttcttgtttccgatcattccaaatttgctcgcaatgcgattgtgcgtttaggcgatgtcagagaagtgaattatctctttactgatcgcccattgccaatagaattgcaaaaccatcttattcacagtgatgtcgctgtgcatatttgtaacgaaaaataagaatgaaatcacattttagtcaagacaaatggttggcttatatgcaattaatgcgtttagataagccaatcggtacttttttattactttggccgaccttatgggcgttatttgcagtggcagatggcgttccgcctttacctattttaatcatctttgtgcttggcgtaattgtgatgcgtgcggcaggctgtgtcatcaacgattatgctgatcgctatattgacggtaacgtaaaacgaacttcacaacgtccacttgccacaggcagagccacagcaaaagaagccaaaatactctttgccacactgatttttattgcctttctgttggtattacaattaaacctttatactcttggcttatctgtgattgccgttgctttagccactgtttatccttttatgaaacgttacacacatttaccccaatttgtactgggaatggcgtttggttggtcaattccaatggcatacggagcggtaagtgaaaccttacccctaaagtgttggctactcttttttgctaatcttgcttggacggttgcctacgacacccaatatgcaatggtggatagagatgatgatttacgaatcggtgtaaaatcaactgcaattttatttgctcaatacgacaataaaatcattgccttattgcaagcaactgcattagtcctactcacgatttttggaaaaataagccactattcaaccgcttactttattgcattagggctaactgctaccttatttatctaccaatgcaaactcaccaaacaacgtgaacgagaagcctgtttcaaagcctttttaaataatcactatgtaggaatggggatctttatttcgattttaatcggcatttacaccgcctagtattgaaatagtgttgaaaataaaaacaaccgattgaaaccacacgatttttacttgcaaccttaaccgaagccccctataatgcactcattcagcttgccagtgtggcgaaatcggtagacgcagcggattcaaaatccgccgcccataaagcgtgtcggttcgagtccgaccactggcaccaacattcaattaaaccgctttttagcggtttttttatttcttattttttcttacattttcatacaatagcaccttaccgcacaaggcttcaagctactttctacttttcctattccttcgtgttcgttcgcatttatacatttacaaccgcaaattttaggggtatatttaggggtatgaaatccactttatacccttaaatctttttttagggggaacgtacccctaaaaacacgttaaagctaggtagaacgtatggcaagacctgctaaagagcttcataaaaccacaatacaaaatgcaaaacctgccgaaactgattataagatgatggacggaaagggactttttctattggtgaaaaaaaatggttccaaaatatggcggtttaggtatgttcgtccaaatacaggcaagcagactgatttaagtttaggcgagctaaaaaacctatcactagcacaagcaagagcattacgagatgaataccgcttgcttatttccaaagggattgacccacaaattcaccgtaaagaacaagagcaagcgaaacaactgcagcaagaaaacagttttttaaatgtgtgtgagcgttggtttagagatatttaccctttaaaagcccacaatgaagaaacgaggcggaagaattgggagcggttagaaaggcacgttttccctatcattggcaatttaccgctggaagaaatcaaacctcgattgttggtggggctgtattctcaaattggggcaagtaatacgctagataaattacaccgcttgattaaagccacaatggatcacggcattaaattaggcattatcgaaagccacaattgcaacattgcaaaagatgattttgttgcaccgctggcaaaaaatcaccctgcgattatgcccgatgaattacccgagctattaacggcaatgaataacgcctatttaagcaagagaattaagcctaatacgttactagcttttaacctgactatgcttacaggcttaagacaaaccgagcttacaaggcttgaatggcggtttattgatgaaagtgagcagtattttattattccagccaagcgaatgaagcaatctaggaagatgaaagagcaaccgatagatcacattatcccgatttcgtcacaaatggcacggttactagccacaatccgccaaagatacggttacagccgttatattttcccgagtacagaaagcaacagcggaaccattggcaaggacaccgtagcaaaagcattaagagaaaacggctacgagggcaagcaaaacgcacacggtatcaggtcaatatttagaacctatttaaccagcataggcgttcccgtggtggttgctgagcttgctctagctcaccattcaataggcaaggagaaaacgcaagcagtctatgaccgttggcaatttatggaagaacgaaagcaagcattacaagccgttggcgattattgcgaacaatgcggaatgatgtttgaaattgagtaaataacagatttttggcggaatttaaccgcttgtagatgagattaaaacaatatggcaaaaacacaacattactataattctctacctgaatgttcaatcgttgattatgagcttatcccatacacggaaggggctttattgtggtgtggtgtaaaatttaatgatttatcagatgaagtaaaattgacgtcaagaatatcacaaagcatttacaagcacccatatattccttgtttagagaaaaaaactagaatgctaaataaggcaataaatgagggtaaattaagagttgttagagaacacggagagggtggggaaattcttactgactatctaggcaatataagaaaggacaataacggaaaccctatgattgatcacgttgcttatgatagacgttatttttggattaaagatttaaaagcctttatttctgaacattacccaaatgatcgccctaaaactattttccacgatgaagaactaaagccgattgttgatttagttgaatatgaaagaatgagtaaagaatatcaaaaattcttaactgaaaataccaatctacaaactaagttaaatgagctaagaacactactagagagcaaagaaagccaaaacagagatcaagacttggcactacaatcattatcaattcagttacagcaagccaaatcatcacaacaagacgctgaagaaagattagaaaaagggagagaactttatcggaaattacaagcagactataacagacttaaaataaatcctgaaacgaatttaaacctagataattcactctacttgctaggagaagttttaagcatagtgaaatcaaaagtcaaacaatggacgcaatccgcaattatcgatgaaattctaacgcaacgacaagagaagcaaataatcggtttagaacagcgaaaaatagaagaatactttagtacagctaataaactttttaaagccaaataatcccatcaacgcccagcaaaagggcgttttttattccccaaaaccctttcaaatcaacctgttattttcgcaacgaaaaaatctttttcgcgtgcgatgaagtttttaccccacaaaaacacaatacgccccgaatgcaaaaactacaacgcaaaggagcgtaaaaaatggaaacattaaacccaacccaaaccacctatcaaaaacaattgattgatgttcaagaggtgaaagctatcacagggcattcagtcaccaccatttacaaatacgttaagcaaggcatttttccacaacctaaaaaatgtggccgttccactcgttggagattggcggacattatggaatatgtaaacagctaaggcacattcacgaggtaacatcttatgaaacaacttatctacccaacccgaaaagcaaaatctatcaccgcactactagaacacccacaaggaattagcgggcgagagattgactttaaatacttcatcaatagcggacgcaatgaggtgacggaattaccaagactacacaatatcgccattcacaaaaccgaaagaccaaaccaatacggaacagggacttacaccatttacagcttccctaatgcaaaagaagccttgaaagctatcaccttgctaaatggtgagcgtgctaaatgtggtttaccaatgctgactgagtatgaaacacaacgctatttatcacagtttaagggggaagaatgcgagtaaataaaaacctgctcactgagcaacaggagcaaatcaacgaagcgattaaattattagaagcctgtatctacggggcagtattaggtagcgagggcgagccacttacacaaactgaaatcattgaagcagtgattaaaatactgaaaggagaaaatcggtactacgctgaagaggtaacaaatgaccgcagtaattaaatgcgtaattgccaaaatgaaccctcttgtaatggatatggcaattaagtactacattgaaaacggctctaaaacgcctctattcacgtttaagagcttgtattcagatgatgaaccttacccattagatgaattgctaatcgtgttatctgagcgaatagaaacgctagcaagggaatttaacgcaatgccaagtgacaacctattacttcagctatcaccactacggaagaagtttaatgcgttatacaaaatttcagttaaggggcaaaacaatgacaaataacgaacaagaaaaaacacttaaatatgacctatcaccccaagggattggcgagctaatgaaagcaccgattaaagcaacgttaagcagtttagattttccctatattcgcattgagcaacaacaagacgacaacggcaaaccgttttatatcggtattttgtggttagaaatgggcgatcaaatcataattgaaatggcgggagccaccgcatttaaagaagctctagcaattattgcttatcaacaacaagccacccaaacaccgttactgattgatgatgaagtggcggacagtatcagatatttctacgagcattctcaatacggtgacggcgtaaatccattgattgaacactacacaggtaatgaaatcacgttggaaatgatggctaaggctaatcgcaaacaagtagatttgctctttatggaaaaacgcattaagggggagcaatgccaaccttagacagaccaaagcaagaaaattttgctcagtattttgttgaaactggcaacgcaagcgaagcctatcgcaaggcttataaagcggatggaatgaaacccgaaacggttcaccgcaaagcaaaagagctaatggataacggcaagattacggcaaggattgaggaactacaagctgaacacatagagcgacacaaactgacagtagatgatttactagatgagctagaggtagccagagaaaaggctttagaacgtgagcagttaagcgttgcagtatcagccacaatgggaaaagcaaagttactagggttagataagcaagttatcaaccatacaagctctgacggctcacttcgccctacggttattgagttggtagcaccaaatgaaagtacagcctaggggctttactcaaaaatgagaaaaacactagaacctgagaaaacctgagatttaatgaactttcgccaccttaattttaaggaggctaaatatatcgacgaacaaggcaaagctagaacaatctgccttgtatttcttacgcaatcatttgacaatggtggcataaaacaaaaccccttagcctaaacactaaggggcaatggggtaacatacttatgaaaaaccatattgtaaacatcaatagagatattactctatttcatttaaaaatcaatcttaatgaaaacatttcactttacaaaatgctaagtgagatttatcctgcccacgttgtagcaaaatctacaaccgagcctgagaactcgaacgatttactaatggcgaatagcacgccccgagcgtgtttttttattcgtagcacacgcacacccaaagaacgcctagagcgtctatctatggtagcgtgtaatgggaaaggtttcgccctttgctgtgttccattagtcgcagtttctcagcccgttacacgttaccgcccaaaccctgagaagtttagcggtagccttcataaatcactaatggagctatcagcaatgatctacaaattcctatgcttaaaccgtactaagcacacctacaaccaagaaacgttatacattcaagccgacagcgaagagcaagcacgcttacagctatctgcggattatcgcctattgcttgatcgtcctattgcaaaattccgagcaaatcataccgcttgtcaccaagtaaaaggaggtatttatgcgtaatcaaaacaaaatcacaacccactacgccgcattaaatggcgtattggcattaatgagcaaaggcttagatgatttagcggaggtttaagatgaatagcattcagcacattaaaatccctttatcgttattagaccgaatgaacatagaccacgcacgcataaacgcccaaattaacgcaatggcggataatccgaccgcttacacaggcgaagtattaaagcacgctctaaacgttattcagtggcatttaggcgaacaatcggagcagttagaggtattacaaagacacgcccacagaattaatcaactgattgataaaacggacgagattttaagcagggggaatgtatgaaattaaaaaacgccccaaatatgaaacagcaaaaacctaatgcggagaatgcctatatcattatcggctctcaagcgtgggattttgccaaagctccaccagctgaacgttcacaggacgagatagcacttgatgatgtgttaccacagggcgagaaatcgccccctattgtgctgacaggtgaggttttggaaaacgttcatcaacaccgcatagcacctaaaaaggcttatatcatcacgatacagcgagctaatcacggtgaagatgtaagcgatgagattatgaataaactttacttaaaccttgcgaaaaatacaaaggctaaaatcattcattacattgacgaagccgagcaacaccttgaagatttaagcggatatatcgaacgcattcgacaaggtgaagcaatggcggaaaacgtggcggaagtgaccgctagcgatgatgtgaatgctgacatagataaacataagccttatgtagaaaaacgcacagaaaacggcgtagaggggctttatcgcattaccccgaaatatgacaaggatacaggcgaactgctatcagagcgtacagaatggctttctgatgtgatttctgtagtaggtatagggcaaagtgaagctgaacattatctcgtgctagagtggacgcctgagggcaaatcgcaaccagtcaaagaggcgttatccttgggggatttaggcgaacgggagggatggcgacagctcaaagcaaaagggctacgcttaactactcgcacctacctacgcaacgagctagcggactatttacaaagtagcggtaagcgtaccctatggcacatcaccaacgctacagggtggcataatggggcttatattttgccaaatggggaagtattaggcgaacctgaaacacccgtgctatttaatcgtcaatccgccaccgccagtggatacgacaccaaaggcacaatagagagctggaggcaagagatcgccgataacgtgctgggcaatccttcaatgatgttaggcgtggcttgtgctttatctgccccgataatgaacatcatagaggctgagagctttggagttcacttattcggtggctcaaccgcaggcaaaaccaccaccgcaaacattgctagtagcctatacggacaccctgacaaaattcgcttatcgtggaatgcgacagggttaggtttaattaatgaagcctcagcaagaaatgataactttatgccccttgatgaaatcgggcaaggctcaaaccgcaagtacatagagcaaaccgcctacgctttatttaatggcgtggggaaaatacagggagcgaaagacggcggtaatagagagcttcaacggtggcggattatggcattttcgacgggtgagattgacctagagggctatttgtcgatgggaggcattaagacaaacgcagggcaattagtccgcttgttgaatgtgcctatcacaagggcgaaagtctatcattcattctctgacggcaaggcacacgctgaccatttgaactatgcgagcaagcaacactacggagccgttggcagggcgtggattgaatggctaacggtggcggacaatcagaaaacactaattagcgttcatagccaaataaaagccaaatggctagaccgcttaccaagcgacgcaagtccacaggttcaacgagtggcgagccgttttgctatccttgaaaccgccttacaattagcgagctttctcacagggtgggacacttccgccaacggtgaagccttactacattgcttcaatgaatggattaatatattcgggctacatagccaagaagaaaagcaaatcattgagcaggtgaacggctggctattagcaaatgctgaggggcggtttatcgaatacccaaacaaccccgaacagcgagccatctcgaatatcgcaggctataaaatcattcctcaacgagataatgagatagagagcttttatctgtatccattagcttttgaggaagcgataaagggacacccaaaggagcaggcttgtaaaatcctatcagacaaaggaatgctatctaagggcgaaaatggctatagatacttagtaagaataccaagcaggatagatccgaaacgtacaagatgttatctcgttttcccacttgttgaaagtgatgaagcataaaaaccataacaaaccatatcattaagtgctttttgtggtctgtatgctacattgatgatttaagagcttcccagagatggttagctcttttttttacctttgcaaaaaaattttttttcatgcgcgtagttttttagtagtccaattagtccaaaatacctattaaaaaaataatatctttatttatcaatatattacataaaattcattggactaatttggggtcgttttggactaattttggggcattttggactaattttggggcattttggactactcaaaaaatgaacaataagagtattttgttagttttggactaattttggactacattggactactaaattagtccaaaaaatgccacttaagtgtttgattttaaaggattggactaattggactaattggactactgttttttactaaatataaaaaaaatttttttgaaagcgtaaaagtggcggtggggtggcgttttggtttctgcggataatatccctttttatgctacacatttttgggggcttttcggagcagtacgcacgatgcttggttaggttcgatcattactaataaataagataattataagataaagattgaatatatttatagagtatcttataattattctattgaaagggtaatcttaggggttataaaatggctgtgattagatgggcaagcagggcaagcaaacagataagaactattgatagccgataccttgaccgaattattgaaaaaatcgaagcgttacaacaatttccaaatgttcaagcagatattatcgaactgaaaggcgagcaaaacaaaggcaagtttagaatgagagtgggattttatagggtaatttttaaagtagtgaacaataaaccgattattatcgaaatccaagagattaagaagcgagacgagcggacttataactagagctataaaacacaggagcaagaaataatgagcaatttacaatatatcagagataacagcggtaagcctttatatgtgattttacctatggcggaatatgaaaagttagtagatgtagacgagtacggctttaggatagaggaggatgacgaagaatgggaaagcctaccctacgagcaaagcgataatgacgatgcgttaattcctcatgaggttgttatgataatgattaaacataacgtaaaccatttaggagcgtggcggatttatcgcaacctatcacagcaagaagtagcggacaaagtggggatttctcaaggggctatttctcaaatggaacgaagcgacagcaagccacagaaaaaaacgctagaacgcttctcaaaaatctatgattgcgatgttaagcagatgtactaaataataagccttacattttttgaatgtagggcttttttgtgggctttaagaattaggggctttatacaaaattattcataggaaatataattatatatttgctccaattaaaaaggtactcccgacggggtggggctttccacggggttacgggctcgtggttttcggcaatttttcggggttctagccatcatcatcttttgattaaaagtgaatagttatgcctagaatgatggcggtagatgttgaatttgctgatactggttttcttcagtctcttaaaattgcaaggcgtgttattttaagtaaatggattatcctaaaattaaatcatttcctcaattttgaggagatgacaccgaagcatagttatatcaccatagtaaaaagtgaactttcttcacctgatccgccaatttaaaaacaaccctatacaagtgataaacttcaaaatgctgtagtgtttagtcgctaaaaatgattaaataataatctatttataggcgtttttttattataggggtacgtttaggggtacgatttagggtttaaatataaaataaccttttatttcaatatgttacattgcttgaatgtatccgaccactgcatcatcttagactgcacaaaaaaaacaaatttctttactaattaaaatggagagatttgtatgccacagtctatcaaaccgtttattgttacagtaatgttcaaaggtggagtaacaaaatcaacgaatgttgcaaatataggtgctttctgtgctgatcacggtattaaaaccttaatgatcgacactgatgttcaacctaccctatcgtcttattatcatattgaagattctggaccttttggattgtatgaatttttcactcgtcctgatcttccattaaaggagattatttctcggaccgaattctctaacttggatttaatccaatctaacgatccactagataagctctctaccgatcttacaagtacacctggaggtatcctgaaatacaatcaatttgttaaaaaattgatggctatgatttaatcatcattgacactagaggtacacggggcattacggttgatatggcagtccttgctagcgatcttatcctttctccactaagaccagagttggtatctgctcgtgaatttatgtgtggtaccttaggtatatataaaaatctaaacatttttacagactactgtactcttatataaattcgtgcggttaacatttatgtaccttcatttagatctataaattatgcctgtaccatttaactctatttaattgctatatggtggtagtatttaagttatggggctgtcctagataactaacttaaactgcccttaaccaattgttttaaaatggaaatttgagattttaagttactgtgattaaaacgccattcgcattccttcaaaggctaaagggctaaaaggcttgataaaacatctaaagtgtcacacaatattatcaagcgaatatttgaactataaaaaagaatgacaaaaaaatttcatatagaagccatacagaagtgggaatcacaagagttcgagaatacctcttttgatatgagtcatcttaatgcacacgaactaatcattcatagtaaaaaaatggattataaactcgttgttacttacggattgcactgttttactaagaatgattcaccattttcactacctatattagtaaaggattcttctggagatactcgtcaatttgacgttgaaagatacttagcatctaaagagttgaagaatatattattttccgaagatattttaggacagttgagattttataaaagtgatcaaaaacggtatttcacgattcataaaatgaataattttactagagcgtgttgatcttttaagtacaaaaaacaaacgacatagaaatttggtataatttagttcgccaaaacctaaccatcccatacaaactatgtcgcttagaacgattttaacagataatctttggaaacgcctagcttattttctcgaccgtacaggacatgtttataataaacctgaacatcgtaatacagtggaagggattttatatcgcattcgtacgggatgcccttggcgtgaatagcacaaaaattcatttagcggtagatagttgtggaaattctattgattttgttctgacgggaggtgaagttcacgacagtaaagctgcacctgagcttgtggaattgttacctgacagtgagaccattgttgcagacagaggttatgattgtgaagccttacgagcgcttattttgacaacaaaagcagttccggttatacctcgtagacgaaattcaaaggtgggtaatgatgatatagactggtgtttatatcgttatcgccatttagttgaaaatgcgtttgttttttaaaacaataccgagccattgcgactcggtacgataagttagcaagaaattatgcggcatcgctagcaatgatttgttgtattcgctgggggaaattgttgtttggttaagatttaaactcaaaagatcaacagcccctaataaattatagaaacacaacatcaaaatttggagagattatttatgcctaaattacgttcggcgaccagcacacaaggtcgcaatatggctggcgcacgtgcattatggcgtgcaacgggaatgaaagaaaatgactttggtaagccgattattgcggtggtgaactcatttacccaattcgtaccaggacacgttcatttgaaagatatggggcagcttgttaccgagcaaattgagaaagcaggtggcgtggcaaaagagtttaatactattgcggttgatgatgggattgcgatggggcacggcggtatgctttattctctgccgagccgtgatttaattgctgatagcgtggaatatatggtaaatgcacactgtgccgatgcgatggtctgtatttcaaactgcgataaaattaccccaggaatgttaatggcagcgttacgtttgaacattccgacaattttcgtttctggtggcccgatggaagcagggaaaactaagctgtccgaccaaatcatcaaattagacttggttgatgcgatgatccaaggggcgaacccgaatgtgtctgatgaggtaagcgatcaaatcgaacgctccgcttgtcctacttgtggatcttgctcaggtatgtttaccgcaaactcaatgaactgtttaaccgaagcactgggtttaagtttaccgggcaacggctcttgccttgcaacccacgctgatcgcaaacagttattcttagatgccggtacgcaaattgttgagctgtgcaaaaaatattacgagcaagatgatttgtctgtattgcctcgttctattgcaaccaaagcagcgttcgataatgcaatgagtttagatattgcaatgggcggttcaaccaatacggttttacatttacttgccgcagcacaagaagcggaagtggatttcacgatggcggatatcgatcgcctttctcgccaagtgccttgcttaagtaaagttgcaccgaacacgcaaaaataccatatggaagatgtacatcgtgcaggtgggattatggcgattttaggcgagctagatcgtgcaggcttattgaacaatcaaactcgcaccgtgttaggcttaagccttgcggaacaaattgccaagtacgacattatgctgaccaaagatgaagcggtacataaattcttccgtgcaggtcctgcaggtattcgcaccaccaaagccttctcgcaagatacccgttgggatacggttgatgatgaccgtcaaaacggttgtattcgcagcaaagagtttgcgtacagccaagatggtggtttagcgatgttgtcgggcaatatcgccttagacggctgtatcgtgaaaaccgcaggggtagatgaggcgatcttaaaattcaaaggcgaagctattgtgtttgaaagccaagaagatgctgttgcagggattttaggcggaaaagtacgagcaggacacgttgtggttatccgctacgaaggcccgaaaggcgggccgggtatgcaagagatgctttatccaaccagctatttaaaatccatgggcttaggcaaggcttgtgccttattaacagacggtcgtttctctggcggtacatcaggcttatctatcggacactgctcaccagaagcagccgcaggcggtttaatcggtttagtgaaagacggcgataccattgaaattgatattccaaaccgtaaaatcgaactggttgtgcctgaagctgagcttgcccaacgccgagcagaacaagatgcgaaaggctggaaacctgcaaaccgtgagcgtgaagtctcttttgcactaaaagtgtatggacattttgcgacatcggcggataaaggtgcggtaagagataaaacgaagatttaattaaaatacaagcggtgggatctttttataaaatctcaccgcttctctctacaatctctcccctactgatacgaagaagtaaaagtcgtcaccgcttgcttccaacacttcaacatgcaactcactactatatcctgtcgggtttaaatctgaaatttcaaaagcaccagcagggacatttaattgacggataatatgcccattctggctaatagttactcttgcattactatgggcaatccctctgacagttggagcgtatcctctcaaggaagttggcaacatgcgatcatcacttgccagacgcacgccacgtagccctatcgcctcaacgacagccccatctgtggtaaaatctcctaccgtaagctcgcttcgcaaagacacaatgggacgttttacataggtcgcaatacgatgataggaactctctcctgaactatcccaacttttcgcaccaacatgccgaaaagcccagtcccccaaatttattcccccattcaaagcaagatagtgctgtttataagaggtattgccataatgttgatagctattcaaatcataattaagaaaagcaacaggtactcccgtttgccataaatgtggagaaatatagcctctaggacgttgtacaacataaatttgcggaatttcaagatgaagcctagacaccgtataatcaaatctgaattttccccattgttaaaaagctactataaaactcagcttcaacccctttattcaaaacagagttaacatcatttgcaacaacagtagggcttaagcctaacagcacagtgagcattgccagtcgaaaaggaacaggttttattattattttcttcattttgacaccatctctttatttcatcatgaggaactaacgcaacactgcttccccttttctgttccgccaaaatcattaattgcttcccaattcactcgactaccactaactttcccttttaatatcaaagttttactagaaaatggtgcaaccatttcgctattaggcaaataagcatttcccaacttaacagattgataggtaataaaataaggtgtctgattatcgacaacgacccccttcgctgtcttaagccattgcactgactgataaacatcataagggctaagagagagcagggcgatagaaaaacttaatacgagaacgaatagcaaattgcagataattagtccctaaatcctccgctttaggtttaggcggaacatctaatacattcaaataaaataacgtttcacgatcttgaggcaaattttctttccctgtaaaaaccactcgcaacgtttgtcctgcgttgggctcgatgcacacaatgggaggtgttactaaaaatggaacctgaatactatttggacggctgttaatatccccacgatctaaccaagattggactaacgcaggatctgagctactgttttgcaactgaacattgacactcttttgctcctcaggaaaaattactctagtaccaataatcaccacatttgccgtcgcaaatgtcatatatctgctctataacacttgaaaacatataaacaaaccgcgtttgatacatcacatttaaaagttaaaaatgaaatgtatccaagcgagtattctaccccccccccccccccgccaaacgtaaagaaaaaatgtcaaaaatgtgaagtatgccacattaaaaattcaaaatatgtaaaatttagatcaaaaatagagcttttaagataaataaattgacaaatcataagattaagtaaaaagataaaataaaatgtaatacaacacatcaagtcgcctacaaaacataaatcaaactgacattatattaaaaacgaattccgattattgatagagcaataatgttggcttaagacaataaaatatagacatcttccttgtgaaaattcccctttttacctacaatatcgccctttatttattgaacaaaaactatgtcgcaaattaaattgattgtcgggcttgctaaccctggtgcaaaatatgaagaaactcgtcacaatgcaggcgaatggctagtgaacgagcttgctcgtatgtttaatgtcaccttaaaagaggaagcgaaatacttcggcaaagtcgctaaaattaacacgccacaaggcgaagttcgtttgcttgtgccaaccacgtttatgaatttaagtggtaaagcggtcggttcgttagcgaatttttaccgcattaagcctgaagagattttagtcgctcacgatgaattagatcttcccccaggtgttgccaaaatcaagcaaggtggcggacacggcggacacaacggtttaaaagacattattgcagcccttggtaatagcaataatttctaccgtgtgcgtatcggaattgggcatccagggcataaagacttggtggcaagttatgtgttaggtaaaccttcgccgtcggatcagcctttaattaatgtagcagttgatgaagccagccgttgtgtggaactgctgttcaaagaaggaattgttaaggcgactaatcgcttgaatggttttaaagcgtaaaattgattgaataacttttttgtgtgtaaacacagttgctacataataggaaaataaaatgggatttaagtgtggtattgtcggtttaccaaatgtgggtaaatcaactctttttaatgcattaaccaaagcaggtatcgaagcggcaaactatccgttttgtactattgaaccaaatacaggcgttgtacctatgccggacccacgtttagatgcgttagcggaaatcgttaagccagaacgtgttttaccaacgacaatggaatttgtggatattgcaggcttagtggctggggcaagtaaaggtgaaggtttaggtaataaattcttagcgaacattcgtgaaaccgatgcgattggtcacgttgttcgttgttttgagaacgatgatatcgtacacgttgctggcaaaatcaatccgcttgatgatattgaagtgatcaatacggaattagctttagcggatttagatagctgtgaacgtgctattcaacgtttacaaaaacgagccaaaggtggcgataaagacgctaaatttgagctgtcaattatggaaaaaatcctaccgactttagaagctggcggtatgattcgctctgttgtgctggataaagatgaactgcacgcaatcaaaggttataacttcttaaccttaaagccaaccatgtacattgctaatgtgaatgaagacggctttgaaaacaacccttatttagaccaagtacgtgaaattacagcaaaagaaaatgcggtagtcgtgcctgtttgtgctgcgattgaagcggaaattgctgaacttgacgatgatgaaaaaatcgagttcttacaagatttaggcattgaagaaccaggtctaaaccgtgtaatccgtgcaggttataagctattgaatttacaaacttactttaccgcaggcgtgaaagaagtgcgtgcttggacggtgtctattggtgcaacggcaccaaaagcagctgcggttattcataccgactttgagcgtggctttatccgtgcggaagtgattgcctatgaagattttattcaattcaaaggtgagaacggcgcgaaagaagcaggtaaatggcgtttagaaggtaaagagtatatcgttcaggatggcgatgtaatgcatttccgttttaatgtttagtctacttattcatcttttgagtagattagttttcaaaaatatgtaacaaaaattttttgcaaatctcaccgctttcctttataatcgccagactttttggggctgatcttggattcgacgggattagcgaagtccaaggtgcacgtcgaggtgcggtaggcctcgtaaacaaaccgcaaaaaatagtcgcaaacgacgaacaatacgctttagcagcttaataacctgctcatagccttatcgcctcagcttccgctcgtaagacgaggagttcgataagtcacccaaaacgagatcgtgtggacgccgccgtttgaggatcgaaacactaaattaaatcaaactagcttattctttgcgtgtctgtccgctgggggtaagcgaaattaaagactagactaaacgtgtagtgctgaagatggagtaatttcggacgggggttcaaatccccccagctccaccaaatcgacataaaccaacgtaaacgaacgtaacaagaagccttgaaaatcaacctttcaaggcttttttgtttctctcaatgtaactcgacgtaaacggaaataatagacttttagtaggatcactctgacatatatcaaaagccgtcctactaaggtgacagttatggctagaactacaaaaccacttacaaacacagaaatagcaaacgccaaacccaaagataaaaaatatcctttaactgatggcggaggcttgtttttacttgtaaagccaaatggggcgaaattatggcgttttaattactataaaccatacacaaaaaatagaactgaaataggcttagggagttatcctgatgtaaacttggcaagagcaagggaaattagggaagaatatagatctttgctttctcaaaatatagacccacacactcaccgtcaagccatagagcaagccaaacagacagaaatctataacacctttgagaatgtagcgtgggcgtggtacgaatggcgacaaacacgggctaatttctcgcagggctacgctagagatgtaaaaagtctaattgagcgaatactattgccagcttttggtaaataccctattacgcaaatctctgctccaatggctttaaaagccttcaaacctttgcaagaaaagggcacgttggaaacgttaaagcgtgctattcaaaagatgaatgaaataatgacgttcgcattgcatagggaaattatccaacacaaccctttaatcaatatttcaaaagaatttgatagccccactgtagagcattttaagacgatcaaacccgaagatctgagcgagtttttatttacgttgaatacgtctcaaattcagctacagacacgctatttaattttgtggcagttgcttactatgacacgcccgaatgaagcggctactgcaaaatatgaagacatagacgaaaaagaaaagatatggacgatttatatcaataaggggattaaacaagacgataaaggacgagagcataaaatcacattatcccgacaagctctagccttgttacgagagattaagaaattcagtggcggtaaggtttatttattccctagccataagaacccacaaacccacacgaacacgcaaaccgccaatgcggctataaagcgtatggggtataaagggaagttagtagctcacggtttacgcagtatcgcaagcacatacctgaatgaaaaaggttataaccctgagctgatcgaagtggctctatcacatataaaccaagaccgaattagaatggcatacaatcgagcggactacatcaaacaacgctttgaaatattgcaagcgtgggcggattttatagatgagtgttctcaaggggcattaccccagtatcatttaaagaaagtagcctgatgatgtttaagcctagttttacagctaggcttttttattacttttttctgcaaaacaaatgttattgcttagtctaataaacaaccttgaaactgtttaaaaaatcagtaaaataactctctaatcataaacgggcgtaaacgattgtaacaaataccacaggataaagcataatgttcaacgaattaaaaacagcacaagcaggggcatacttgctacataaagcaggcggaacaatgcatcacataaaattgatgaaattgctttatttatctgatcgtttaagttggttagaaagagatcattctattacaggtgatgaatattactctttaccttatggacctgtgctatctaagaccttaaatcttattcgtggggaaaccttaaaccatacaaaaacagcgtgggaagagtggattagcgataaggaaaatcatcaagtaagcattgcaaaaatagtagatgaaaaagatgagtatttctggggcgagctttctcttagtgatacggatattttagacagtgtttttgagaaatacggacattttgataggttcgcattagtggagcttacgcataatcccgacattgtgcctgaatgggaagatcctaaaggtggagcaaagaaaatcacccttgaaaagctattacagcatttaggcaagagcaaagaacaaatcaaagcaatctttgaggaacaagccgaaatgcaacaaatcaacagactttttaagggaacgatatgacagtaggggaccctatcccaaattctgtgtaaacacccatttcaacttaacggtgatcgtctaggcgatcaccaaaatcaatcataaatcgattcatcgccagtttccagttctgaatcggcattgtccatttttttgatgcatctttaatcgcaagccaaatcactttgaaaactgaatcatccgtcgggaatacatttcgttttttaatcacgcgacgaatcacgctattaagcgattccacggcattcgtggtataaatcgctttacgaatgtcagccggataatcaaaaaatgtggcaatatttgcccagttatcttcccagcccttcgccacaagcgggtattttgcctgccatttttgcgaaagtgcggtcagattttcgcgagcctgtgcttccgtcggggcctgataaacctgctttaaatctgcggtgacggctttgtaatctttccacgaaacgaatttcaagctgttacgcactaaatgcacaatgcaaagctgaatcttcgttttagataaccaagatggtcggtcagttcatcatttaacgcagcctcgacggtgattttcttgagcatccgtgaaaattgattgaggtcttctggtgtttttaggtttttggcaaattccgctgccaaggcgtgaagttgtttttcgttcataataaaatacctgtgtctgaatgtattatctcagaaacaggtatttacacaaattgtgggagaggctctattccaaagatcttagagtttatctttgaactcgtttctttaaattttcccaatccaaaaccattgccgtatattgaataatccaacccacacacaaggcaaaaaacaatgtgctaacgccgactgttccgcctaagataaaaccaagcacacatacagtcacttcgattgttgtgcggacgatcccgactttccagccgtatttctggcacattccgaccattaatccatctcttggtccggcacctaaatggcacgaaaggtagaaagttgtgctaatgccaaacagtaaaatagcccctatcattagaataaagcgtgataataggctttctggagcaggtacatattgtacggttaaatcaataaagagagcgatccaaaaaatattgagtagtgtgcctaatccgaaacgtagttgaagtgggatccagagtagcagtacgataacgctgataatggcaaccactgtgccgatagacaagcccgtttgtaatgctaccccttgtgagaagactgtccacgggctagagcctaaatttgccagtactaatagcccttcaccaattcccattagaatggttgccactgagattacgcagagtgaactgggtttaagttgccattgatgttttgccgtccaaggcatttcaggaataggcgattttctactcatagcgtaaggcttccgccggctctatttttgatgctcgataagcaggataaagagtacaagccaaagagagcagaatagatgaacatacgatgatgatcacctgttccattgcaatttctgtcggtaacattagccctgttgggttgatgaaacgaataagatcacctaagtaagcggttgctagaaccccggatattccgccaataaacgccccaataataccaacaatagccccttgtgctacgaagatttgcgtgacctgtcctttggttaatccttgggtttgcaaaatcgcaatttccccttgtttatcaaccaccattaaacttaatgatgtcacaatatttgaaatcgccacgataataatcaggctaattagtaagcccatcatatttttttccattctcaccgcttggaaaaattcccctttttgctctcgccagtcgttcactagccatttatccgcaggaaatgccgaaggtaattccgtgactaaaaaaggatcggttaaaaacaaacgaacaccttggctcttaccttcttcaatacgcaacaaacgcccaacatccgccaaatttgcaaataaggtataagcgctcgcttcattattcgaataataaatatctgaaacggtaaaaagacgctgaacaggcactcgaccaaatggggtatattgactattttccgtgatcatcaaacggattttatctcccacattcagatccaactgattggctaaccttgaaccgatcaatacattaaaatcgcctgcaggtaagcgttcagctaaatcgcttacttccgttaataacggatcatcgctatttttctcaacgccaattaattgccctgcatttatgccatgctgactttgaatcatcacatttgcacggctaattgggacagatttttccacataagcaggtaaatttaactgctgttctttgctccaagcttcatctatgggtgaaataatcgcatggggtaagatagaaagcagattgcgtttctgcatattttctaagccattcatcacagaaagaacgataacaagtgccatcacgcctaatacaatgcctagacttgcaaggtttgtgactaatcgaccaaaacggtcgccacttttagaacgccaatagcgaaaggcaataaataaaggagttgttaagttcataaaaaattaatacgagtagaaattggtaaaattctaccaaaatctacccgcttgtcttagagatttctgttatatcaacaaaaaattagttaataacaccgcaagccattcttgctccgccaccgccaagtggtgctgggtggtctgaatggttatcgccacctgcgtggatcatcaatgaacgacctttcacttcttctaactttttcaaacgtggtgcaagaactggattagtcgcattaccctcgtgatcaaccgctaatgcaggtaaatcacctaaatgcgcttcatcagaccaaggataaccgtgctttttcgtctctttaggatcccagtgaccgcctgcacctaagccagcgactaatttgccatctttctcttttggttcacagcttggtttctcgtgaatatggaaaccgtgtaagccgtgtgacaatcctttcagatttggggtaaaaactaaaccgtaaggcgattcggtaatcgtcaccgttcccacatctttgttgccattttgtaaatcaagttgttgaactttcacttcaatttgggtagctgaatttgctatcgctgaagttgaaaatccgaaaagtgctgttaaagcaagggttaaaactgtttttttcataggaactcctaagttaattacaaattatttgcctgttttgacaaattcttcaatattctgagccactttattgactaagattgtcacggctgaatcactcgcccacgcaacgtgtggcgtaatcaataaattcggtaaacgttttgccgcttgaatgagcggattatcaatcgctggcggttctttgactaacacatctaatgccgctcccgcaattttgccattttctagggcatctagtaaggcggtttcatctaccaaaggaccacgtcccgtattaattaaataagcggtcggtttcattaatgccaaggtctctgcattaatcaggttttgggtcgtttcagttaatggacaatgtaaagtgacaatatccgcctgttttaacacctcttcaaaaggggtatagccatcacgaatagtcgttgcacctttatgttctgcataaagcactttcatgccgactaactctgctaaacgcccgacgtccgtccccaaacagcctttgccgaacacgccaagagtggagccacgcacatcggtaatcggataatcgacatagcagaactgcccacaagttgcccaacggtcgctggtgacttgatcacggtggtagctcattaaactatgttttaatgaaaaaatcatccctaaaacgtgttctggcactgtcacactggaatagcccgttacatttttcaccgcaatgcctagttcttttgctgcaacgagatcaacattatttgtccctgtcgccgtaattgcaataagcttcagtttcggcaacctcgctaataactctcgtccgaataacactttgctggtaatcacaatatccgcatcttttgctcgctcgtaggtttcttcagcagaagtgcgatcgtattcaatccaattatgcggaaaaggcggacgtggaatgttgtgagtggcaggaatgcctgtgcggtcaagaaaaacgatattcaacatattagttccttgtttggaaagagaaagtaagggtgaatatacaacaagcggtgcgttttaacaagaaatttacgaaacgaatggaatatacagtttgaaaagcgaaaatgtaggacacacgcagtgtgtccctactattatgaagaaaggttatagcttttcaacaagttccaccgcatagccaatatagcttgcaggggtcatctgttttaagcgatctttctctgcttgtggcaatgccaatccatcaataaattgacgcatcgcttcgccatctacacgtttaccacgggttagctctttgagtttttcatacggtttttcaataccataacgacgcatcaccgtttgaattggctcggctaacacttcccagttttgatccaattcatctcgcagatgttgttcattaacttctaatttactgatcccttttagcgtagaagcataagcaatcaacgcataacccaaacctacacctaagttacgcaatacggttgagtcggttaaatcacgttgccaacgagaaatcggtaatttttgccctaaatggttcattactgcattggctaaccccaagttgccttctgagttttcaaagtcaattggattaactttatgtggcattgttgaagagccaatttcacctgcaatcgtacgttgtttaaagtgatttaacgcaatatagccccacatatcacggtcaaaatcaatcacaatcgtattaaagcgagcgacacaatcaaaaaattccgcaatgtaatcgtgcggttcaatttgagtggtgtatgggttccaagttacccctaaagattgaataaactcttggctaaaggtgtgccaatcaacttcagggtaagcggatagatgagcattataatttccaaccgcaccgttaattttcgccaaaatctctaagttttctaattgcttatattgacgttttaaacgatacgccacattcgccatctctttaccaatcgtagttgggctggcaggctgaccgtgtgtgcgagaaagtaacggaatatctttgtaacggtgagccaattccacaacggcatcaatcacttttttccactcaggcaacaaaacttcttctcgtgctgtcttgagcatcaaggcgtgagaagtattgttaatgtcttcagaagtacaagcgaagtgaataaattcattgattttttgcagttcaggcaaggcttcacacttctcttttaagaaatactcaacggctttgacatcgtggtttgtggtacgctcaatcgttttaatacgctcagcatcttcaatcgaaaaatgttcgacaatctgatttaagtaaccgtttgcgtctttagataaaactgaaacttcgttgatttgtgcgtgagaagccagtttttgtaaccaacgaacttctacggtaacacgaaatttaagtaagccaaattcactgaaaatagggcgaagtgcagtcgctttatcttgataacgaccatcaataggggataacgctgttaaagcggtcagttccattcaggtttctccgtacataaataaaaatcaacctgagaaatgtagcattttttgcgaggaatttcattagtttgttgtggttttatcaattttatatcgtattttgatagctttaacatacagcaaaaatagtaaaaagtataatttctagccatcatagtgttttactctcttggtaaaactcattagaattaatcgtttttttctatcttcctaaggatcatctatgcatttccgaaaatcccctttagcgttagctatcttattatgtttatccccaattacagttacagtgactaatgccaatgctgaaacttatattgttactggtgaaaataacaatgtgcgcggcgaacaattccaacgtttacttaaccaagccaaagatggcgatacaattcgcttagacggagatactcaattattgcgtggaagtggttttttcaatgttgataaacaagtaacaattgatggacaaggaaatcgcttacaccttgaaggttataatttgtccttaggacaagatgttactttttcgaatgtaaatttatccttaaaacctagtcgagatttaaacaatatttttagttctggatttaaaatggataatttggaagcgaaaccaacctatattgtgacaaatggcaataaattgacattagataatgtgacaacgaatgttgatagcgaaccttcagatactcgcccaattatttggctcgggaatgctgatgctactaaaagcaataatggacataatacccttattgttacttcaaattcagcagaaactaaattatattcggtaatcattagcgataatacggaaaatagttctgatgactctcctgtaaacatacaattaggggaacatgttggattagttgatgcaatatatttagctggagtaaataatgatcaagcacataatagagctattcattttactagttcatcaaattctgtaactaaaatttatacgggagaagctacaaatgtttctgttacgttaaataacatcaatcctgaaactgctatcactttacaagatgttaaagatttaacattaaataatagccgtattactttggataagaatttatctgtttcagaaaccttaactctgaataatcaatccgcaatcactacagtggcgagtaaagatgcttttggtgacatcgctaagactagtttgatgttaaataatatccataccaatggtaataatagtaatatcactatcgttcgggacaatgctcttttgattaatggtaatattactggtgaattgactattaatacagaagataaagataataacgttagtcttcctaatggcagcactttagtaggagaaaatggcagctatgttgtgaagctaaaaacagaagtaactcaacctgtatcagaaaatacagcgactaacagcagtaatactgatgtaccccctgctaaacctacggatagcacaccagcaacaacaggtgaacaggctggttcgtcagatacaacatcgccaacagatacagctcaaacagacgatcaagcggaggcttctagctctgacactgcaacatctacaccaacacaaccaacagtcgtaacaactccgacaacggaagctccaacaagtgaacaagcgacaacgtcgagtacatctacaaaccacaataaaatcacaatcaccacggcagaacaggaaacacagcgagcgattgcggaaagtcgttatgccaccgttgtatctaactttgcattaaattctatccgaaacagactagaacacagccgttcaagtaatgcttatccgtatttaactgcaacggtaaacggcatgatcccgacggtttctgagctaggtaggttatgggttaattcaagttctgatcgaataacgcaggatctatataaattcaacaattttggattacaagtaggttatgataaatcctcggcgttggataatggcacagctcgttttggcttcgctttagatgttgaaaaaggcaaggctaactttgctcaattctctgaaacatataaaacccaaacatacggtatggcattatatggtgcttacgaaacagaagatcgccattatttagatgtcgcagtgagaatggcaagagcatctaatgaactaaaatccaatgcttcgcaggcgtatcatcacaatctctattctgcatcactggcttatagtaaaggttttgaattgagtaaccgctgggcaatcgaaccatatacgcagttattctatactcacctaagttctacgaactatattagaaatggcttgaatgtaacggctgacgaaatcaatagcttagtaggtagcgttgggactaaggcagaatatcaactcaatcaaattttgaatttctatactaaagtcgcaatgcatagagaatttaacgctacacaagatattaatatcattcgtagtgccacagacagagttcaacataatatcaatcatcgtggaacttggacaacgttaggattaggtatgaaagctcgtctaggcaataatactcatttatatcttgatgtagataaattatttggtaatggatataaacaaagttatcaaataaatttaggattagattggaaattttaatttcagttagattaataagttaaaagcagtgggatttccactgcgtttttaatattatagtagacatgagttgaatagaagtggcttacatcctaatgaacacaccccacatctacatcggcacgggcggttatagcgatacggatttagtcggtacgctctatccgtttggaacggacaaagcggattttttgtcggtttacagccagcattacgacaccgttgagatcaatagtacctttcacgccacgattggctataaggctgtgcaaggtatattaaaaaaggcggaagggcggttaaaattttcggtgaaactgcatcaagattttagccataaacgtaccgctaccgccgagcaagcgcaggcatttttggctgcgttacaacctctgtgtgatagccattgtttagccaatttatttgtgcaattcccgaccagttttgaacgtcagcacgccaatcgttactatctggcggagctggtgtcgtggtttagtgattatccccttgcgattgaatttcgccataccagttggcatacgcagtcggtgctagactattttcacggcaaggaaaatttgatttggtgtaacgtggattatccgcagaatatcggtttgcctgcctttcagttttatgcgaaccaacgcaccgcttacctacgattacacggtcgcaatccccactggtggaaagcccaatcggcacaagaacgccacgattatcgttatagcgaaaccgaattacaacaactggcaacattgttaaatcagcgaaaagcggagtttgatcagctttatctctattttcaaaacaccaccaatagccattcgttctacaatatcgaaagtctgaaaggctatttggcgagctatggatttaaagcaaaagagacacctgagtttttgagtggacagcagagtttgttttaataagagaaattcgtggttatttattagtaatattctacctgtttttcagctatacaaagaagtggagacaaaagtattggagagaattagagaacatgattaaaactaatacttttgcctactgcgccgatttctatagaaaataaaaagacctctgtggttttactaccaaagaggtctttttgagattttaaattactgttggcaaacaccgcaagttgctgctgatgagaacatccaaacaagtttctcttgttctttgatatagtcactcatttgtgaggctgtaccttcatcttctgcttcatttgctaacgctaaaatttcacgctgttgtttaagtagagttttgaagccttctaaagtaccagttaagcaatgttgtgctgaacttgcaccgatgtcttctttaacaagtgaaacttgtaagtattggctaaatgcgttatctggtgtgtaacctaaggttaaaatacgctctgcgatttcatctactttaactactaagtcgtcgtagatttcttcaaattttgcgtgtaattcaaagaaacttacacctttgatattccagtgataaccacgcacattggtgtaaaacacttggtagcttgctaataagccatttaactcttttgctaatttctcagcagacaccttgtctaaaccgatagagtttaccatttttttctcctatataatgtgattcgcgaggcggattatagcctaaaaaaataattgaataaatgaatataatttattcatataatagaaaaaatcaatcagtttaatgaaaataatttctttttaaaacaattggataggaattatttttattgcttaaataaaagcactcttttttatttaaaatgctctaacccatattgataaagtgcattttttttgtagccaaaagtgcctgcaacaattgcggccgcttttttcagtggtaattcttcacttaatagggagagtaatttaagtgcttgcggagaaaattcttcgctttcatctgcagttttcccttcaacgattaagacgatttcgcctttaatacgattgctatcttgttgtagccagtcgattaattgtgcaagcgggtcaccgtgaatagtttcccaagttttggttagctctcttgccattacaacatagcgttctccaccaaacacgctttgcatatccgttaagcagtctaaaatgcgatgggtggactcatagaaaatgagtgtgcgaggctctgtggctaattcgttaaatttgtcacaacgagctttactttttgctggtaggaacccttcaaaacaaaagcggtcagatgcgatacccgaactgcaaagtgcggtaattgcagcacaagcccctgggattggtacaatgttaatgccagcttgacggcaatggcgaacgagatggaaaccaggatcgctgattaatggcgtgccggcatcagaaattaaggcgatgttttgcccttgttgtaatttttcgacaagcacggtggcacgttgttgttcgttatggtcgtgcagtgcgaagaaaggtttttttataccataatggcttaacagaataccgctatggcgggtatcttctgctgcaataagatcgacggcagcaaaagtatttaaggctcgctgagtaatgtcctctaaatttccgattggggttgcaacaatatataatgtaccgatttgtttaggtgagtattcgtttttcatttgattttcgcttagttgataagtaagatctgcctaatattcacagactaacttaagtctagataatagccaaatttatggagcaataatatgccaactattttagtacaaagttatggctttcgccaaaaaatgaaaacgatctttattcctactgcccttgctttgttgttggcagcctgttcaggtaataaagtgactgaaacattaaaaaacgaggcttatggtaactctgaattttatatcaataaagccgaacagagccgcaatattgaggaacagcaaagttatcgtttgttagctgttcgcaagttaattgaagaaaataaggttgttgaagctcagaataccttttcagagattttggtagctaaactaaacgatgagcaaaaacttgaacatcgtcttttaattgctcaattagctgcattacaagggaacaattcagaggctcaaggtgtattgagagctttaccacaaacactattaagccaatctcaacgtctgcgtgtgtatcaaactcaagcccgtattgctgaaaatcaaaatgatgtcattgcggcagttaatgcaagagcattgatggatagctatatgacggatactcaaagtcgccaagcgaataatgacaaaatttgggagatgttacgcaatgctaaccgtggtatgttagaaaaagcggtggcaggtcctggtgaaatcggattagctggttggttggctttagtggttgcttataatcaaaatatgtctaatccggcacaattgcctcaagtgatcgaaatgtggaaacagcaataccctaatcactcagccgtattgttgcttccaattgaattgcgaaatgtatcttctttccaacaaacccaattaaatggcgtggcattattattgcctttaagtggtgatgcaaaaattttaggggaaatcatcaagcgtggttttgacgatgctaagggcacaacaaccatgcaagttcaggtatttgatactgatagtgctcctattaatgatttattaatgcaggcgaagcaacaaggggctcaaactattatcggtccattgttaaaaccaagagtagatgaaatgctaaccagtcctgaaattagcaatatcaatgttcttgcactcaattctactccaaatgtaagagctgtcgccaaagtgtgctactacgggttatcgccagaagcagaagcacgttctgcggctgaacgtttcctgaaagatggcttacagcatgcggttgtagttgcacctaatggcgattttggcacacgttctgcagaagcctttgctcaacgttggcgtcagcttaccaatagggatacagacattcgttactacaatcaagcctttgaagtaacctcgcttttacaaggttcaggaattggacagggaagtggtttatatgcgttaggaacagcagagcaattatctgatttgaaacaaagtttagataactcaccgcttgctaatcagttcccaatttatacttcttcgcgtagtaattcgccgaacaatgggcctgatttccgtttaacgatggaaggggtgaaatttagtgaaattccactcttatccgatccttcatctagcgaatataaaaaagcagagcaaattgtagaaagcgatttttcaatgatgcgtttatatgcaatgggatctgacacttggtctattgcgaataaattcaacgaattccgtcaaattccaggttacaaagttcacggattaacgggcgtactgagtgcaggcccaaattgtaatattgagcgtgaaatgaactggctacaatatcgtggcggttctattgttgatgcaaactaatatgcgttcacaaggtgcatattttgaacagcaagccaaaattttcttagaaaagaatggcttgcggtttattgcccaaaatcagcagttcaaatgtggcgaactggatttaattatgcaagagggcgataccttgatttttgtcgaagttcgccaacgcaaaaatgcctattttggctctgcggtagaaagtattgattttcgcaagcaacagaaatggcaaaaagcagcaaatttatggcttgcacaacgaaatcaatctttagatacggcaaattgtcgttttgatgttgtggcatttgaaggtgattgttcacctatttggatcaaaaattttttaggatagtatgttagaaaaaattcaagatcgctttagtgaaagtattcaaattcagattgccgcagcggaattactgccaaaagtattaaacgaagcggctaatcgtatcgtagcttgtttgttgcgaggcaataaagtgatcgtttgtggctatggacgctcttatgccaatgcacaattgctggtgagtaatttgttacaccgatatgatcttgtaagacctagcttatcggcacatttactgcaatttgatggaatgctcgtgggctgtttaaaccaagatcaagatctcaatgaaatctttcgtaaacagctacaagtgattgcaaaagagggagatctgtttattgcattttctccactaggcaacgaacaagcggtcttaaatgcgatacattgtgcaaataacgaaaatttggaaatttttgcgtttaccagtagtctaaatgatcatacaaaaggactgcttgataataccgatctggatattgagatgccatcaattaatgaaatgcgaattattgaaggacatcaattttgcgtgaatttaatctgtgagctggtggataatctgctgtttccaactacatcacactaacattgaaataggagaggactatgttaaaactcgttaaacgcattacccttgcaagcctatttggcttaacatttctatcattacaaggttgtttagccactgctgttgtaggtggagcagcggtcgcaacgaaggttgcaacggatccaagaacggcaggtcgtcagttagatgatgaaacactggaagaaaaagtggcttataatctgaataaagatcaacaacttaacagcgaagctcgtatcaatgtcgtttcttataacggcaaagtcctgctgataggtcaagtccctaatgatttttccaaagactcggcgagtagtatcgctacaggggtagaaggcgtatctacggtttataacgaagttcgtatcggccctaaaattggggttgcacaaattagcaaagatagctggattaccacaaaaattaaatcaaaactctttgtgaacggctctgttaaagcaacagatgtcaaagtgattactgaaaatggtgaagtattcttaatgggtaatttatcaagtagtcaagcagatgccgctgccaatgttgctcgtcacgtcgatggggtcgtcaaagtcgtgaaagtgtttacctacgtacaataaagacattaatgctaaacattaagcatattggtatacttggagccaatatgcttttttgtaaacggaattttgtcaattactttaaagaacattgactttaattgctcattcattaattatcacaagccatttttcagtcaataccccctttaattttcaaagggtatcgtatttttaaactagaagaaaacgaatgcgtgagataaaaaatttggttgaagtaaaaaacctcacctttaaacgaggtgaacgtgtgatttacgacaacctaaatctacaagtgcaaaaaggcaaaatcacagcgattatggggccatcagggatcggtaaaaccaccttgttacgccttatcggtgggcagattttacctgaaaatggtgaaattctctttgatgggcaagatatttgccaagcaaacaataaaaccttatatcaacttcgtcaaagaatgggaatgttgttccaatctggtgcattatttaccgatctatcaacttttgataatgtcgcattccctattcgtgaacatacccaattgcccgaagagttaatccgtaaattagttttgatgaaacttgaagccgttgggctacgaggggcggcacaactaatgccttcagaattatctggcggtatggctcgccgtgcggcattagcacgagcgattgccctagatcccgatcttattatgtatgatgaaccttttacagggcaagatccgatcagtatgggcgttatcgtcgaattaatcaaaaagctcaatcaagcactcaatttaacctcaattgtcgtttcacacgatgtgaatgaagtgctaagtattgccgattacgcctatattattgcgaataaacgcattattgctgaaggaacacctgaaagtttattagcaagccaagatccacaagtggttcaattcttagcaggaaaagcagatgggccagtgcaattccactatcctgctcaaaattatacggaggaactgtttcaatgatggagtttatatcctcaataggtgcttccgttattcaggctattagagcaatgggacgagccacctttatgttgtggggggctttagtcggtaagccagaatttcgtaaacatacccctttatttatcaagcagttacacgttttaggcgtacaatccttactgattattatgctatcaggcttatttatcggaatggtgctaggtttacaaggatatgtcgtcttagtcgatttctcggcagaaaccagcttaggacagctcgtttctctttcactcttgcgtgaactcggccctgtcgtcaccgcattgctctttgcagggcgagcaggctctgccctcactgcagaaatcggtttaatgaaagcgacagaacagctctcaagtttagaaatgatggccgtcgatccgctacgtcgtgttatcgccccacgtttttgggctggtattattgcaatgccgattttagcggtgatttttaccgctatcggtatttgggggggctcactcgttggcgtagattggaaaggggtcgatgtaggtagcttttggtcagtaatgcaaagtaccgtgacaatgggcgatctgctcaatggctttattaaaagtattgtttttgcctttgctgtggtatggattgcactctttaatggctatgatgccctaccaacctcagaggggattagccaagcaacaacaagaaccgtcgttcacgcttcactggttattttagggcttgattttattttaacggcaattatgttcggcggttaaacaagcaaaggtattattgtaaaatagcagacaaaatacaccgcttgttagtgtatttgaataggaaaaattatgcgtcaatcaattaaatatgaattttgggtaggcttatttgtacttcttggattaggagctttagtctttttgggcttacgagttgccaacgtacaaggcttctcttcggaaaaaagctactcactctatgcaacttttgataacattggaggactaaaagtccgtgcgccaattaaagttggcggtgtagtaattggacgagtatctgatattcaactcgatcctaaaacctacaccccgaaagtcacccttgctattaatgaagaatttaatcaaattcctgatacaagttctctttctattaaaacagcaggcttactgggcgagcagtacattgcactgaatgtgggatttgtccttgaaggcgaaacagcaatgctcaaagagggggatagctttgctgataccaactcagcaatggtactggaagatttaatcggtcagttcttatatggcgataagaaatctgacaaaacggaagacaccgctgaacctaaagcggaataattgctcacttttaaaatcacattttggagttttatgatgatcaaaacccttaaaaacctttttattgcaggctttgttgcaatttctgcattcgtttcaaactcggctttggcttctactagcccttatgtcttaatgcaacaaacggcagataaactttttggtgatatcaaagcaaatcaaagcaaaattaagaaagatccaaactatttacgcactatcgttcgtaatgatcttatgccacatattcacgttaaatatgctggtcaattagttttaggtaaaaatttagcgtcagcgactgatgttcagcgtgaggcttttttcaccgcctttggtcaatttattgaacaatcttacgcacaagtattaacccaatacagcgatcaacaagttcaaattgaaagcgaaaaaccgctagacaacaaatctatcgtcagtattcgtgtcaatgtcctacaatcaggcaacgcccagccaatcaaattagatttcaaatggcgtaaaaatagcaaaacaggtgaatggcaagcctacgatatggcagccgaaggtgtgagtatggtcgcaaccaaacaaaacgaatggagcggtattttacgccaacaaggaattgacgctttaacagctcaggttgcacaatctgcaaaacaacctatcacattaaaataattcgggtatgcaaacaaaaaatccattacaatggcatattcagcaaaacaatgaaagtctgatggttcaactatctggcgagcttacccgtgacacgttgcttccactttggaagcaacgtgcttcttttttatctcccaaaagctcgcagcacatttattgggatttaaaaggtctcactagcattgattcctcaggctttaccttactggctgaactacttcacctctatcaacaaaaaaataaaaactgtttatttaatgttccgcaagcggtacacagccttgcagagctatttgatttagcaggctggtttaaaaaatttctattttgtgagaagaaataacaatggaacccaaacaaattgaagaaatcctaaaaaacgccttagaacttgatgaagtttatgtacaaggtgaaaattcccattatggtgttatcgcagtaagcgacagctttgccacaatgtctaaagtaaaacaacaacagatgatctatggtcctttaactgaattttttgcaaccaatgcaatccacgcattaacaatcaaaacattcactaaagaacaatggaaaagagagcgtttgctcaatatgccaagctaatcacatcatctaaaggaattaaaatggaaaaatttcgtgttcacggtcctttcactttaagcggaactgttgatatttcaggtgccaaaaatgcagcattaccgattttatttgcggctattttagcggaagaacccgttattcttacgaacgtccctgatttgaaagatgttgaaaccacattcaaaattctacgtaaactaggtgttgtcgttgaacgtgcggaaaataacgcagtacatattgatgccagcaaaatcgaccattatgttgcaccttatgaacttgtcaaaacaatgcgagcttcaatttgggcattagcccctcttgtggctcgtttccatcaaggtcaagtttcattaccaggtggctgtaccatcggggctagacctgtcgatatgcacattgcaggcttagaaaaaatgggtgcgactatcacccttgatgaaggttacgttaaagcagaagtgaacggtcgcttaacaggggctcgtattctgatggataaagttagcgttggtgcaacattatctgtgatgatggcggcaacccttgcaaaaggcacaaccactattgaaaatgccgctcgtgaacctgaaattgttgataccgccattttcctcaacaaaatgggagcaaaaattacaggggcaggcacagacaccattaccattgagggcgtagagcgtttaggtggctgtgaacactacattgtcccagatcgtatcgaaacaggtacattccttgttgctgccgcaatctctggcggacgaattacttgtcgaggcacgaaagcggatacattagatgccgtgattgaaaaattgcgcgaagcaggaatgcaagttgacgtgaccgaaaacagcattaccctcgactctctaggtatgcgaccaaaagcagtcaatatccgcacaatgcctcacccaggcttcccaacggatatgcaagctcaatttacattattaaatgtagtcgccaacggcaccagcaaaattaccgaaacgatctttgaaaaccgctttatgcacattccagagctaatccgtatgggagcaaaagcagaaattgaaggtaacacagcgatctgtcacggtgtcgaaagcctctcaggcgcagaagtaatggcaacagacctacgagcttctatcagtttagttctggcaggttgtattgcaaatggtcaaactattgttgatcgtatttatcatatcgaccgtggatatgaacacattgaagataaactacaaaaattaggtgctagaattgaaagatttaatgcaccatttgaagaataatttttcatataaaacaacataattgctaaataggggcctaagccttatattacaaggcttaggcccctattttaaaacatgagcaaaaaatctcccattttgtcaaagtttgaaaattaaggaaacatagtatacaaaataatatccaatgttatttggtaataaatgttataaaatttttatcttaaaaaataaattagatccaattaaaatttggacttattacacatctggaatacaaacctatcaacagcttgctgttaaatctcgttgttcagtcagaactattcaaagatatcaaggttattttccttataaacatcgcaatgtagggggatgccagtctaaaacattagatggggcgatattttatctatgaaaaacatcctgaattaaatatagaaaagataacaaataggttagatggattatttaaagaactgaaacagaaattatcagttcataatggattaacgaaaaagcataagattatgtttataaaggattttttaaataaaaagagttggtaataattagggaaaataattaaaaccaacacttttgtctatgatcaatatactagcacctgaatattgacttaacttccgacaatagaagggactaacttttattattcatcaaacaagactagttctgttttttctatttctggtggattatcacataaccaatttgctaaacgggcataatccgcaagcgataagttttccgctcgtgcattcaaatctacccctaatgcctctaactgctctacattaaacagcgtagcaagtgcgttgcgtaatgttttacgacgttgattaaaggcttgtgtggtcacacgatttagccagtaaatatctttcactgggtacggcagtgttttatatggtactaaccgcactactgcagaatccactttcggagcaggtttgaatgccgttggtggcacttccaacacgggcattacttgacaataatattgcgccataatggttaaacgcccgtaggctttgctatttggtgcagcacataaacgcttaaccacctctttttgcaacataaagtgcatatcttgaattaagtcgtggaatttaaagagatggaacatcaacggagttgaaatgttgtaaggcaagttaccaaacactttgacagctttgccattcaaggctaggctatcaaaataggcacggaaatcaaaacgcaacgcatcttgttcaatcacagttaatttttgatgtaaaaacgggtgatggcgtaaacgttctgcaagatcacggtctaattcgaccacagtaagatgatctactagatctgccactggctcagttaatgcccccaagcctgggccaatttccaataaaaattgattttgctgcggattaattgccgcaacaatattatgaataacgttttggtcgtgtaaaaagttttgaccaaagcgtttacgagcggtatgccctaaatgtttttttgaatttgaactcattggataccttaataagcggttatgttcccactgatttttataaatttaataaagtaaagaacctcgcatatgcgaggctcccttaattattagataaattaaaaatattttatatctaatttacttctcaatacttttatccaatcttttgatgccacttgcacttgtttatcaataagctgctcgtaagctctctgtaaataagcatcttccgtacgatctcctctgcgagtatcagtaacttttagtatatgccaaccaaattgtgatttaaaaggagatgaaatcacatcaattttacttttacttgcaatgttagcaaaagttgaatcataggcatctagaaaattaaaaccgagatctcccccatcaataccagatatataatctacagagttaattttcgctgcttcttcaaatgttattttaccagatttaatgtcagcggtaattgatagtaattttgccttagcttgcatatcatttaagattggcgtcgttttaatcaatatgtgactaatacgatattctgtagcggaaactgtttcaagtgtaccgtttatttttgctttatctagcatatccttcgctaaagattgaacatctttcggatctacttgaatagaatttccaatactttgttgccgaacttgttccattaaaagctgatgagcaagttgttgacgatactgactaagactaatgccctgataatccaaagcatcaagtagttggccatatgttataccattttgagcagcaacatcttccatcatctgatcaacataagcatagtctacttttataccagattctttaatcgcacgttgcacaacgaaatcatcaataatagtctccaaagccgctttacgattagcttccgtattcgcttttttacccaaagcctgttttacttgactctgcataatgggataaccatctactgttgcaacgactctctcttccgcattagctgaagaaaatgcaaataaagcaaaacctgcgataaataatgattttacttgtgtaaacttcattttaatttcctatgaatattgtagataaaaaattcctgctacttagaaggctattctagcaaaaggttcacaaagattgaattttcttaatcacatttgtggtcgaacaaccgttttcaaagttgagtacacgaacctcgccaccatttgcccaaacttcttggctacctgcaatctcttctggcttataatcgccgccttttaccaataaatcaggcaaaatttccccaattaaacgttgtggcgtgtcttcaccaaatggcacaacccaatcgactgaagcaagccctgctaacaccgccattcgtgcatttaaatcattaatcggacgactttccccttttaagcgtttcactgattcatccgtatttactgcaacaatcaaacgatcacctaacttacgtgcattttcaaggtaagaaatgtgtcctgggtgaagaatatcaaagcaaccattagtcattacgattttttcaccacgagtttttgattgtttaacaatcaccttcaattcatcttcagacacaaccccaaaacctgtttcagcacgttgatgaattgcctgctctagttcacttgggctaacggttgatgtccctaatttacccaccacaattccagccgccgcattcgctaaatagcacgcttcttctaaaggacgaccatctgcaatcgcagttgctaacacactaatcaccgtatcgccagcccctgtgacatcataaacttccttcgcttgcgtcggtaaatggaatggatcttgatttggacgaagtaaggtcatccctttttctgaacgagtaatcagcaatgccgacaaatcaaaatcggctatcatttttaagcctttagccacgatttcgccttcatcattgcaatgccctgcaaccgcttcaaattcagacatatttggcgtaagcagtgttgcaccacgataacgctcaaaatccgttcctttcggatcaattaacacaggcacatttgcttgacgtgcaatttgaatcatttgttgaacggcatcaagcgtacccttgccataatctgacaggatcaacgcaccgtaagcggtaatttctgctgctaattttgcaagtaacgcttggcaatctaaattatgaaaaccttcttcaaaatctaaacgtaataattgctgatggcgagaaagaatgcgtaatttggtgatcgttgggtgagaatctaccgcaacacattgattttgaatactatgttcgcttaacagtttatccaacgctcgccctgcatcatcattacccactaaaccgtgtaaagtgacaggtacgttcaggcttacaatattcattgccacgtttgccgcaccgccagccctatcttctctctcttgaactttgacaacaggcacgggagcttcaggcgaaatacggttagtggcaccaaaccaatagcgatctaacatcacatcgccaagcaccaatacttttgcattgttaaattgcggggaatattgcatcatcatagcttcaatctcttatcttttacttttcttaataaatttcatcaagcgtttacgtttacgcaactggcttggggtcaatttattcttcttacctgcaaatgggttgtttccttcttggaacaacacacggatcggcgaaccaataattttcaaactcttacggaaatagttagacaaataacgcttataagagtcaggcaacttctcaatttgattaccgtggatcacaatgatcggcggattataaccacctgggtgcgcatattttaatttcacacggcggccatttactaacggcggctgatgatcgtccatcgctaactgcaaaattcgggttagcattgatgttgtcattttcttcgtcgcacattgataggcttcttggattgagctaaataagttgcccacgccactaccgtgcagtgcagaaataaaatgcactcgtgcaaaatcaataaaatctaaacggcgatcaagttctgatttcacattatctttaatatcctgtgataagccgtcccatttattgacaacgatcaccaacgacttacctgcattaagaataaagcccaacagcgataaatcctgatcagacacaccatcacgagcatcgatcgtcaataaaaccacattcgcatcttggatcgcctgtaaggttttaatcaccgagaatttctccaccgctaaatgcaccttaccacgcttacgcacccctgcggtatcaatgatggtatattgctgaccatcacgttccatagggatatagatcgaatcacgcgtcgttcccggcatatcgtaaaccactacacgttcttcacctaaaatacggttagtcagtgtcgatttacccacatttgggcggcctacaatggcaatcttaatgtttttatcgtcagcttcttcttgatcttcttccaatgcttcatctaataatgccgtatcttcttcgttatcaaagtcaaaatcgctatcccattcatcttgctcatcatctgcaacattttcatcggaatcgaccgcttgtgcgtctaatttttccgcaaggggagttaaaacctgttcgataagttgtgtcacaccacgcccttgtgccgcagcgattggttctacttcacctaaacctaactgataaaattccgcaatatgagagtctgcatcaataccgtccgttttatttgcaaccaccacggttgttttatcacgctgacgcaaatattgtgcaatacctacgtccgcaggcaataacccagcacgagcatcaactaaaaataacactacgtctgcttcttcaatcgctaacagcgactgttctgccattttctcttcaacaccttcttcagtgccatcaataccgcccgtgtcaatcacaataaaatagtgtccagctatatttgcgtgaccatatttacggtcacgggttaagccagggaaatctgccactaacgcatcacgggtgcgagttaagcggttaaataacgtagattttcctacgttaggtctgcccacaagggcaacaacaggagtcatattacaacctcatttaaaatcggtttacgaacatcttacgcaaaatacgtacattatatcgtactttaaaagaaaacggagaaaataataaagagcgggtgatgaagagagttagggcaaaatagtaccctaacaaagagttattcttctaatttcaatgctttagaaaaactttgcagacctttaacattgctattttttgccattgcttgtaaggcttgtgttggaatgtgtaataactgatttgtaagtttataactcaattcatttagtactttttcgcaatcctgcccttgttgcaaggcactcaacgctttttcaagtaaatctaaacgaatctcttcagcattttggcgataatgtttaattaaattggttgattgttgctgtttcaaccaaacaaagaaatcttttgcctcctcaataacaatttctttcgcttgctctgctgcctgctgacgttgagctatattctgctgaatgatattttgtaaatcatctacactataagcataaatactatctagttctcccgctttttcatcaatatcacgaggaacagcaatatcaatcaataacattgggtcaaaacggcgttgtttctgtgcttgttcaaccatttctttagtaatcaaaatatctggactacctgttgaacaaatcactacatctgcttgatttaaaccgatttgcaatgcacttaacgaaagaatttgcattggaatatctagtttcaccgctaacatttctgctcgaatatgagttcggttagcaatcataatattttttgccccgtgattaattaaatggcgagccactagttctatagtttcaccagcaccaactaataaaaaacggagttttttaaaatcatcaaaaatttggcgagctaagccacaagcagcatacgcaacggataccgcactactaccgatttcagtttcagagcggactcgctttgctgtagcaaaggttttctgaaatagccgagaaagattggtggaaacgccacttccttgagaatgataaaattcttcactctcttggtatgcctgtttcacttgccctagaatttgtggttctcctaaaattaacgagtctaaaccacaagcgacactcattaaatgacgagcagcttcaaggttttgcttgaaataataggcctcgcttaattcctctttatctaattgatgaatttcagcaaaccaattaaaacactgttcacgccaagcaatattatcagggtgttcttcttgagggggaacttcaggctgatggaaataaagctcagtacgattacaagtagataaaattacaacactttctgctaggctttgatcacgaatttgctcaaatgcacgctgacgtttgtcttctacaaacgctactttttctcgcaagctcactgatgccgttttatgattgatacctaatgctaaaattgtcattgttacccacagaataaaaaaaggtggaaaccacccgaaaagacggagcattttaatcaatccatgcggttggtgcaaataattgtcttaataggtttgatttataacaagtgaataacattttatgacgtataaagtggtaagatttttttaaaattttgtaaatctaaaaaatccccacgattttggagtgatttcagttataatacttcaaagcagttttacattgtcaaattctgtcaagaaccctttcagttaagcgttatggaggacttatggttgcgattcgccattcacaccggctcgatccgaacaattttgagttggctagttggagtgctgggctacagatgtctcctattacctttgaacaattactgattgcgtggcgatatgcacaggaaaaaatcgatattgaacaaaatcacttgatgtggtttggggttgaattggtcgaaattttgcatagtttgaatatggacgatgatagccttgtcgctgccttacttttccctcttgtgaagcaaaacatcattgatttagtgcagattaaagagcattttgataatgatgtgaaaaatctcgtcaaaggtgtgttggagatggataacgttcgccaacttaatgccagtcacgcttccgatcttcaaattgataatattcgtcgtatgcttttagcaatggtggacgatttccgttgtgttgtgattaaacttgcagagcgaattgtctatttgcgtgataccgaacgcttaagcgaagaagatctggtattagccgcaaaagagtgttctcatatttatgcaccgctcgctaatcgtctaggaattgggcagttaaaatgggagctggaagattactgcttcagagccttacaccctcaggaatatcgtcaaattgcgaaatatgatttaggtgaacgccgtttagatcgggaacaatatattgcaaattttgtcgaggatctgaccgcctgtctgcaagatgagttagagagtgtgcaaatttatggtcgccctaaacatatttatagtatctggaaaaaaatgcagaaaaaacatctgcgttttgagcagttgtttgatgtgcgtgcggttcgggtgattgtgccgaatttgcaagattgttataccgctcttggcattgtacatacacattataaacatttgcctgaacattttgatgattatattgctaatcctaaacctaatggctatcagtctatccatacggttgttttgggccaaggtaataaaaccattgaagtgcaaattcgtacgcaaaaaatgcacgatgatgcagaattgggcgttgcggcacactggaaatataaagaaggtgcaacggctgggcgttcaggctatgaagaaaaaatcgtttggctacgcaagttgctggattggcagaaagatattgccgattcgggcgatgtggtggctgaaatgcgttctcaagtctttgatgatcgtgtttatgtctttacgccaaaaggggaagtggttgatttaccgaaaaatgccacccctcttgattttgcttattcaatccacagcgaaattggtcaccgttgtatcggagctaaaattgcaggacgaattgtgccgttcacctatattttacaaatgggtgatcaagttgagattattacgcagaaaaacccaaacccaagccgagattggttaattccaagtcaaggctttgtgaatacagcaagagctagatctaaaattgttgcttggtttaaaaagctagaccgtgataaaaatattccgcttggtaaagagatgttagaagcggagatggctaaattcaactttagccaaaaacagattgaggatttagccttacctcgctacaacttaaaacaaattgatgatctttatgcaggcattggtggcggtgatatacgtttacatcaattaatgcactatttgcagagtaagctcatcaaaaccactgctgagcaagccgatgaagcgatcttaaaacaggtggcaaataaatctcaacagcaacagaaaaaccgtagtggttttgttgtagttgagggggttggaaatctaatgcaccacattgcccgttgttgtcagcctattccaggtgacgagatcgttggttatatcactcaggggcgaggcatttctatacaccgctctgattgcgaacagctctttgatttacgcagtagtagccctgaacgggtggtggaagcagaatggggcgagagctatgcttcaggcaaatttagtttgaccattcgggtgattgcaaatgatcgcaatggcttattgcgtgatgttagcggtattatggcaaatgaaaaagtaaatgtgttaggcgtatcaagtcgcaccgatccaaaacgtttaattgcaacaatggacgttcaaattgagctaaataatgtggaattgttggataagttactaaaacgtattctacaaattgatgatgtgattgatgcgaaaaggttgtcaaattaataaggaataacaatgcaaacattaaatattctttcgactaaagagttggaattttcacttttttgcattgattatattgcaagagaattaaatcaagaacctagtgaaatttatcaaaaacttaaagatagccgtttattacaggattatattattcagcattatgatattttacataccttaggaaaggattatttagttaaagatattattgaattaatgaaagaaaaaggggtgttatgattatttatcacggttcattccaagaaataaagtttcctaatattgctttttctcgaactcgactagattttgggcaaggattttatacaacgccgataaaacaacaagcggtcagttgggcggaacgttttaaacagaaaaataaagatgctattataaactgttatgaatttgatgaaggtttatttactcaatatcgtactaaagaattttattcctatagcgaacaatggctagattttattattgctaaccgaactcaacaacccgttgatgaatatgatattattattggagggatagcgaatgataaggtttttaataccattgaactattgcttgaaaatctcattacacgacaagaagcattaggtcggttaatctatgaggaaaataatttacaaatttgttttaggcaacaaaaaattattgaacaacaccttatttttaaaggaagcgaaaaagtatgaaagctcaccctgtattattacaacgaaaatatacgcggattatttctctttttgctcaagaaaaaaatatttctcttggtgaagctttagataaatttatgtattcaaatacttatttattaatgcgaaaaggcattggtgactttcattgtttatctgacggctatttagttgatgaattattaatagaatatgagcaagataaaataatatcatctcatcagtaattatatgtttaataaaaagaataggatttaatcgatcaatgcaaaaattagtcattttaggttcaacaggctctatcggaaaaagcaccctttctgtggtcgataataaccctgagcagtatcaagttttcgctttagttggcggaaaaaatgtcgaattaattaccgaacaatgccaacaatatcaaccgcgtttcgtggcattagatgatgaacaggcagctgcaaaattaaaagaaaatctcaccgctttaggattgaaaatcgaagttctcgcagggcaaaaagcgatttacgaactggcttcacaccctgaagtggatatggtaatggcggcaattgtgggcgcggcaggcttattaccgacgctctcagcggtgcaagcaggcaaaaaagtcttgctggcaaataaagaatcattggtcacttgcggacaaatttttattgatgaagctcgcaagtcaggtgctaaattgctccctgtcgatagtgaacataacgccatttttcaatcattgccgccagaagcacaagaaaaagtaggtttctgcccgcttgcagaactaggggtaagtaaaattattctcacggggtcaggcgggcctttccgtacaaaaccattgaatgaatttggtcaaatcaccccagctcaagctgtcgcacacccgaattggtctatgggtaaaaagatttcggtggactctgccacaatgatgaacaaagggttggaatacattgaggctcgttggctctttaatgcctcagctgatgaaatggagatcatcattcacccacaatctatcattcactcaatggtacgttacattgacggtagcgtcattgcacaaatgggcaatcctgatatgcgaaccccgattgctcacacaatggcatatccaaaccgtatctacgctggcgttgctccattagatttctttaaattaaaagaactcacctttattgaacctgattttgctcgttaccctaacttaaaattggcgatagaggcttttgccgagggacaatatgctacaacggcaatgaatgcagcaaatgaaattgcagtagaggcatttttaaacgatcaaatccgttttacagatattgtcgaagttaatcgtcaagttgtcgaaaatattgcccctgttcaagttaaagaaattgccgatgttctacatattgataaattggcaagagaggtggcgaagcagcatattttacaattttaagagtattataggcaaaagtgttggttttaattatttcccctaattattaccaactctttttattcaaaaaacctttataaacataatgttatattttctcgttaatcctttatgaaccgataatttctgcctcaggtctttaaataatccttccaacctatttgttgtttttttctatatttaagtgagcatattcttcaaaggtgaataaatatttcatacagtattttaaactagcataagcccctcttacattatggtgtttataaggaaaatatcctttctcattgggatattcagaccgttcatttaaaaactctttatgttttaaataccattggtgtaatcttaaataaaattcatttttgaggctttcttttagccttttttacgaagtatgttcaatgcgagtttgtaatagaagtctttttctgttttgatgacacggtgataaacgacttttttagctcgtgtatccattaaaactaatacaccaaattcacgaccgaagaaggttacatctgcaataatatttatataagtttgttgtaatggaataaattcagctttagaggacttttcaatataacgttgaatagttctaatggaacagtgatatttttcggctaattgtttataggtttgttttcctattgtgtaatcagtccaaatatctattggatttaatttatttatggaagaaaatgttttatgacaggacgaacaaaagtatctctgaatattatttttctttccatacttttggatattgtgcttaaggcaaaaaggacagttttttgttcatatttcaaaaagtgggcttaaagccttgtactagaaggctttaagccactttttaccaacacttttgtccacttggcatagtttttgacgaatcagcaactattttgactactatgccggttttcttcgtagattactgttttttagcccaatctaagaaacgtttttgtgtttctttgtctgcttgttggaaccagtattgaagttgttgttctgtgacattttctccttgcacaacaattttccccttattaactttattggtattatttgccattgttattggcatagttgataatgcaaatttttgtacagcagcaacaccttcaccaatattgtagtttgccaagttattgataatatttgaattaggcataaaaccttctccttttaggaaatcttgcttatatgttagcttttttcctgaaacagtttcaattttgaaactgggtgatttcttaaattgtgctatatcaaattcactatttaaactaggtgcaaggattttaatatcttcagtgcttccttcaaaagtgagaataataggttgagactcaaaaaaggcactatcagaaccagactgatagatactggatatttctactacaacttggtgtagattggtatcatttacctgtaaattagtatttcttcttactttttgtccatcaaaagcaagaaaagttacatttgaagaacccgtgattgtacctgcaaatgccgttgttccagcgataagagctgtcattgcaagggcaattttacctaatttcataacataatctcctaaaagggtataagggtaaaaaaactgctatatcctatgctaaatttgtgtaaatagaaagagagaaattccattcgttgtcgattttttattggaattatgataattttcctctgcttaacttataacgagaaaataaaatgagtgatgaacaacatagcgtaaatacgcaagacaagaagtcctttttaaagtcgctgtttggcggtttgtttcaacaagagccaaaaaatcgtgaagatttggtcgaagtgatccgtgattctgctgagaatgagctaattgatacggatactaaagagatgattgaaggggtaatggaaatttcctctctgcgtgtgcgtgatattatgatccctcgtccgcaaattgtatttattgatgccgaacagccattagaggcttgtgttgatgtgattattgaatcggcacactctcgctttcctgtggtgcatggcggtaaagataccattgaaggtattttgctggcaaaagatctgctcaaatacctacgttccgattctgaaccattcaatatggcagaaattctacgcccagccgtgattgtccctgaaagcaagcgggtagatcgtatgttaaaagagttccgttccgaacgttttcatatggctattgtagttgatgaatttggagcggtttcaggcttagtgaccattgaagatattcttgagcagattgttggggatattgaagatgaatttgatgaagaagaaatcgaacctattcgtcagctttctcaacacacctacgctgtgtcagccttaacagatattgaacgttttaatcagcaatttgcaattgaatttgatgatgaagaagtggataccgtcggcggcttagtaatgcaagcctttgggtatttaccaaaacgaggcgaagaaatcgaattaggcggaatgatgtttaaagtcacctctgctgacagccgtcgtttaattcaactgcgagtgactgtcagtgatgaacaattagcgttaatgcaacaagagaaacaagacgaatgaaagctgtaaaaaaatcgtcatttttaaccgcttgtgcggtcgccttagtttcaggcggaataggaaccctagcttattcccctttcgactattggtttatcatcttcttatctgcaagcggtctgatttggcttgctacacacaacaataagaaaatcgccctatggggaacattcttatgggctgtcagctatttttgtattggggtgaactgggttcacgttagtatgatccagtttggtggcgtacctgaaattgtcagctatattgccgtattactgctctctgcctacctagccctctattttggcttattcgcttatctggtacaacggtttaaactggctaatccttggctacttgcagtcatattcaccgcaactgaatatctgagaggtgttgtctttactggctttccatggctacaatttggttatagtcaaatcgacagcccattttcaggagttgcaccgattttaggggttgaaggcttaagcttttttgttatggtaatcagcggttatctggtagcgatctgccgtgatctcgcaaaaaaagcgactgttccgaccgcttcctatgccgttgttgtcagcctgttagttcttgcctttggttcacaatttattcgttttgttgaaatcgatgaacaacaaccgccaacaacaatggctctggtgcaggggaatattgagcaaaaaatgaaatgggatccatcccattttaactacaccgtaagaacctatcagcaactgatattaccgttacttggtaaatatcaggtaatcgttttgcctgagtcggcaattcctgctgtagaagctcaaattgaacctttactacaacagttacaaaccgttggggctaaaacaggcagtgaaattattattggtacgctacaccaaacgccaaaagatatatttaacagtgccaccgtactaggcaatccgcagcaaccctactcgctcgaacaatcgcctcgttacaataaacatcaccttgtcccttttggcgaatatgttccttttggcaatttgctagattggatgagggaagtctttgttttacctataaatttatcgcaagggacatttatccagtcgccactacaagcggctaacagagcctttaatttagcgatttgctacgaaattatcttcaccgatcaagttcagcaaaatcaaaaagctcaccaagccgattatcttctcacgatttccaacgatgcgtggtttggcacgagtataggtccttggcaacattttcaaatggcaagaatgcgagctttagagctaggcaaaccgctaattcgtgcgacaaacacaggcattaccgcctttgtcgatgcctacggcaaagtcaccgctcaagctccacaatttgaagccaccgccttaactgccagcgtgcctgcaatgaaagggcaaacgctgtttgctcaatatggtaatcacttgctgtatgcgttttgcagtgcggtattgttattgggggtaattgcaagaagaaaataatgggcatagtagacaaaagtgttggtttttttacagattatgccaacttaagaagaaattatcacatcatgcaggcttaacgaagaagcataagattatgtttataaaggatttttttaataaaaagagttgctaagaataattaaaaatattcattagcaaccattttgcctactatgccccaaataatgagggtgggataccccaccttaatattaaatatttcctccaatccctttaaacttctcgataaaggcagaaattttttgaaataccgcctgttttaatgtgagatatttaggattaagtggactcattttaggtagaatggcatttaaatccgttccgttttcacttgcatattctcgttttaatgatgtgctaatataacgcttagctgcttcttcatttaattgctctgcttgaattaatgcttgagcttctcgctgttgctccttctgagcaaactggaaaaaggcttcaattatgctggctttatctggaatattgtcaaggtttgtttgattaataaaatcaacgatcaaactttcttttgctcgatttcctacgctagagcgaataattcggcgaatttcgttaattaatgttggcttatcttttgtttttttatgatgttcgaaaatcagttctaaaatataatcaaggttgatttcttgtgatttcaatagatcaatttcaaatactacatcatcccaatcaatcgttgtcttgtccttatcatcgcttgttttttgcttgcgtagccaatcccgaatatcattataagttgaacgataatcttgaataactctttctgacgggacagttacaccagcattataggctccgctaggttcttctactccatcaacaatattcgttttttcaccttgagttaatgcatgaaactcatcgtaattttgtaaaatattttcaaggcgaagatactcgccaaaaagtttcacaaactctttcttatcttgttccgtttcaatttttgctggatctgagaagcgagtttgcaactctttgacgactgaccaataaccccgtttagcttcgccagtagcttgatcgacatagccatccatatattcctgatagcttttctccaaaactacattacgagtattgctatcaccaaataacgtaatcgtatcaatcgttgcctgttctaaatcacggaaggtgacaatatttccgaatgttttggtcgcatcaaaaatacgattagtgcgtgagtaagcttgcaataaaccatgataacgtaagtttttatcgacaaataacgtatttagtgttggagcgtcaaatcccgttaaaaacataccgaccacaattaataaatcaatatcttgattttttacccgtttcgctaaatcacggtaataattctgaaattctttgccttctatactataagtcgttttaaatagctgattgtaatcatgtatggctgcggttaaaaactcttttgccgatgtattcattgcagtaggttcaaaggtttcatcttcgatatcccctatggcatcttgcgtttcattagcggcaaaagaaaatattgttgcaattttcagtggtttttcgaccgcttgttgttgctgtttaaaactctcataatacaacttagctgcatctacactactgacggcaaacattgcattaaaaccttttcccgttgcgtttaagcggtgagtcttctgtttgaaatggctcaaaatatactgcgtaatttctttaattcgttctgggtgtaataaagcttgtttggtttcaagtgcggtgagttttttctcatctttttccatctcaacatcacggaattttggtcggacattgttgtaatccactttgaatttcaacactttttcatcacgaatggcatcggtaattacataagaatgtaactctctaccaaaaacgctggcggtcgtttctgcacctaacgcattttctgcaaatataggtgtgcccgtaaaaccaaattgacagaatttcttaaactttttcttcaaattcttttgtgcctcgccaaattgtgagcgatgacattcatcaaaaataaacactacaggttgttgataaatcggcagattatcttccgatttcattaggttgtttaatttttggatagttgtgacaataattttattatcatctttttcaatattccgttttaaccctacggtactttcagagccatttacactgtcaggtgaaaaacgttgatactctttcatagtttgataatcaaggtcttttctatccacgacaaaaaagactttatcaataaagtctaattcagtggcaagacgtgctgctttgaaacttgttaatgttttaccagaacccgtggtatgccaaataaatccgccactttcggtattattccaatttttcgttaaataggtattgtttattttccataaaatacgttctgttgctgcaatttgatacggacgcataattaataaattattaccggtatcaaacacagaatatttagttaatacattaagtagagtatttttttgaaagaatgttgcggtaaaatcttttaagtctttgattaaagtattatcagattttgcccaattcatcgtaaagtcaaaactatttttatctcgtttggtcgtattggcaaaatagcgagtatctgtaccgttagagataacaaaaatctgtagatatttaaataacgaattttctttattaaaactttctttactataacgatgaacttggttaaaggcttcccgaattgccactcctcgttttttgagttcaacttgcactaaaggcaatccatttactaaaatagtaacgtcatatcgattactatgtgaaccagcttgttcaaactggttaatcacttgtaaacgattgcgggcaatatttgttttgtcaattaaatagatattttgaatgcgaccgttgtcaaaaacaaaatcataaatatagtcattatgaattttacgcgttttatcaataatattttcagccggtttatctaaatattccgttaaaaaacgttgccattcactatctaaaaaaacgacattatttaattgttgtaattgctcacgagcattgctcaataatttttcaggcgtggtaatatctgtgcgatattcataattgaaggtttgtaaatcagcaataaactcccgctctaaatcagcttctgtctggtagcctaaattagcttgttctatcttggtatatttatcaagaatgataaaatgattggtttcagtgataggcgttgtttcaatagtcataattttattcctgtaatatatgtaggatgggctttagctcatcatccaaatcctcatatatattttgatgggctgagtcccattctacatgctattatctactgaggaaaacttaataatttctctctgtaatattcatactgttttcttcttaattcaatctcttttggtaaaccttctgcaatagaattggttaaagtttcaaatttatctaaaattgttacgatacgttgttgttcctcaaatggaggggctgggatttttatattacttaaattgtttttatttaattttggttgagctgctccagaaatataaggtgttaaatcaatattatttaaataaaattcaacaaatctacgttcagtataagtattaaattttaaaacatgaacgtggttattaacccagtttttaccactaatactgaaggcaataggcgtatttcttgctaataaatttgcaccgtcttcagatactagcaaataatcaccttcaaatatatagtctttaacatagtctacaattcctgaagctccatagtaaggtatatttcctttttctcgtagcccactggttattggttttctcataaaatccaaattttcagatatatttcccaaagccttaaacaccactttcttattgtgccataaggctttggtaatagggttagtctcgtacccccccctatcagaaatatcatcaaaattcaataatttatctctaaaatattgatattgtttttgtcttgaagtaagctcggctgtaagctcggctgtaagctcggctgtaagcgaggtaaatgcgtccagaatccgtactatctcttgttgtacatcaagaggggggattgggacaaagaatgcttccataaccttagagtttagattgttaatcgttgagctgtttaaaacttcattcaagtaattttggaataaatcgcttgttaaaatatgaaaaacataacgaggatttacatcgttgacacatcggattactcccatgaaaccgccgaagtaataatcaagatctgctgtaataaatgcaactttaccaacatgttctcggctcccgctggcggcacttattaaaatatcattcttatataatttttgattttcttttacttttgtatcaaatttaacaatcttgatatcgtcaagattcaatgtattgttagaaagagtaatattattcgctcttaaaattttatatccttcattattggggctttcattgtttttagtgtaagtgagtcctcgaatatagcttgcaatatctcctaaatgcttccactccacctctctaccattcaacaacttttcaataaaacgactttctatcatgttaaacctcataaaataggctttagcccatcatttaatcttttattttacaagagctacagctcatctcttacttttctatattttgcaaatttttactaaaatctaaccgcttatcacattactttagtaataacccttgacctttggatcccgagttgtacaattcgccttaataactccccctattttgccaacccatgaggttggagccacaaggttgggggctttttttcatcgtcaacaagcagacctctactttttagaataggctttattgttcaatttctgcaatgatcgcatcaatttctgtacgcaagcggtcaatattggcaactgttttgcgaatttcagcatttagtgccgtaatgtcgatgacttctcgtgtatctttttgttcaacataagaacttacggcgagattatattcgttttcagcaattttctgattttcaacggattgagcaagatgaggtacatcagttttttcgctaaataatttaatgatttcagcaatatgctcatccgttaaaacgttattattcgtttctttcttaaatagactgcttgcatcaataaattgggttttgttatctggtttgtgttttgaaagcactaaaatattcacggcaattgatgtgccgtaaaataaatttggagcaagggcgatcacggtttctacatagttattatcgacaaggtatttacgaattttttgttccgctccaccacgatagaaaataccagggaatgttacaatcgctgcacgtcctcgagtagagaggtagcttaacgcatgcaaaataaaagcaaagtctgctttggatttcggtgctagaataccagccggggcaaaacgttcatcatttatcaatgtcggatcttcatcaccaatccaacgaatagagtaaggtggattggatacgattgcatcaaatggtttatcgttttgaaattgtgggtcgagcagtgtattgccgagagcaatatcaaatttatcgtagtttatgttgtgtaaaaacatattcatacgagcaaggttgtatgtggtatggttaatttcttgcccgaaaaagccgtcttcaatgacatgatcatcaaattgcttttttgcttgtagtagtaatgagccagagcctgctgcagggtcataaattttattaacggttttttgtccgtgtaatgccagctgagcaataagtttggaaacattttgtggcgtaaaaaactcccctccagattttcccgcattagcagcataatttgaaattaaaaattcgtaggcatcgccgaaaagatcaatgtgattatcttcaaatttcccaaaatcaagttcttccaccccttttaatacagcagtcaaacgtttatttttatcggcaacggtattacctaggcggttacttcgtgtgtcaaaatcagcaaataagcctttaatatcttgctcagacggataaccgttcgctgaattttcaatatctgcaaaaatctctgccaattctatattcaatgtaggattggtgtgtgcatctttaacaacattctcaaacagttggctgggataaataaagtaacctttacttttgatcgtatcgtctttgatttgttctaaaataggatcgtcatctgaaaactgagcgtaattaacactttcatcgccttgttcaatataagccttaaagttttcactgataaaacgatagaaaagtgtgcctaatacatattgtttaaaatcccaaccatctacagaacctcttacttcattagcgatctgccaaatacggcgttgaagttctgcacgttgctgaatactgattatcattttaaaactccactaaaatagggtattatttacaactgaacgttattatactgaatataggcatattgttttttagtataggaagatatgtttattatttttgcaaatttagcacaaattttaattaatcaaactatttttatgaactttaaagaaatatcgcacactaacaagcgtgcattcaagaaaaataaaaacagcgtagaagttaggagaacgcaaaacgatgagtgagcaaagagccgatcaagaattggttgagcgtgcacaaaatggtgataagaaagcgtttaatttactcgtcgtgcgttaccaaaatagagtagctgggttgcttactcgctatatcgcaagagacgatattccagatattgtgcaagaaacttttattaaagcctatcgttcattaaatgctttccgtggggagagtgctttttatacttggctttatcgaattgctgtaaatacggcaaaaaaccatttaaccgccttaggcagacgaccaccgaaagaagatattttagctgaagatgcagaagtttatgatggtggggtgcagttgcgtgaggctgatacaccagaaaatttggtgttgtctgaagaattaaaacgtgtcgtgtttgacacaattgaaaacctacctgatgagcttaaaacggcaattacgttgcgtgagcttgaagggctgagttatgaagaaattgcagaaacaatgcaatgtcctgtgggtacggttcgttcccgaatttttagagcaagggaagcgattgatgccaaaatcaatccgcttttgtagcagaattaaaatactttggagttatctatgcaacataaagaaacactttccgcctatatggacggacataaagaaagcggtgatttcgctgaaactttatgcaatagtgctgagttacaaaaaacgtgggcgaactaccatactattcgtagcgtgatgcgaagtgaagagcagattttgggtagtgatttctctgcaaaaatggctgcgttgctcgaaaatgaggagattgaggcggtggctgaagctcaacaaagtgagaaaccaagaggtatgttactcaaattgaaacgctgggcaacaccgttaatgcaggcggggattgcagcttctgtctgcttggtagccgtttggggtgtgaatatgatgaacagcagtgaggaagtggctcaagcggagcaacctgtattgcaaaccttgcctttctcaaattctgtacagcaagtaagctataatgcgccagccaaagatcagccgacagctgaacatttggagtatcagcaacgccgtattaatgtgctgttgcaaaatcacgagttacaacgtcgtactagtgcaggaaatgtgactttaacggaagatgagaaacaaaaagcacaaaactcttccattcaagtgccattacagccacaagcacaacctcaaaataatcagtaactttttatcactctgggggcgttttaaacgcccttcagattattgacaaagtggcttgtagggtgggtcttgacccaccatatagccgtaacatattgattttattggtgggttaaaacccaccctacaatattcaatccatctaatatatggtttgtcagcagcctgaggggcgttttaaacgcccctccattttttatatacctatggaaaacgaaattgaacttaaaataatgctactgcctgaaaatattccggtgttaaagcagtggataaatgctcaacctatcttagaacaaggaaaagagctgttaggaaatacctattatgatagccccgctctcttttttgcgaacaacaaaatgggattacgggttcgtcatcaaaatcagcaatatgaattaacccttaaaatgaaaggcgaaattgtaggtggattgcatattcgccctgaatataatctagcattgcctgatgctcagccagattttaagcggttagtttctcactttaatttaccctttccgcaagcagatttattagacagtcaattacaaccaacttttagcaccgattttatgcgagagaaatggttgattacaacgccgacggctcaaattgaaattgctctcgatcaaggcaaagtgaaaaatccttttggggaagaagccatttgtgaagtggagtttgaattaaaacagggaatgctagcggatttaattgcatttttagacacattgcctaaacaagatggaatgtggtttagtagcttgagtaaagcccagcgaggctatttggtcggacagcctgagcagattgcaaaagagatcgataaacttaccgcttgtgatatagcacaattatcagaaaaagctcgttatcagttagagcaacagttggtggacttttggcgactaatgcaatcgccgaaattagccgaaaaattagcgacgctatatcctcagcaagcaatggaatattttacagggcgggagtacttcaagaggaatttggaaaagttgaatgtttggatttaaaaatggctatataattctaataatcttcctcttatagtaagtaggagagtaaataattggcatagtagacaaaaagtgttggttttaaaattatttttctaattaccgctaattttttgtctactatgccgcttgttattgtttactgtatcaggtttatctattacatcgaaataaaccagggctgagtcaggaaataccatcaccagcccttttacattcattttttataacataggatattaactcctacgtataaagcagctatagttttggacctgctgcaattaatgctttaccttcatcgttggttgcatattgctcaaagtttttcacgaaacgacccgctagatcttccgctttcgcttgccattgagctttatctgcataggtatcacgagggtctaagatcgcaggatcaacaccaggtaatgcttttggaattgctaaattgaagattggtaatgaacccatttctgctttttcgatagaaccatctaaaatcgcatcaatgataccacgagtatctttaattgagatacgtttaccagtaccgttccaacctgtattcactaagtatgcttctgcacctgatgcttccatacgttttactaacacttctgcgtattgtgttgggtgtaatgataagaacgctttaccgaaacacgctgagaatgttggggttggctcagttacgccacgctctgtacctgctaatttcgctgtgaaaccagataagaagtagtatttggtttgctctgaagttaatttagatactggtggtaatacgccgaatgcgtcagcagttaagaagattactttcgttgcgtgacctgcttttgatactggctcaacaatgttatcaatgtgataaattgggtaagaaacacgagtgttttctgtttttgaaccatctgcgaaatcgattgaaccatcttcacgaactacaacgttttctaataatgcgtcacgtttaatcgcacgatagatgtcaggctcgttttcttctgaaaggttaatagttttcgcatagcaaccaccttcgtagttgaatacgccatcgtcgtcccaaccgtgttcatcgtcaccgattaatttacgttttggatcggttgataatgtggttttacctgtacctgataaaccgaagaataccgctacatcgccatcttcacccacgtttgcagaacagtgcattgatgcaatgccttttaatggtaaccagtagttcatcaatgagaacaaaccttttttcatttcaccgccgtaccaagtaccgccgattaattggattttctcagtaatgttgaatgctacgaaattttcagaatttaagccttgctctttccagttcgggttagttacttttgaaccattcattaccacgaaatctggtgtgaagttcgctaattcagcctctgatggacggataaacatattttttacaaagtgtgcttgccacgcaacttctgttacaatacgcactgcaacacggctgtctttgttcgcaccgcagaatgcgtcaataacaaatagacgtttatttgataattggttggtaacaagttctttgatactttgccaagttgattggctcattggtttgttatcgtttttcacttcgtcgcttgtccaccaaacggtatctttggtattttcatctaatacgatgaatttatcttttggtgagcgacctgtgaaaatccctgtatcaacagcgaccgcacctgaagtcgttaaacgtcctttttcaaaaccttctaactcaggtttcatctcttcttcaaagagttgttcataacttgggttataaacaatctctttaacgtttgtaatgcctaaaagtgcaagttcttgttcaacacgatttaacataaattcacctcatatatgattaaagattaaaatttaaaaactggagagattatagagtaattatccaaaaaaaatgttacatacttcaaatttttgagaattgataaaaaatttttttgatctagattatattttttgtaattcggggtagaatagttcatcttttttattgaatggggtaaaagaatgcgagttttagttgtcgttttagcacttttattaggtggtttccagtatgcgttttggtttgggcaaaacggttggaatgaataccaacaagctaaacaagaagtctctcaactgaaagaaactaatcagaaactgaccgctcgtaatcaacttattcaagccgaaatcgaagatttaaaaacgggtatcaatgcccttgaagaacgagcaaggcttgatcgtgaaatggttaaaccagatgaaacgttttatcgcatcgtcccaagagagcaacgttaatgaatagcaagcgaaaaatcattgcgatcattcctgcttctggcgtaggtagccgaatgaatgtggctgtgcctaaacagtatttaaccttgctgggtaaaacgctgttggaacatacgctacaaccttttcttgaacaccctgcgatcagccaaattattgtggcggtatccaaagaggatcgctattatggcgatattgctctgcttaactctggcaaaattcagattgtgtttggtggcgaaactcgagccaattcggtatttaatgcccttaatgccattgacgatgatacggcttgggcattagttcacgatgcggctcgcccttgtcttaagcggtcagatttagacaaacttttgcagattgaagataatcaaggggcaattttagcaacccctgcaattgatacgatgaaacgggctaatggctcgcagattgctcatacggaagatcgttcaaccctatggcacgccttaacgccacagttctttccagcgaaattgctcaaagaggctttacaatcggcttttaagcaaggcttaaccatcactgacgaggcttctgcgatggaatttgcaggcttccacccgttattaattaatgggcgtagcgataaccttaaagtcactcgtcctgaagatttagctctcgcagaattttatctaacaagaggataataagatgattagaattggacacggttttgatgttcacgcttttggacaagatcgtccattaatgatttgcggcgttgccgttccctatcatacaggctttatcgcccacagtgacggtgatgttgctctacacgctttaagcgatgctctgattggtgctgctgctcttggggatattggtaagctctttcctgacacggatatgcaatacaaaaatgctgacagccgtaaattattgattgaagcctaccgccaagttcaagcaacgggttatgtggtagggaatgttgatgtgacaattatcgctcaagccccgaaaatgcgaccttatattgaccaaatgcgtcaagtgatcgccgacgatctcaactgcgatatttcttgcgtcaatgtaaaagccacaaccacagaaaaattaggttttaccggacgtggcgaaggcattgcttgtgaagcggtggcgttattaattaaaccagcattatgcagtagttacagaaatatttaatttctttcgtagcatcagtgttcaaaccatatttcataaagagagtatagtaatgctattcaaaatacctttgttacaaaaggctgctaataacattgaaaaattaaggtagagtttgctcaacaatttttttcttttaatttgctttccattggttgatacaaaattgtggtaaactatcgccattttttagttacttaaaaatactatgccaactgtcaatcaatcctctcttgtgccttatagtgctgaacaaatgtatcgtctagtcaatgactatgaaaaatatccgcagtttttatcaggctgtgttgaggcaacgaccttaagtttaggcgacaatgaactcaatgcagagttagtcattcaaaaattggggattagccaacgttttagcactcataacacgatgattccaaatgaaaaaattacaatggagttattaaatggaccgttcaaatatttaaagggtgcttggacgtttcagccctttgatgaacagagttgcaaaatcagcctaaatttggaatttgaattttcaagcccgatgattggtatggtgtttggcaaaattttcaatgaattaacgctcaaaatggtgaatgcgtttaaacagcgagcaaaagaggtgtatggtgtctgatacgcaaaaaattgtggtggaagtgatttacgcttatcctgaaaaatatttttataagaaaatggaattagacaatccactttccattcaaaatgtgattttgcaatcgggcgtattgcaaaaacatacggaaattgacttacgagaaaataaagtgggtgtttttagtcgtcctgcgaaattaacagatatggtggaaaatggcgatcgcattgagatctaccgcccgttaatcgccgatcctaaagagattagacgtaaacgagcggaagagcagaagaagtaacctataagggttatttcacaattttgaatttttgtgttgggaatattgtatcattaatttgtagatctaatgtatagtcgccaattggatccgtgttatcaaatttccaacaacgacgaatgaattcgttatttacacttttcatttggcttgtaatagtatgcattttcccatcttttgttgatactacattatcgccttgtccccccctcattgtagattttgctgggctattaaatatttcagtcgttttattttgagcagtaaaaggtacattaattacttcccagcataattgaatttttttattactgatagagtatgttgtgctatttagtgacttagggacttccccactaaagtcaattgtggtgagcaccatcatagggggctctggggcaatatctgctgttgcagcaaatcccattgtagatggtagaagcagactagttatagtaataagatattttttcatctatttttcctctgatttttgatgggtatcacgcagttgttgagcgacaatcgcaattgcttcgccgctgctgataccttgttgcataagttgttgaatttgttgaacggcttgttgttgctgttcgtgagttaaactcagtagtgtattatccatatagaaccatgataagtctaataaaatttagtaaagttccaactaaattgcgtaaaaagtgctttccactgttcgtcaagcggtgcttttatctcaattgtttgcaaggttttcgggtgaataaattgcaaactattggaatggagcataagtctatcacagcctgtgtttgctgttaatactcggttttgatgtaggtctccgtaattggtgtcgcccataattgggtgaaacagatgtttcaaatggcgacgaagctgatgtttcctgcctgttttggggtagagttgtaccagactataacgtgcggttgcaaattttcctgcagggtagggcatttcaacggtagcaatgtttcgataatcggtaatcgcttcttgtgcctctttttcttgggaaaatttatccgcaattttgtcgagttgcactttaagaggataatcaatccgcccttccccttgtagataacctcgaacaacggctaaatagcttttttgtatttgatgttgtttaaaaagctggcttatcgtccgtgccatttcgctatttaaggcaaaaagaagcacgccagaagtcggtcgatctaaacgatggatcagaaaaacgtgttgcccgatttgatctcgtaaagtttgcattgcaaaaactgtttcgtgtttatcaagccaacttcgatgaaccaacattcctgcaggtttgtttatcgcaataagttcatcatcttgatagataatctctagtttcattcgcttttcaacaaggtttcaagtttaacaaggggagcgtttaaggcttggagataatctaaatctttcaaggcttcttctagataaggcgaaatagcaaaattgcgaggcaattcggcattggcttctaatagggcgtgcattcttggtaagaagatccattgtaaccattgggttgcagagagtgtgctaacacaaaaaggttcatcattggctaaggcttctgcggaaggcggagttgcttcccagagattatgtactcgcaaagcgatttcgagatcggttaggtgttgttttacttgggttttcattgttattttatatgattaagaattcattgattatgttctatctacactattgtgtatcgagatatttttccctgctgttgacttaacaactgctctgccccatctttatccagatccgccaagatcatcataattgccaatttcgcattattctccgctaaggctaaggtggtttctgcaatttcacgggaacattcagtcgcttgcattacaatccgaatagcacgagcgacaagtttttgattgcttgcctgcacatcaaccatcaaattttgatagcatttgccgattaaaatcatacttgccgtagtaagcatatttaacactaatttttgtgctgttcccgatttcattcggctcgaccccgtcaaaacttctgcccccaccacagtatcaatcacaatatcggcaatttggctcattgcagaattagggttgctggcaatcgacactgtggttgcaccaagctgtttagcgtatgctaacgcgcctaacacataaggcgttctgccgctggcagcaatgccgaccaagacatcttttgggctaaattcgaccgcttgcagatcttgtttacccgcttctttgttatcttccgctccttcgattgggtgtcgcaaggcacgctcgcccccagcaataatgcctttgaccatttcaggtgacaccccaaacgttggcggacattcggacgcatctagcacgccaagtcgtccgcttgtgccagcgccgatatagactagccgcccgccctgctgaaaggcttcgacaattttctcaacggcttgggcaatctgaggcaatactttttcgatcgccaatggtacttgtttatcttcattgttgatgatttgtacaatttcataggcagaaagtgtatcaatctgcatactgtttggattacgctgttcggtaattaattgccctaaggtttttagaagatcttgttctgccattgttactccttttatatgttgggaaaaattgcccctaaactgaccgcttgtgtcgcccctgtgacgctaggcaaattcgcaggcagattgtgtatcctttgatacgcaagccacgcaaatgctgccgcttccacataatcgacatctaagccatattccgttgtagtggagacctgccaatcggttaaatgggtttgtaaccgttccattatcaatggatttttcgctccgccgccgcataccaataaaacacagggataagcctgcggattttcaatttgccgtaaggcttgcactatgctttgtacggtaaattcaaccagcgttgcctgtacatcttcagcaggaagcggtttaatttgggttaatttatgttccaaccattccaagttaaacagctctcgccctgtgcttttcggcggtggtagttggaaaaagggttcgtctaacagcaatgcaagtaaagcggaatgaattttccctgtccttgcccattcgccgttcgcatcataccgcttgccgagatgtttttcgatccaaatatctaataaggtattgcccgccccgacatcatagccgatagtctgctggttaggattaagcacggaaatattgctgatcccgccgatatttagcacaacggttaggcgttcaggggaactaaacaccgcttgatgaaaggcaggaaccagcggcgcaccttgtccgccaaaagccatatcccgacggcgaaaatcacctacagtagttatacctgttctagccgccaataaattcatatcgccaatttgcattgtaaaaggatattgcccttttggtgaatgccaaacggtttgcccgtgacagcccaccgccacaatatcatcagcattgagttgatgtttagctaaaaaacgctgaatactgtcagcatagagcaaggctaattggtgatcgagttcgcctaatgcttgtaggcttgtttccccttttttgactaactgcgacagggcaacacgaagtgtgtcgggcattggggtgaagtcggcagcaattaatttgggcgtttggctaaaatcgactaacgccaaatcaacgccatcaaggctcgtgccagacattacgccgaggtaattttgagaaaccataggtaattataaaaataaaatactgctttcagctcaataatagaggataaaaattcatgtatttatgtttgagttctgattagccaatagacgttaggcacgattattaaattgctatgagataatactatgttgttttgctctaatttccgtatcactgtgcagtggcgttatctagagcaatattgctcactaagcctttattatcaaagtaaacaaagatagttctttggataggagcttcatagcctttacgcaaaatgaacacataatcccaacgatcttgagcaaaggaatctcgtagcataggtgttccaagcagatattgaacctgctctttattcataccaacttgcagttgatcgattttttcttgctctaaatagttaccttgtggcacatcaatacgataaacgactttttttatcgtagagcaagcagtaacacctaaggcaagtaataatacagcaacaagcgatttcattttcatagcgataaccttcctcttaaaatttttggcgattataccgaaatcgccgataaaatgtcattatttattacgttctaattgatctcgtaaatttgcaggcaatcctttgattgtcaaagtatcatttagttcatcccaaataatacgttgggacaataattcagcgtcaaagctgatcgtcaccccttttcctgaacctgagtatttggttaacgtttttaacgcattacgcacaggcggaatactttcttctaaaccgtactcttgttgttcagcaaagtcagcaaaatcaatctcttttaaagttggcattgaagccgataattcgctgattgcaatttcttccccactattgatttgccctttacagtactcaaacacctgttttttaaccgcttgagtttggttactatctaactcgccttgttcacaataatcactcaccgcttgaagcaacgtttgattttgcacttgcggatttaacccttcttcagcccctaaaaagtccataaagaagtcggcaactttacgcccaacacgccctttaataaaggtcaaatagcggttagattgtgcattgtgttttagttcagtaaggttgatacggcaagcaatatcatattgtgtaatatcgagatattccgtgcgtttcacttccagtttatcatcaaccaacatagacgcacggctatcaattaatgcaataaagagatattccgtcgctaaaaaggtataacggcaaaggataaaagttccgcctgaagcaaaaggatatttgactaattctgtcgctaacattttggcacaactgtggctaaaaggcagaaattcgctttcgccttctaacaagcggtttaattgttgtgcaaaaatggattccgattgaaatatgccataggctttcgctttattttgataggcttgatgtagttgcaacatcatctgttcaacttcagggctgatcgcaagcagatcttcacgtaaaacagtatgaagctcagcagtttcccctgcggtttgttgaagttggtgtaaaacaatttcggtaacgttaatgctcataaattattctcgattataggtaaaaagttaaagtcctttgattgtatcaaagagtagaattaaggttaatggcatattttccaatggaatagcaccataagattgataccaacgagaaatgtcttcatcttttgcttcaatgagaagcccaattcccccgacttgttcggcaacgatggcacagcgtttgagagctttaactaacagcattccgccaatgccttgtttttgatagcgaatatccactgcaagtcttgctaatgtaaagagcggaatagggtagtagccaaaacgttttttgcatagttcgggtaagtgttgctggtctaatgcacttaaggtgattgtataaaatccgataatctgttgactgtctaagtgtcggctaatgtaagtttttgatgtccctttttcgtgagattgccgagcgtattgtttaaaaaatcggttcatctctagatttccgcaatcaaaggcttcacgttgatgatgcttcgttaaaggctcttcaataaacttactcttcatgatagctttcctttgctaatttcgccgcttgttgtagttttgtattagctttcggcggattatcaagcaattccataatcaacgagagatcttgcggtgaaaattgccgattatcatactgctgaataatttctctggcactaggcaaaatacgttgtaatacaaattccgtaatattcgtatgggtaagtgcaacggctctaattaaagtctgcttgtcttccgtactaatgcgaatagacattctatcgttaagggcatttgcaatttgtggcataataaatatcctatttgtacagattaaagtagtacgaattttaagtgaaacagtagtaatcttcaataaaaatcacctttacaaaccacaaaaaaactttcaaactcgcaatgttgaatttaatttatttcactaggagatttttatgacaacagttattcataccgaaaatgccccaaaagcaatcgggccttatgtacaagcggttgatttaggcaatttagtgctaacatcagggcaaattccggttaatccaaaaacaggcgaagtccctgcagagatcaaagctcaagctcgccaatcccttgaaaatgtcaaagccatcattgaacaagcgggtttatctgtagcagatattgtaaaaaccaccgtatttgtgaaagatctcaatgactttgccacggtaaatgctgaatatgaagcctttttccgtgaaaataatcacccaaatttccctgctcgttcttgtgttgaagtcgcacgtttaccaaaagatgttggcattgagattgaagcgattgcggtgagaaaataaacaatgaaaaaaattctgccaacttggtctgttcctgatttcgttcacgcattcactaccactcgagaaggtggggtaagccaagctccctttgatagcttgaatttaggtgatcacgttactgatgatccacaatcagtgcaaactaaccgtgaaatcttgcaagaacaaggcaatttgccacattttccgctctatttaacgcaaacccatagtacaagagtgctacgtctgccctatgaacaaaacgacattgaagcggatgcagtttataccaaccaagcaaaccaagtctgtttagtgatgaccgcagattgtttgccagtgcttttttgcagtaaagatggcaaagaaattgcggcagcccacgcaggttggcgtggcttatgcgatggtgtgcttgaagctacggtggcagaatttgaatgtgagccagagaatatttgtgtttggcttggtcctgcaatcggtccaaccgcattccaagttggcgaagatgtaatagaacaattttgtgctttcgatccccaagcgagagaagcctttgtggcagatgaatatataagcggtaagttcctaggtaatctttaccagattgctcgccaacgcttaaataaacttggaattacggaaattgcagggggtgattattgtacctattgcgatgcagaacaatttttctcttaccgtagagataaagtcacagggcgaatggcaacgctgatttggcgtagtgaataattaagacttaaacaatatatatcttttcttttttacaaattgattcagaggtgttccgcctagatgaaatggtggtacattacttaaaatatatggtggattttacctctctattttatcgtaatatattgatttagttggtaggggacttccacataattctactgtatttaaatgaaacaaacttatatttatttacaaaccgatcttcttattgtcggtggtggtatcgcagggcttgcgtgctgtgctgaagctaaggctcagggtattcaagcgacattaattaccaaagcccctatcggcagtggtgcaagtttttttccgttaaaagcaacacttggtattcaagtaactggcgagcaacaagataaagcacgctttcaagaagatattgagcgtgttgcacagggaatgaataacccgaaaattgtgcaagtctatattgaagattcgccacaggcgattgagctattagaacgtattggctttaaaccttggaaacggaatgacaatcgccccgcttgctttgcgaaatatccacgcccgatttatttgattaatcagtggcgagaagcagcggaaagagcaaggcagattatcaaagaacaggggacgacgatctatgaagatgcaacgctgttacatattgtcagcgataatcagcaagttcaaggggcgttgttttcctataaaacaagcggtgagatccgctatgtgctttgcaaaaccagccaaattattttggcaacagggggaattgcagggttgtataaagataacctctatccagccgatgtgattggttcaacccatgccattgctgaacaagcaggggcaaggctgactaacttagaatttattcagtttatccctgcttttgttgagcctaaatacaaagtgctgtttggagagcataccttaaaatatgtcagtaaagtgactgacagccaagggcgagatctgtttccacacctttcaccacagcagtttcaacagatgatgactgctcgcagtgattatgccccttttagtattgatttcccttgcgttgagtttgatttggtgatgatgaagcacttgctcgaacacccagaagaaaaaggcatttatctgcactattcccctgagctgtatcaggatcaaacggaattttacaccgtgtatttaagctggttagagaaagaagtcgggattaatcttgtgcgagatagggttgcgattacgccatttgctcacagttgtaacggcggtattgtgatcgatgaatttgccgaaagtgaagtgaaagggctttttgccgtaggcgaagtttcttcttgcattgaaggggcgaaccgtttaggtggcaattctgtcggaggtagtttggtttttgctaaacgagcaatccaacggattttgcaaaatttagcggaaaaccgaccgcttaccaacgatatagcgtgtgaacgtagtattgaacagtttttccagtcgttagcaaatccaaagggtgataaaatgctgacggcaagtgaagtgttaagcaccgttcgttctcagatggcaacatacgctaatgtttatcgaacagaggcgaatttggttcaactgttgaactgcttaacgcagttagagcaacgttattgcccccttgaatatcaagcctatcaaggtattgaaatttaccacgctctcaaagccgcacaaagtgtggtaaaggcgatgctgagtaggaaagtgagtttgggagcacattatattgtttgatgtatgctatttttttcaacaagtgttgaaaaatggactacgcaaacgttttctttttttgtagaatagtttccgttttgccgaaaggcaatattgaggtatttatggttgatgcgattattatcggaattatcgttttttctttattagtcagtgtatggcgaggctttattagtgaagtctttgcgcttgtggggtggatagtagcttttttggtttctagccatttttatccttatttaagtaattacttattacaaatcaactctgtctatatccaaaattccgaatatttgcgtaatggtattgcgattgcgattttatttattgccgtgcttatcatcagtgcagtgattaacgcattactcagccaacttgttgataaaacaggtttaagcggtacagaccgtgtactgggtgctggttttggtgtattaagaggcatttttattgtcgcagcgatactctttttccttgatacctttacggcatttagccaaagcgaattatggaaagaatcacaacttattccacactttgatttcattgtgaagtggttctttgaacagttacaagcaaattccagttttttaaaatctagctaatttaagaggtaattatgtgcggcattgttgggattatcggtcaaacccctgtaaatcaggcgttatatgacggacttacgttattacaacatcgggggcaagatgcggcagggattgtcacaattgacgatgaaaaccgcttccgcctacgtaaagcaaatggattagtcagtgatgtgtttcgtcaagaacatatgttacgtttgcaaggaaatgttggcataggacacgtccgttatccaactgcaggcagctcaagtgtatccgaagcacagcctttttatgtcaattccccttatggcttaaccctagtacataacggcaatctcaccaacaatgcagaattaaaacgcctactgtttaacctagccaaacgccacgttaatacaaactcagactcagaatctttactcaatatatttgcttactatctcgatcaatatccacacgaacccctaacacctgaaaatatctttgaaagcgttcgcaaaactaaccaagttattcgaggggcttatgcttgtttagcgatgattatcggacacggaatggtggcatttcgcgatccactcggtatccgaccgcttgtactcggcaaacgagaaattgacggcaaaacagaatatatgtttgcttcagaaagtgttgcacttgatgttgttggatttgaatatgttcgagatgtacaagcaggcgaagccatttatattacctttgatggacaattctactcagcaatctgtgccgataacccgaaattgaacccttgtatctttgaatatgtctatttcgctcgaccagattctgttattgatggcgtatctgtttacgcagcaagagtacatatggggaaattcttaggcgaaaaaattgcgaaagagtggacagatattctggcggatattgatgtggttatcccgattcctgaaacttctaccgatattgccttacaaattgcaacagtactgaaaaaaacttatcgccaagggtttgtgaaaaatcgctacgttgctcgaacctttattatgccggggcaggcacaacgaaaaaattcagtccgtcgcaagttgaatgccattgcctctgaatttaaaggaaaaaatgtattacttgttgatgattcaattgttcgtggcactacctcagagcagattgttgaaatggctcgacaagcgggggcaaataaagtctattttgcctcagctgcccctgaagtacgttatccaaatgtatatggtattgatatgccaacctgtgaagaactggttgcttataatcgtagcgtggaacaagttgctgaaatgattggtgtagatcgcctgattttccaagacttatcggcgctctttaagtctgttcagttagaaaatccagatattcacaactttgacgcttctgttttcactggggaatatataacaggcgatgtgagttgcgaatacttaaatgcgatagctcaagcgcgcaatgataaagccaaaaccgcccaagcgaagcaggcaggtaatttggaaattcataatgaataatcaagaatgaggcatagcaggcaaaagtgttggttttaattatttcccctaattattaggcggcatagtagacaaaatgcctttagtatttgacgactaaaggcatttctcgtagggaagttaattatgattattcatctttatcgattcggctaaacaccgcactttgctgatttttatattttgcatctttacgagcattatatggatgttctgcgtaaccacttaaaatttcaaagctcaatgcaccaattgccatattaggacgtaatgcaagcggtaactttcccgcattaaaaaactcaagtacgattttgccttcccaacctggatcgatacgatgggcagtaacgtgtaccattaacccaagtcgagccaaagaagaacggccatcaagccagccgactatgttggcaggtagtttcactgattcaagcgttgttgctaaagccagttccccagggtgtaggaaaaaggcttcatcatcggcaatcaggatttcatcactcatcacacgattaagctgtgccgtcatttcttcacgtgggccgcttaaatcaatataaggcgttgaatgttcacgaaacacacggaaagaattacccaaacggacatcaatcgtcgctccactgattttttcatttgatgggcgaggcgttaggctgataatcccttcatcaagataacgttcaatatctttgtcacataaacgcataattccccctaatatattaactatgtcctaatagctgtttaatttgtgctttcaagatattaatcgcaatacggtttttaccgccttttggaataataatatccgcatactgtttagatggttcaacaaattgtaagaacattgggcgaaccgttttacgatactgatttacgatagattccattgttctgccacgctcctccatatcacgctgtaaacgacggataaaacagatatctaaaggggcatcaacgaaaatagacacattaatttcatcacgaattttttcatcagtaagtaataaaataccttcaagaatgatgatttttttaggagtgaagtgggttacggtttctttgcgattatgttctgcataatcatattctggaatatcaacagcttgcccttgtttgaggcttttaagatgggtaactaacagttcgtgatccattgagtttgggtggtcgtaattggtttttacccgttcttccattgcaagatggctttgatctcggtaataagcgtcttcagaaataataccaatatcatcttgccccaattccgcttgcaattctttgtaaatagtcgaagcaataagacttttaccagaagctgaagcccctgcaattgcaataacaatacaagattccttttgagtggtgtttgacataattaaatccttgaacacacaactggagaatttagggaattatatcgcaaaatccgtaatcttttgaagataattaccgaattttggagcctgtactaattttagtagtattcatgcttcatgtcagttcagtattcatttaaacaaatgtgtatagtaaacatgaattacatctaattaaatgtaggtttacaatcttcttgcttgccaaaaacttctagaccaataaggtgaattaatatctgaataaattaccccaccttttgttgaagcgtgaagaaactgcccatttttgacgtaaatgccaacatgtctgccatttggcccacgaccagttttaaaaaagacaagatcacccgtacgtaattcactctttgagatttgtatgcctgcttttgcttgatctactgttattcgaggtaaatcaataccaaataactctcggaaagtaagttgcacaaaaccagagcaatcaataccgctttttgttataccgcctagacggtagcgtgtacctttccactctctttgatgttcgcttaaactgctaatcacaaaaatggagtctgaaagctgccctttatgtttatttccgcttttatcttgaaccgtagtgatttttgatacacaagcggacaacaaaaatgcacaaaacagcattgtgtataaagaaaaatgcttttttattaactgagaaaacattgcgatccttaaaaatattctgcgaaataccaagatttcgcagaataatcatttaggcttttaccttcgcattttcgacacgttcacgcaatttttgtccagctttaaaaaccacaactcgacgagcagacactgcaacatcttcgccggttttaggattacgacctggacgagcttttttatcacgaacagtaaaattgccgaagcccgacagttttacctcttcaccgctctctaacgagcgacgaatttcttcaaaaaagtcctcaacaaattgttttgcgatacgtttatctaaaccacatctttcgacaaggttttctgcgatttcaattttggtaagtgccataatttatccttaaaatctaatctcttagataagcattaaaacgttgtgcaagtgtttcgagaacagcttgaagcaccgcattaatttcttcctcttcaagagttttttcagtgtcttgaatcgttaagctgatcgctaaacttttcttaccttcaggtaaatttgtgccttggtaaacgtcaaataaattcactgccacaagtttagctccacctgcttgtctagccacatcaagtagatcacctgcaggtaaattgctatccacaaccacggcaatatcacgtttatttgcagggaaacgtgaaatttcttttgcatttggtactgaacgctctgcaatcgcagaccacaataattcaaaagcaacaggtttacctgacaatccgagtttttgaacaactttagggtgaattgtgccgatataaccgatctcttgatcgtcgagtaaaatagcagcagattgtcctgggtggaacgcaggatatgattttgcaacaaaacgtaaacgattgccagcatttgttagtgataaaacacgttctaaatccccttttagatcaaagaaatcgacgttttctgctttatgttcccaatgtgctggacgtttatcccctacaatcactgcacctaatacaaattcttggcgtatgccattttctgcattggtatcaggaataaagcgtaaaccactttcaaaaatacgcactcgattttgctggcgattttggttataagcaacggtttcaagtaagcctgttaaaagcgacacacgcattgccgacatttcacttgaaatcggatttggtagaattaacgcttcttggcttggatgtaacagctcttgcacttttggatcaacaaagctataagtaatcacttcttgataatcgctatcgaccaaagccgttctcacacgaatagcttctaaaatcttctctgggaagcctttcatctgtaaatgagcaagcggtgcgttatttggaatgctgttatagccgtaaatacgagctacttcttccacaagatcttcttcgatctcaatatcaaaacgccagcttggtgattgaactgtccagctctcgtctgcatagcttgggtttaagcctaagcgagctaaaatatcggttacggtttctgtttcaatatgatgaccgagtaagctatctaatttactacgacgtaaaaccacttgttttgacgttggtaaatgagccgaacttaccgcttctacgatttcaccagcttcaccgccacaaatttcaagcagtaacgctgtcgctctttccattgctttacgcgttaattctggatcaacgccacgttcaaaacgatgagatgcgtctgtgtgtaagccatattgtcttgcacgacctgtaattgcaagcggtgcgaagaatgcagcttctaacaccacatctttggtttcggcacttacgccactcgcttcaccaccaaaaataccagccattgcaagcggtccgttttggtctgcaattagcaaagtatttggctgaagttttgctgtcgtgccatcaagcaatatgagttcttcaccctcttttgccatacgcacttggattgtaccgttgatttttgctgcatcaaaagcgtgcattggctgaccaagttccagtaagctcagattggtaatatccacaatcggatcgatagaacggataccacaacggcgtaatttttcttgcaaccataatggtgactgtgctttgacattcacatttttcaccacacgacctaaatagcgtgggcaagcttcaggggcttgaagttcaatcgtcactttatctgcaatagttgcaggcacagcttgaatttcaggtgcattcaccgctaattgattaacaaccccaacttcacgcgcaattcctgcaatgcttaaacagtccgcacggttaggcgttaaactaatttcaatggctctgtcatttaatttgagatagtcacggaaatcaataccgactggagcatctgctggcaactcaataataccgctatgatcttctttaatccctaattctgagaatgagcaaagcattccctctgacggctgaccacgcaatttagttttcttaattttaaaatcacctggtaacaccgccccatctgttgcacaagccactttcaaaccttgacggcagtttggtgcgccacaaacgatatctaataaacgttcgccacccacattcactttggtaacacgcaatttatcggcatcagggtgctgagcgcactcaaccacttcgccgatcacaacaccgttaaattcacctgcaaccgcttcaacggcatcaacttctaaacctaacatagtaatttggtcacatagctgttcgatggtaatcgctggattaacccactcacgcaaccaactttcgctgaatttcattatttctatcctatatttgtaacgttttctacaaattttaccgcttgttatgatagacacacgcagtgtgtccctacaagagaaaataagccattaatatagtagggacacactgcgtgtgtccgcaaactgcatatatccgcaaaatgattagattacttaaactgctttaagaaacgcagatcattttcaaaaaatgaacgtaaatcggtcacgttataacgcaacatcgtcaaacgctcaacgcccattccaaccgcaaaaccagtgtattcatcaggatcaatgcccacattgcgaagtacattcgggtgaaccattccgcaacctaacacttcaagccatttaccgtttttacccattacgtccacctctgccgacggctctgtaaatgggaaataagacggacggaaacgcacttgcagatcttcttcaaagaaagctcttaagaaatcgtgcaataagccttttaactcagtaaagttcgcttttttatctacataaagcagttcaatttgatggaacatcggcgtatgggtttgatcgtagtcgttacgataaacacgccctggtgccataatgcgaataggcggttgcattttttccatagtacgaatttgaacgcctgatgtttgtgtacgcaacaaacgctctgcatcaaaccagaaagtatcgtgatctgcacgagcagggtgatgtgcagggatatttaacgcatcaaagttataataatccgtttcaatttcaggacctttctctacactaaagccaagttctgagaagaatttcaccacacgttcaattgtaatcgacacagggtgcaaaccacctaactctgttttacaaccaggtaagctcacatcaatactctcactcgctaatttagcattgagttcttctgtttctaactgctcttttttcccatttaacgcatcttgtgctttctgttttgcttcattaatttttgcacccaccgcaggacgttcatctgctggcacatcacgcaagccttgcattaacaaggtaaaatgacctttcttaccaaaatattcaacacgcaatgcttcaagacttgcaacatcactggctttttcaaccgcttgcaacgcttcagcaacgatattttctaggttttgcatacctaccctctaatcaatttcaacataaataaactgaatgcctcattcataggcaaaacgccttgaataataatacttctaagcgatattgtaaatttaaaagtgaggattttgtgggggtaacattttgatttgtaacagctatcaaagataaacactgtgattattttaccatttttgctaaaaaaacaccaaatattaccgcttgttaaacattaatccgtgatcttcttgaaaacatacggtaaaatttacaccgatttgcaaaagtgcaaatcaacgctgttaaattttattggagatatacctatggcaaagaataatattttaggattattcgcacagtcgccactcaagccattacaaaagcactcaaaaaaagtgactgaatgttgtggattactaatcccattttttgaagcgagttttcaaaaaaattgggaagtagcggaagatatccgtcgtcaagtcattgatttagaaaaccgcgcagatacccttaaacgtgaaattcgtttaaaatcaccgcgtggtttatttatgcctgttgaacgtactgacttacttgaactcgttacacagctagataaattagcaaactatgctaaagatatttctggtcgtgcaatcggtcgtcaattaaacattcctgaagaaatccaacctattttccaacaattcttaacccgtagccttgatgcaacagttcacgttgataaagtaattaatgaaatggatcacctacttgaaacaggcttccgtggtcgcgaattaaattttgtgaacaatatgattttagagttagatgttatcgaagacgatacggatcaacttcaaatcgtactacgccgagcaatgttagcgattgaacaacaatacaatccaattgacattatgttcttatacaaaattatcgaatgggtcggagttcttgcagatcaagcacaacgtatcggttcacgcattgagttaatgttagctcgttcataatcgaaagaggacttaaataatggaactgattcaagaatatggctcgatgattgtcttcatcaccgcagtgtttggcttctttatggcatttggtatcggtgcaaacgatgtttcaaatgcaatgggaacctctgtaggttcaggcactatcactgcaaaacaggcaattttagttgcaatggtttttgaatttgctggtgcttatttagcaggcggtgaagtaactgaaaccatcaaaagtggcatcattgatattcaccacttctctggcagaccagacacccttgtactaggtatgatgtcggcactttttgctgcaggtacttggttattacttgcctctaaaatgggctggccagtatccactactcactctattatcggtgcaattatcggttttgcgttagtcaccgttggtgcggaagcggttcattggggtgatttgtctggtatcgtaggtagctggtttgttacacctgttgtatcggggatcattgcttatgctatttttactagcacacaaaaactgatttttgatactgataatccgatgaaaaatgctcaaaaatatggtccattctatatgggtttaaccacattcattttgagtattgttacaatgacaaaaggcttaaaacacgttggtttacagcttacaatgactgaaaccttagtgatttcaagtgcaatctcaattacgtctatcatcacttgtttcttctacttccgtagccaatcttttgctaaccgtgtacaaggcggtgcatttggtggtgtagaaaaagtattcagcattttaatgttactcaccgcttgttcaatggcatttgctcacggttcaaacgacgtagctaatgcgattgggcctttatctgccgtagtatctatcgttgagaacggcggtgtgattgaagcgaaatcaattctcgccccttggattttaccattaggtgcaacgggtatcgttgctggtttagcggtaatgggttacaaagtaatgggaacgatcggaactggtattactgacctaaccccaagccgtggtttctcagcagaatttgcaacagcaatgaccgttgttgttgcctctggtacaggtttacctatttcaacaacacaaaccttagtaggtgcggtattaggcgtaggttttgctcgtggtattgcagcgttaaacttaacagttattcgtaatatcgttgcatcttgggttgtaaccttacctgctggtgcattcttctcgattttaattttctatattttgaatgcaattttctattaatttagaataatgactttattcagaaaagtgcggctattcgcacttttcttttatgattttttaaggattgtttatgcaaaaacatatttctcttttctgctcaactctgcttttagcaatatcacttccctcttttgctcaaacacagtacgttactgaaaatttgaatacctatttgcgtaaaggtccaggcgatcaatttaagatttttggttcaattcaagccggtgaaaaagttaccttaatcgaaaccaaagatcgttattctctcattcgtgatagtaaaaaccgtgaagcgtggattttaaattctgaattaacatctacgccaagctcaaaagaattaacaccgttattacaacaacaagttcaagaattaaccaccaaactcaataatattgatagagattggcaacaacgtaccgctgaaatgcaacgtagagttcaacaatctgcattacaaagtagtgaattacttgaacaaaatgcacttctaaagcgagaattagaaattattaaaaataaaaatcgtgatttagaagcaatacaagatgtcgcatctcgcgaaattatgatccaatattttatctacggaggagctgttctaggcttaggtttaatatttggattacttattccagcccttcttcctcgccgtaaatctaattatcgctggaattaactcaaaacaaccgtacttttagcttactgtgatgtttttaatttggggtatagtagacaaaagtgttggttttaattattttccctaattattaccaactctttttatttaaaaatcctttataaacataatcttacgctttttcgttaatccgctatgaaccgataatttctgtttcagttctttaaataacccttccaacctatttgttgttttttctatatttaggtgagtatattcttcaaaagtgagcttaaagccttgtactataaggctttagtccactttttaccaacattgtctactatgcaaaatatcctatctaaatcaccgctttcattagatttccgcctattatttctaacttttattgataaaagttgaaaaattcttgttattttatctttagttttgtgtaactctttgtttttttttttttttttacaatgggagggttctatttgtgcattcctagaaaaacgtaaataaaggtttacgatttgttttaattagggaaaacagcttggtagggtgggtcttgacccaccatgtacgccgtaacatattgattttattggtgggttaaaacccaccctacaatattcaatccatctaatatatggttttgtcaaggtagttaaccttcccccggcttggcgggggaagtgcccgagcgaaagcgagggcgagtgggggcatttgtgcatcctgaaaatgtaaataaaggtttatgattttttattaggaaaaacagtagagaaggttattatgaataaaatatttagagttatttggagtcatactcaacaggcttgggtggttgtgtctgagttagtaaagtctcataccaaaacatccgcttgcacggataaaagagctcaagtatgcacctcagattattttttagataaacagcaagataaatttaaattaagtcttttaagtctagtattactaagtatattttttagtccagtagcagtaggtgtagatcgtcataaaggaagtccatatcttcaagatggtgctactaaatcgaatttaggaactgacgacggtactattggtattggtaaaagtagtaaggctgggtatggtgctattgctatcggtcagtattcaaaagctgaagctaggcataatgttgcgataggttatgattcaaatgcaggaacaggcacaaactctattacgataggctacaatactcaagtaactggggaggaaggaattgccatcgggaaacagtcaaaagcgggagggagatctgttgtcttaggcggacaagccgatgcggcaaatattgaacaagcagttgtaataggtaaccttgctaaagcaagtaaggcacaatctattgctatcggggcaaataccaaagcggaggggtatggctccatatcaatcggtggagatgatttaaaaacaacgaaatatcaaactggtaatcaaggccaatccaaaacaacaactgcgaaaggtaaagcctctgttgctattgggggtatgtctttggctgggggcgaaggatctattgttttaggtcctgtagcatctgcaagtcatgttgaaggcattgctatcggtgcgagaagtaagtctaccgctgagtacggtattgcggttggtggtggtgcaactgctggaaaaaacgccgttgctgttggtagggactcgaaaggtgctggggaagattccattgcgataggtaattctgcgaaaacaacaggggcagactctgttgttgtgggtgccaatatcaatgtgacagatggacaattagtggcaattggataccaagcaagtgctaaaagtcattctactgccttgggttataaagcctctgccggtggtatgcactctgttgctgtgggtgataatgccgtgacaaatgatggtgctgctagagcaaccgcacttggtaataataccgttgtcaccgtgggcggcggtgtggcattaggttatggatctaatgcaagtacagctggcggtgtagaggggttaaaacaaaatcattctgtcacaacgggaacaagcactgaagctaacggctttaaatccacagaaaaggttgatggtaataataaaattggtgcggtttctgtgggtaataacctaatcaaacgccaaatcgtcaatgtggcggcaggtacacaagataccgatgcagtaaacgtggcacagcttaaatcgctcaccatgcaaacaggaggcgataacaacagcagtggcaaggtaggcatttggaatggtacgcttaaagtagtgggtacaagcggtgagattaagacttccgcaagcaatgataccatcacattgaaattagatgaaacattgaaaaataaaattgataagattgacaatttaggttggaaacttgcaattactcagggatcggggggtcaagctactcctttgaatagtccacatcttatcaaaatggaccagaccgtaacctttaccgctggaaataatattaaattagaacaagtgggcggaaatattacgatttctacgattattggtaagttaattacaaagactgaaagcctagcagatggtggtttgaaaattacttatacagataattcgcatgacattatcaagaaaggtgaaaaaggagatcgtggcgaaaaaggtccaaaaggcgatagaggagaaactggccctgcgggtccagcggggcctaggggtgaaccgggtccagtggggccagctggaccacaaggtacacctggtccagcaggaccacgaggaccgcagggaacagcgggtgctcagggacctaagggggataaaggcgaaccaggagaagcgggtccagcaggaccacgaggccctgcgggtcctaaaggagatgcaggtccaaaaggtgatacaggtcaggagaggtgaaactggctctgcgggtccagcgggaccaaagggtgaaccgggtcctaaaggtgaacaaggtattccaggccctgcgggtccagcgggaccacaaggtcctgcgggtccagcaggaccacaaggccctgcgggtccaacgggatcacaagaccctgcgggtccaactggaaattcggaattaaaaggcattacgtcgattgccaatggtaacgacgccaccaaggcgaatggggctaagattaccttgtctgcaggttctacagataaaacagttaatgttaatgatgcgaaaattaccaatgtggcggctggtacagcagatactgatgcggtaaatgtgagccagttaaatactaaggcagcagccgcaagaactgaagttgaagcgggtaaaaatgtgaaagtgacttcaaaaacgggggcaaatggtcagaatatttacaatgtgagcgtgtctggagatttaagcgacattacttcaattagtaatggcgatacgaaagtatctttaggtaaagataagcaaggaaatccagttgtaaatatgaatggcgccagaattaccaacgttggagatggtagtgctgagggcgatattgtgaatgttcgtcagctcaacaaagtggtttcttctgtgaatacaggatttaatcaattatcaagagatattggtcgtgttgatgttaatgcaagagcgggtattgcttctgctggggcgatggctaatttgccacaaatttctttaccaggtaaaagtgctatttctgtttctaatgcacaatatcgcgggcaatctgcctatgctataggttattccagaatttctgataatggcaaatggcttattcgagcgtctgttagcagtaatactcagcgggataccatgattggaggaggggtaggttttgtgtggtaatctagcacctataaattagaatttcatgctcaatgccattgttattttaacaatggcattgtttgtaatgccttatatatggcagcactatcggcaattcgctttgaacctgtttttaaagccttttacacccgattggttgcaaaaggcaaagcgaagaaagtcgctattatggcgtgtatgcgtaaactgctcaccattatgaattgacttttatgcaactgctgcattataccgattaaatctccgtcttctctttatactcacacaaatcttcaataatacaagagccacagcgaggcttgcgagcaatgcaggtgtagcgaccgtgtaaaatcagccaatgatgaacatcaaccttaaattcatcaggcacgactttcaacaatttttcttccaccttaaccacatctttccctggggcgaaattagtacggttagaaacacggaatatatgcgtatcaacggcaatagtcggctgaccgaatgcggtatttagcaccacatttgccgttttacgtcctacacctgcaagggcttctaattcttcacgcgtttgaggtacttcgccattatgtttttcaattaaatcacggcaagttttaataatgttttccgctttgctgttataaagcccaatggttttaatatactcttttagcccatcaagccctaaatctaaaatcgcttggggcgtatttgccacaggataaagttttgccgtggctttattgacccccacatccgttgcttgagcagataaaatgaccgcaatcaataattcaaaagggttggaataattgagttctgtggttgggtgagggttctcattgcgtaaacgggttaaaatttcaatacgtttttctttgttcattcattatcctataaaagcaaaatagctctgatcccacaacatttttaccaccataataaacgatatcataacaatcaacgggcgaataatctgttttcctttggtgacaaccattctcgcccccaatgaagccccgataaattgtccaatcatcattagaaaaccgattttccataaaatcgcaccgccaatgatgaagaaaatcagcgaagcaaggttagaggtaaaatttaacactttggagtgagcaacgctttgggtcaggttaaaaccaagtaataacacaaaagcgagcgtaaagaaagagcctgtggcaggcccgaatagcccatcataaaagcctattcccattgccgccgtgcaagcgaacatcggaaagctcattctttggcgacgttgttcatcgcctaggcttggactaaagagaaaataacagccaataattaagatcagaaaggggagggcaacttttaatgcattgacatctatcatctgcactaaaatagtcccgattgaaccgccgataaaggtcagcaaaataagcaaccaaatctgcttcaaatcgaccacttttttacgcacaaaatagagcgaagcggaaaacgagccgccacaagcctgtaatttattcgtgcctaacgcaaccgtagggggaataccgaccgctaataacgctggaatagtaatcaaaccaccaccgccagcaatggcatcaataaaaccagccacgaaagccgcaacaaataagataatcgcaacatcaagtccaagttccatatttccccctacgatctattaattaataatgcaccaccatttcatctcggtggaatactactgaaccaaactcatagcccaaaatggtttcaatctcgctagattttttgcctttgattaatgctagagcatcactgttataacgactaatgccaagggcaagcactttgccgttaaggttacaaatttttgccacttcaccacgcgcaaattgcccttcgattttggcaataccagtaggtaagagcgatttatgctgttctactaatgcgttttctgccccttgatcgatataaattgtgccagcaggcggcgcaccaaagagccactgtttgcgtccttcgattttgtcgtgttgagctaagaagcgtgtgccaatttccgctccttgtgccacttcaaaaatcacattaggacgttcgccagaagcaatcgctgtttcaacgccagaacgggtggcaatatcggcagcggtgattttggtactcataccgcctgtgcctaaggttgtaccacttccccctgccatttggcgaatttcaggggtgattttttcaacaacaggaatgcgtttggcattttggtttgaacgtggatcactgtcgtataacccttcttgatcggtgagcaaaatcaataactctgcttgagctaaaatcgctacgagtgccgataaattatcgttatcgccgatacgaaactcagccgttgccaccgcatcattttcattgataatcgggataatttgttgatcgagcaaggcggtgagcgtatcccttgcgtttaaaaagtggtctttattttcaatatctgcacgggttaaaagcatctgtccgattttgatgttataaatggaaaagaggctttcccacacttgaataagctggctttgtccgacggcggctagaagctgttttgtcgccaacgtttttggcaattcacgatgccctaagtagtcacgcccagcggcaactgccccagaggtaaccaaaataacacggtagccttgttcatgtaattgtgcgatctgtttaacaatttctagcatatgtggacggcttagacttttagtgccgtgggttaaggtgctagtgcctaattttactacgattgtttttgccataatgatttgtaaaaagaaaagaaacttttgctattatctgctaaaatcttttttatttcaaaagagttatgtcgctatgattcaaattagtttaattgttgcccgaaccttaaataaagtgattggcaaagataatacaatgccttggcatttgcccgttgatcttgcatggtttagagcaaataccctaggtaaaccggttattatggggcgaaaaacctatgaatctatcggcaggctgttgccgaaacgcccgaatattatcctttctcgctctgattttgctattgatggcgcttattctgcgacaagccttgaacaagcggtggaattagccaaaaattttgctaatagcgatgaaataatgattatcggtggcggtgagttatacaaacaagcaatgccttttgccgataaactttatcttactgaaattcaagccaatatagagggcgatactttttttgagtttgatgaaactcagtggcaacaggttgcagagaagtggtctgaagtagatgagcaaaatagttaccgttgtcggtttatgattttggataggttaaaaaatgattaataagtgattaaaaaataacctctcctgattgtttgtaaaataattgtggttttattttgaacgaatgatagggttttatgtgatttatttcacaatttaataacattttgcttttttgtttacaaattttcactagaatatgagcctcaatattgacttttatggtgttttcttttttgaggtgttttatggctctgtttctcagtatttttcctatcgttttactgatttatttaatggtaaaacgcaacgcattaccttcctatgtcgctttaccgtggattgcggtagtggtgttaattatccagctaatctatttcggcaccgatattcaaacggtcagtgcgaatattgcttctgccttgattgcggtacaaacaccgattaccgtcattttcggtgcagtgcttttcaaccgtttttcagaagtatctggtgcaaccgatgtgttgcgtaaatggttatcgaatatcaacccaaatcctgtggctcagttaatgatcatcggttgggcatttgcctttatgattgaaggggcgagtggtttcggtacacctgcggcgattgcagcaccgattttagtcggtatcggtttccatccgcttaaagtggcaatgttggcattagtgatgaactccgtaccggtttcatttggtgcggtgggtacgccgacttggtttggtatgggagcgttacaattaggtgaagagcaaattttagaaatcggttctatcactgcatttattcactctattgccgcatttatcattccagtaatggcattgcgtttaatcgtgagctggtctgaaattcgtaaaaatatcgtgtttatctacatcagtatttttgcttgtgtgatcccttatttcctaattgctcaattaaactacgagttcccgtcattagtgggcggtgcaatcggtatggtgatctctgttttagtggcaaacaaaggtatcggtttagcgaaagtggataataccgttgatagcaatgccgtaaccactgcacaagtagtgaaagctttattcccaacaggtttattaattgcgatcttaattgtaactcgtattaaacagttaccattaaaagcaatgatgaacgatgcaacttcttggttcagcgtaaaattaggttcgcttggtgtatttgatattagccacgggttaattttcagcttaaaagaaattttcggcacaacaattagctcaaactacaaattgctttatgtgccagcattaatcccgtttgtgattaccgtattaattgcaatccctgtatttgccgtatcagcgaaaaataccaaagagatcttcgcaacaagcttaaaacaaacgaaaaacccattctttgcgcttgtgggtgcgttaataatggtaaacttaatgcttgtaggcggtgatggttcaatggtgaaaatcatcggtcaaagtttcgcacaagcaacaggggaatactggactatcttcgcctcttatttaggtgctgtgggggcgttcttctcaggttcaaataccgtatcgaacttaacctttggtagcgtacagctttcaacagcaatggaaacaggattatctgtgagcctaattcttgctgcacaatctgtgggcggtgcgatgggtaatatggtgtgtatcaacaacatcgtagcagtatgttcggtattgaacatcaataataaagaaggtgaaattatcaagcgtacggttatgccaatgtttgtttacggtgtaattaccgcactttcagcactctttattgtgccgttgttctacaatgtgtaatcttaggtggggtattaccccaccttttcgtttttaaatgttgaagaacaagcggagtattgtgataaaaatttggctatatatttgagagtagggacgccaagcgtggcgtccgttctctaaatttgtgtaaagtctatatttaaggacgccaagcgtggcgtccgttctctaaatttgtgtaaagtctatatttaaggacgccaagcgtggcgtccgttctctaaatttgtgtaaagtctatatttaaggacgccaagcgtggcgtccctacaatataaaaagatttacaacataaatgccaaaaaatttgtaaaatccaaccgcttgttttagcttttttactatttttatttattggagtttttatgaacgtgaatttttacgtcacctgtattgccgatatcgtcaaagcaggtgttgccaaaaatagcgtgctattgttagaaaaactgggttgtaaaatcactttccttgaaaaacaaggatgctgtggacagcctgcaattaacagtggttatacaaaacaagcccttgagggaatgaaaaagttagtggaaacttttgaagtcaatgattatccaattgttgcccctgcaggttcttgtgtttatgcaattaaaacctatcctgaccattttgaacgctttggcgaaccagagtgggcggctcgtgcgaaaaaagtcgctgaccgttttcacgatttaacagattttatcgtcaataaactgggcgttaccaatgtcggtgcaaccttaacaggcaaagctgtttatcacccgtcttgcagtttgtcgcgtaaattaggtattgtgaatgaaccaatcaccttattacaaaacgtcaaaggcttagagttgttaccaattcaaaatcaacaaacctgttgcggtttcggcgggactttctcggtcaaaatggcggaaatttcaggcgaaatggtcaaagaaaaagtcgagcatattgctgatgttgaaccagaatacttgatcggtgcagatgtgagctgtttgatgaacatcggcggacgtttaagtcgtgaagggaaaaatattaaggtaatgcatattgccgaagtattaatgcaggagggcaaataagatgtcactgaaaaccagcaatcttgcctttaaaaaacgcgtggacgatcaaatccacaacgcaatgatgcgtaaagcggtggtaaaagcccaagaaaccatcggggcaaaccgtcaaagaatggtggacgaacttggccactgggaagagtggcgtgacgcggcaaaacagatccgtaaccacgttcttgccaatttagacgcctatctctaccaattaagtgaaaaagtgcaacaaaacggcggtaaagtcttttttgcagaaactgccgaagaagcgaccgcttatattcgtcaaattgccttagaaaaaaatgctaagaagatcgttaaatccaaatcaatggtgacagaagagatcggcttaaaccacgttcttgaaaacgaaggcattaaagtggttgaaacggacttaggcgaatatttacttcaaatcgttggcgataaaccatctcacatcgttgtacctgcaatccacaaagatcgctataaaatccgtcaagaattacacgaacaactgggctataacggctcagaaacgccagaggaaatgactgcatttgtgcgtcaagtgatccgcaaagatttcttagaggcagacatcggcattagtggttgtaactttgccgtagcagaaacaggttctgtctgtttagtcactaacgaaggtaacttgcgtttagcaacaacggtgccgaaaacccatatcgccgtaatgggtatggaacgtttagccccaaccttccaagaagttgatgtgttaatcacaatgctagcgagaagtgcggttggtgcaaaactcactgcctataacacttggctaacaggaccacgtcttgaaggcgaaacggacggaccggaagagttccacttagttatcgtggataacggacgttcaaaaatccttgaaagcgaatttaaagaagttttacgttgtatccgttgcggtgcgtgtttgaacacttgccctgcgtatcgtcaaatcggcggacacggctacggctctatctatccaggaccaatcggatcggtgatctcgccattactcggtggctatgaagaatttaaagaattgccttatgcttgttcgctttgtaccgcttgtaactccgtttgtccagtgaaaattccactggcacaactgatcttaaaacaccgtgaacatatcgctcaaaatggtatgactccagcagcagagcgtttatcgattttcggtttcaactttgctaactcgcacccaactttatggaaagtcggggtgaatatcggggcaaaagtggcaggtaaattcatcaaaaacggcaaagcaccaattcaagtaggcgcacttgcagaatggacaaaagcccgtgatttaccgtcagctgaaggcgaaagtttccgtgaatggttcaacaatagaggataagagaatggatttacaaaaccgtgaaaattttctaaataaactggcggaaagaatgggcagaccgcgtcagctcgtgcctgaaccaatgccgaaattagtcaatgattatccgacgacacgtttaacggatcgcacccaagctcaattagtcgaggaatttgttagctttgctaaagtgatgatgaccgatgtagcggtggtgaaagaagaaaatctgatcgcagaagtgaccgcactttgtgataaatatggcggtggctcggtgattattaataacgacagccgtttagttgatttaggcattacgccagcattgcaagctaaatacgacagctatgtttgggatcacaatgcagatggtagtgtgaatatcgacaaagcggaaaaagccaatatcggcgtggtttacggcgaatacggcttaacggaatctggcggtattgtactgttttcagataaagaatttggacgttcagtcagcctgttacctgaaaaatccattgtcgtcttgcgtgccagcaccgtgttaccccgtgtggcacagttagctaaaatcctacacgacaaagcccaacaaggcgaaagaatgccatcttgcgtaaacattatttcagggccaagtgctacggcagatattgagttaatcaaagttgtcggcgtacacggacctgtgaataaggtttatgtggtgattgatgatctataaataaattgttactgcgaatggaatggttcaatcaaatgtgattgagccattttttattctagataaagcgtgataaaatccgcatcatttctatcttgaattatctataaaatggctaaacaaaatctcttaacggcacaaggtgaacgagtggcgattgttgctggattacgcacaccttttgttcatcgtgatacaggatttaaatcttcctatgcaacagatttaggcacaatggtaacaaacgagctacttagtcgtactgccgttgatcatcaacatattgaacagctcgtctttgggcaagttattcaacagcctgatattcctaacccttctcgtgagattgccttggcgttaaatatgccttatgtgcaggcttatactttaagtagctcttgtttatctgggttgcaagcgttggtgaatgtcgccggcagtattattagcggctcgatttctgcaggaattgcagggggaacggactcgatttctaatgccccttttagtattagccctcgtgttattcataagctcaaggcaatttttaatgctccaaccttagatgataagtatcgcttgttccgtgagttttcgtggaaagagcttaaacctcacggggttaatctcaaagattatatgacccaaatgtccgtggcggaaatttctgagcagatggctcagcagtttcacattagccgtgaagctcaggacgaatatgcgttaaattcacatatcaaagctcagaatgcgtggaaattggggctgttaaaagatgaagtaatgccttcgtttcctcgtccttataccgattttgtggtatctgacagtttgatttcctctgccacaaaagcggcttattatgaaaaattttcgccgttaatgaataaaagttatgccactgtgaccgaagcaaatatgcctcgtacggtggacggtgcggcggcagtgttattaatgcgagagaacaaggcgaaagaactggggttagagccgttaggttatattcgtagctatgccattgcgggtaacgatatttggcaaaatatgtttatgggggcgacggtggcaagccatcttgcccttgagcgtgcgaatgtgagcttgtctgatttggattttgttgatattcacgaaacctcagccagccaaatgttggttaatatgaagctgtttgcttcagatgaatttgctaaaaaacagcttaatcgttccgcttgtattggggaaatcgatcctgagaagttgaaccatttgggcggttctattgcttttggtaatcctcgtgcggcgaccagtttacgcattttagttcaatcgttaaaagccttgaaacgcaagggaggcggattgtctttgattgcctcaagtggattaggtggattaggttctgcaatgattttggaaagcgagtaacagtatgacaacacaagcacaatatatctcaccttttcacgttgagattgatgataatcgaattgccattgttcgtattgatgtaaaagggaaatcgcaaaactggttgcctgagcagtttattgaagatttacgtgatgtgattggttctgtgatttatcaacaagcacggggcgtgatttttgtttcgggtaaggagaaaggttttattcaaggttatgatcctgatcatttgcgtggtaaaaatgatgaacagctgaaaaccttatctcataatgctcagttggtgatgcgtgaaattaatacgctcaaaatgcctgcggtggcggtgattgatggtggctgttatggcgttgggctagagttggcattggcgtgcgattatcgtattgccagcgaggaaggttataccaaatttgcaatgccacaaattcgttcggggattttgccttttgctgggggaacacagcgtttgcctcgtttggtcggcttgcaaaatgcggtcacgatgttgctatctggacagaaaattggggtggaaaaagccctgaaaattgggctggtggataaacttatccctgccagtaatttatttgaaacggcatatcagttattgcttaaccataaagtgcaaaaagtggatcataaaaatccgcttgataaggtcaaaaaatggcgtaaacagcttgagggcaataagtttatccgtgaaaaatatctggctcatattgaaaatcgtgtttgggataaagcctttggcaactatcctgcggttacagaaatgttggcattattgaaagagcctcattttaaagccgggttggcattagaacaaaatgcgttagtgaacctaatgcacacggagcaagctcaggttttaatgaatttgaaacagactgagcgagcgatgaaggagcaatatcaacacttggctcaagtgcgagatgtacaacaagtgacggtgctgggtagtggttatatgggggctgggattgcttatttgacggcaaataatgctcaaattccagttagaattaaggatattcacccgtcggaaattcaaaaagcattgcaaacttgctatggcttaatgcaaaaagcggtggataagaaacagctcagccacggtgagatgatccaacgaatgaatttaattacgggtggtgagcgtttagttgcggcgaaatcgacagattttatcgtagaggcagtttatgaaaaattagaactcaaacagcagatggtgcaagagagtgaaaattactacgaagaaaatgcgatttttgccacaaatacctcaacctttgcgatccgtgatattgcttctgtcgccaaacgccctgaaaatgtaatcggttttcactatttcagccctgtgactaaacgtccgatggtggaaattattccacacgaaaaaacttgccagcgagcggtttcaacggcaattcattttgcgatccagcaaggaaaaattccgatgcttgttgcggataaagaagggttctttattaaccgtattcttacgccgttcttacttgaagcaatcgagtgtttatccgaaggggaagggatcgaatttatcgaccgtgccttacaggaatttggctttaagatcggaccgcttgcaatgatcgatgaaattggcttggatattattgttaaatctaatccagcgatggtgagtgaattgggtaaacgttttgctttaccgacgactattgaacgtttgactggcgatgatcgtaaagggcgaaaaaataaacgaggcttctatctctacgacacaagaggaaaacgcactcaagaggataagagtgtttatcacacaatggaaaccattatgcaaaatgaaatggaagccgaagatattgcccgtcgttgtgtattgagaatgttgaatgaagcctgctggtgtttacaagatcaagttattcgttccaccgatgaaggtaacgttgcttctgtatttggggtggatttcccagatttccgaggcggtgtgtatgcctatattgacaagattggggctaaagagcttgttcgtcagttacgcaaacatacacaacaatatggcgagcgttttacgccttgtgagtggttggtagaaagggcggaaaaggcataactaaaggctttctaccattttaattgagagataataaagaggaacaacaatgaaattaactaaaatcacccttgctctggctggcattcttggcattgctgttgttgggggcagttggtacacagggcaacaagcagaacaacgctatcagcaattggttcaacaaggtaatcaaagcctgaaagcactgaagatctatggcatagatgcagaaattaaagatgttaaatttgaacgccattttttcagttctgatgtgaaatataccttagaggtaggaacggttgatgaacgttatcagctacaaggcgatgataaactctttcacggtccattaccgttaaatcgccttagccaagtgaacttaatgcctgcaatgatgagcgttgagagcaaactttatttacctgaaaaattcaagctacagaccccatttaccgaagggcaaacggatattagctacgcaggtaatttaagcggtgagtttagcctcaatgctttcaaaggtgaaacttgggatcttgcaaagacccagattgagttcgagtacgatccagcacaaaaatcggggaaattcagtagccaaattccgtcctatcaatatcaagatcaaacaaatactaggatagaaatccaagataccctttacaaagcggattttacctcaaatgagaaatatccagagcttagtttgggtaattatgagttcagttctaaaatggttcgttactcgtctgacggaaaagcaccttttgctttcacaaatctttccagtcagggtaaaaatacgttagaaaaggatcgctggacttcaacgggtagccttactggtgagttgctcgctcaagataaacttaacttaggtaagctcaacattgatagctcggcagagcttgatgcagagagtgctaatgaattaatgcattatgcctcttccttggaaaaattagaatctgtggaagctggcgatgtggtgttatcacttcttaacaaatcacctaaattacaaattaaagagcttagcttagagaatgcgaaagggaaaaatagtctgtctttaaatctaaatttagataaatttgatccaagccaattcaaaggaatggaagatgttctaaaaatctttaaagcgtctgtgttagaaactcaattcaagttgccttcattagaattattcatggcacagctaaatcaactagatggtttcccgaaagaagacgctgaacagaaggcaaaacaaacgatcagtgagtttgcctatcaagttcaagccagctcattagctactttggataaagatagcctgaaaatgaagctatccattgatcaggggaaagtcaatttgaatggcagagatgttcctgaagctgaagtgcaaggggcattgtttatgataatgcttgggttaaatcattgataagtaaataggcataagtactactcttatgcctgtaaacaggggttaattttcacgtttcacaataaattcagccaaagcaacaagagccgtagtatcaaaaggcaaggtttctagtgcttttagggctgtttggtagaggctctccgctttttgtttcgccccctctaaacccagcagttttggataagtgcttttatccaacgcttgatctgaacctgcagttttaccaatgacctcactattaccaatcacatcaagaatatcgtcttgtacttggaaagccagcccgattgctttagcatattgcacaagttgttgtttaatctgatgatcttgggcgtaagcggatagattaaatcccatcattacagaggcaaggatcaacgccccggttttattacgatgaatacgttcaagttcatcaagggcaatggctttatgctcagattgtaaatctaaactttgccccaaacacataccttttgccccagcggattttgcaagccactgtatttgtgccaccttctgctctgcggttagacttgggtcaaacgctagtaattcaaaggcaaaactttgtagtgcatcgccagccaaaatagctgttgcttcatcaaaagcaatatggcaagttggcttgcctcgacgaagggtatcattatccattgcaggtaaatcatcgtgaaccaatgaataggcgtgaatggcttccattgcccctgctgaatggtcaagttgagcaagtggcacgcctagcattttccctgtagcataaattaagaaggggcgaactcgtttgccaccaagcaaaacagcataagacatcgcttcaataagcggtgtgttgtaggctggatattgcgaaagttgctcgcttagaaaatggttgatacgttgttgatattgacttaattcagcgaaaaggtcgtaattcattatgggtaatccgtaagatctgcgtgttcatttttttgtagcaaaatttggatacgttgttccgctttttgtaagcgttcttgcccttgttgcaccaattttactgcggtttcaaactcatttaaggcttcttctaaaggaagatcgcccgtttcaagacgattgacgatttcctcaagctctttgagtgtggtttcaaaatctagggtaggtttctttgccatagtctattccttttcaaataatcccgatattttacttgagaaagatataaaagtagatgattttctgctattgtttatcgcctaaatttagaggggaacttatgcaagtcacacaaatttgtctttatccgattaaatctactcaggcgtatcgggtagagcaggcttttgttttgccacaaggtctgaattttgaccgtgaatttatgattaccgaagtagatggaacttttatcacggctcgcaaagaacagatgttatatcgtttagctacatttcccatttcaacgggaattgtcattcaatctgattgtggcgagcgatgtgtggcactgtataacgattttactcaacagcgatctagcgaagtttggggaagtcattttccatcttgggtggcgaacaacgcggtaaatcaatggttaagccaaaaatttgggcgtgaagttcagttacgttggctaggcgaacagtcacaacgaatggtaaaacattttgaacctcaaccgttaagttttgcagacagtaatccacttttattggtgtctgaacaatccttaaaacaactacaacaatggtcgccagtacctgtttcgatggaacagtttcgagcaaatgttgtcatagatggcattcaagcctttgaagaagaaaggtggaagcaggtgaaaattggcacagtggaatttgaggtggctcaaccttgcacacgctgtattttaattacccgagatccacagacccttgaattagatccgaatacagaaccttttcggaccttaaaacaacaccacaccaatgagaaaggtaagccaatttttggggtgcatttagtgccacaaacaagcggtgttattcgagttggggattacattacaatttcagagtaattttatgcaaaaaaatacccgctttattttgtttccgatttttttctttatcggattaaatttaatgattttcagcctgtcacgccttggattatctctgtggcaagcagatcgtgtttctgcggttgagggctggtttcctcttttcctacaaggcttgcggatggatattgtctccatttgttatctctttggcgtaccagcattatttacggtgttattggtgcataacaatgggttaggcacactttggaaaggtattttacgcgtttggcttacgataagcagtgtgtttattctatttatggaagtcgccacccctgcgtttattgaaacctatgatttccgcccaaatcgtctatttattgagtatctactttatccaaaagaagtatttacaatgttagccaatgggcatttgactgcggtgattagcagtttggttgcaactacagtcgcaggcattatttattggaaactgtctggctgggctgtgcaacatctgcgtttacctagctggaaactgcgtcctgcaatggcattgttgattattgctgtggcgtttgctggggcaagatcatcattgggacatcgtggcattaaccctgcaatggtggcattttcaagcgatccactggttaattcattggttctcaattcaggctactctgtattatatgccgtacaacagctgaaagatgaagaaaaatcttcagagcaatatggcaaaatgtctgaacaagagatgtttgagattgtaaaaaatagccgtaatcgccccacttctgattatatttcaacggttattccgacattaaccaagaatgtggcaagctatcaaggtaagcctaaaaatatcgttattgtgctagaagaaagtcttggcgctcagtttgtcggcacattgggcggtaagccacttactcctgaatttgatcaacttgctaaagaaggttggttgtttgaaaatatctacgcaacaggcacacgttctgtgcgtggtattgaagctgttactgcaggttttacaccaacgccagcgcgtgcaacagttaaattgaccaaaagccaaaacggtttctttaccattgcagaattattgcgtcgtcaaggttaccgcacctctttcatttatggcggtgaaaaacatttcgacaatatggcgagctatttttatggaaatggctttgaaaccatcattgatgagaaagattataaaaatccgaagtttgtttccacttgggggatgagtgacgaagatttatttgataaagcacacgaaacctttaccgaattagcaaaaggcgataaaccgttttttagcttagtctttacttcaagtaaccacgatccatttgagttcccagacggtaaaattgagttgtttgataaagagaaacagacccgcaataatgcggcaaaatatgcggattatgcgttagggcatttcttcaaattagcaaaacaatcaaattattggaaagatacggtattccttgtcattgctgaccacgactcgcgagtagcgggtgatagtcttgtgccgatcaaacatttccatatcccagccttaattttaggggaacatattgagcctcgccgtgataatcgtttggtcagccaaattgatatgccaacgacattgttatctgtcgcaggcattagtggcgattatccgatgattggctttgacttaactcaaaatgtcgatccaaatcgtgcgtttatgcagtacgaccaaacgcaagcaatgatgaaaggcaaagatgtgattattcttaagccaaatcaatctcctcaaggttatgaatatgataaagcgaatgaacgccttaacccaaaagagcagtctgaagcaatgaaaaaagaggcactggcccacgcattgttaggcagttatttatataaacatcagttatataaattgccgaaagatgttgaatagcaagtaatatttaatttttagtaaatataggtataaaaaattatgagtattcgtattttaccccaagaagaaattcaacaagctgcaagctcttttcacaatccgccgttgttgtatgccaatcctaaaaatttatatgctcgccgagctaaacgtttaagacaattggctgaacataatccttttggggattatttggaatttgtggcaaatattgtcgaggttcagcttgatttattagaaaatcagcctattgcaaatagagtgggcgaacttaccgcttatttggaagctcatcagggagtgaagcctttagatgtgaaaacctttaagcggtcagatgagtggcagaaattgctgttggcgtttattgataagtttaagccttatgcgtcggatactgtgttggcgacattggaatggttagagaaagcctcaaattctgagcttgaaatgctggcggatcatttgttgaatgagcgttatgaagaggtgggcgcagacaaggcggttttcttatgggcggccttgtcgctttattgggtgcaattaactcagcaacttcctcgcaataccaaagcggagtacggtgaagaacgccatacttgccctgtgtgtaactctgccccgattgccagtgtggttcattttggggaaacgcaaggtttacgttatttgcactgttctctatgtgaaagcgagtggaatatggtgcgtgcgaagtgtagtaattgtgagcagacaggcaagctcgattactggagcttagacagtatggacgcagaggtgaaagcggaaagttgtggtgattgtgagagttatctgaaagtgatgtatcaagataaagatccgcatgttgagccaatcgccgatgatttaggtacgattttccttgatgctgaaatggagcaaaaagggctggcacgcagtgcgattaatccttttttgtttcaagtagaataatttttatacatatttattgactacatagcaactgtgtaagaatacagttgctataagtagaatctaggaagcgtggtgggtagcgtaaatttctaagcgttttcgtttttagggaacatccccaaacgcattttcatttttcgtaataaacattgcgtcaccgtagctaaagaaacggtattgactttcaacggcgtgttgataagcgttcatacagtttttgaagcccgcaaaagcagaaaccagcataatgagggtggattctggcaagtggaagttagtgactagggcatcaacgatacggaaggtttttccagggtatagaaaaattgttgtgtctgaatagaatggggcgattaatttgccttctttttctgccgcttgtgctgcactttcgatagagcgaacagaggttgtgccaacgcagatcactcgtttgccttgtgctttggtggcaagaattttatcgaccacttcctgcgatacttcggcatattctgcgtgcattttatgttcttcaatggtttctactcgcactggttggaatgtgccagccccgacgtgtaaggtaacaaaggcggtttgtactcctttttcttgcagtttttgtagcatttgatgatcaaaatgcaagccagccgttggggctgcaactgcacctaacactttgctatataccgtttgataacgctcttgatcggcatcttcatcggggcgatcgatataaggcggtagtggcatatgtcctgcctgttgtagcagatcgaataaaggcggctgtgcttcttcaaatttcagctcaaataacgcatcgtgacgagccaccattatcgctttaaagccatttccttcgcctaatttatcttcccctagaaagatttcagcattctctttcggggcttttgatgaacggatatgagctaaacagcgatgttcgtctaatacacgttccaccaacacttctaacttaccgccactggctttgcgtccataaaggcgagctgggataacacgggtgttattaaaaatcagtaagtcaccactatggatatgttcaagtaaatcattgaattgttgatcttgatattcgcctgtattaccgttgagataaagtaaacggcttgcacttcgttcagccgttggatagcgagcgataagttcatcaggtaggtcaaaatggaaatcggttacacgcacaacagttccttaaaaaatagtagggacgccacgcttggcgtccataagtataatgagataaataaaaccgtgaatttatagtgaaatccaaccgcttgcaagcctaagattgcgattcttctacattaggcaaggcattgatcaccgctttgactaaagttgctaatggaatggcaaaaaataccccccagaagccccaaagaccgccgaaaataattacggcaacgatgatcgttaatgggtgtaaatttactgcttctgagaataaaaatggcacaacaaggttaccatctaaaagttggctaatcacaaaagcaagtagcaagtagtagaaatcaggggataagccaaattgaaagagtgcaactaacgcaacaggaattgtcactaataccgcaccaatataaggcactaataccgataaaccgaccgctactgagagtaacaatggatagcgtaaatcaaagaaaaggaaaataatataagttacaacgccaacaatgagaatttctaaaaatttcccacgaatatagttggcgatttgtaattgcatttccccccaaacacgagtagcaaggtggcggtttttaggcataaaacgtagtgcagaacgcataaacaacgttttatctttgagtaagaaaaagaccattaatggtactaaaaacgcataaatacctaatccgacaaggctaacaagagagttgaatgaaaacgacaataaagagtcgccaaaggtaagaattttagtttttgctgttgccattagggagtcgagcattgcatagtcaatcaattctggatagtgttctggcagtgcttcaagccatgcattcagtaaattaaacatgctaggaagatctttcagaaaggtcatggcttgattccaaaggcttggaagcataacgacaaataaaaagacagaaatagagataaaaccacctaaaacaaggattaggcttaacattcttggaaattttaatttagtcgttaaaaagcggataggccactctaaaagataagcaaaaacaatggcaatcaaaagtggcattaagagatcactaaaaaagtagatcgttccaaagccgataattaagatggcaagaagtgcgacaatttgtggatcagtaaatttctgtttataccaatccttgaacatttcaaacataatctatcctgtcgtgttttgcgtttatttattgttatgatgataaaaaaagggggcggttaatgtacctactatggatcactgacaaatatcaattaacaagataatgttgttttgtcgtggtagggacacactgagtgtgtccgtttttaaggtaaagataaaatatctcgtacccttaccacaatggacacgctcagcgtgtccctacatttacttctttttcgttatttacattatttttgactacaaaccgcaataaagcccagttgattttcaggatcattaaaggtctggaacatttttttgaaagtatcacggttttctggttttaacgcattacccaccactttcattgcccctaaaaccccttcgtcttgaattaacccttttggtgataacaagctcatctcaccgctaaaggtttcaacattgcggaaaccacaatgaaggaaggtctctttccaatcctgcttatttaatggtgctacggtgatattaatcgcatcacgcaatttagcgatcacatcttctctgttatcgccattgagcagtaaatcgtgggtaagtaataaaccgtttggctttaatactcgcagatattcacgaattgccttttctttggcttcttgcggtagcattgtcagcattgcttcgttgataataatgtcgaaactattatcttcaaatggcagtttggttgcattggcacgctgaacttgcactaattcttcaactttatgttctttaatgttttgttgtgctttctcgagggcttcttcatcaagatcgataccgatcacttggcaaccaaattgttgagcaatttcgattgcggtcgttcccatattacaagcaacttcaagcacttttttatctttccgaaaatcgccatttgcaatgagccagtccgttgccactttgccacctgggcgtaaacgtgttttacccaaacgagctaagaaatggtgtccaacttcttcttttttcatattcacctctttggattttgtaaaattcttcttaattcagaccgcttgcattgaaaagaagttcaatttaggcggaataacaaacattcaatagcagttatacacagtaagaacgtagggacgccacgcttggcgtccatttagatattttatgaaatcctagaaaacagacgccaagcgtggcgtccctacaatattgtttattaaaaaaactgtgcattactaccttaaggaataacgccgtagattataccgtttttttatctgtgcatatatacaattaaacagaaatttggcaaaatttcgcacatatcttctaacaacaatgaaaatatatcatctcgtgtttaacaaaaaggaaaaataatgaaaaaatcaacaaaatcagaatgctatgcccatcagcgtggcgaaattcaagagagtgcaattaaagccttggtgacggataaactgtttagaagtcgagtagagcgaaaccgcaaaggtaaaggaagttatcagcgtaacgcaaaacatcgcaaaggggaaaacccatttaaaagtgttcaacagaatgtttttaaatgggtttttcttatccagaattagggttgtttaatttggtattatgtagcagttgtataaatatcttaattttctgctacaattccgttatctttatttaggttaaataagaacaaagagacaaccatgcaaaacgaacccattcgcttaacacagtatagtcacggtgctggctgcggctgtaaaatttccccgaaagtgcttgaacaaattctgcacacagaacaggcgaagtttatcgacccgaatttgttagtcggtaatgaaaccaaagatgacgcggcggtctatgacatcggtaacggtgtcggcattgtcagcaccacggatttctttatgccgattgtagatgatccttttgatttcgggcgaattgctgcgactaatgcaatcagtgatatttttgcaatgggcggtaagccaattatggcgattgcaattttaggctttccaatcaataagctacctgccgaagttgcacaaaaaattgttgatggcggtcgttttgcgtgccaacaagcaggcattgcgttagctggtggacactcaattgactcccctgaaccgatttttggtttagcggttacaggcattatttctaccgaacaagtgaaaaagaacgcatcagcacaagccgattgcgatttatatttaacaaaaccacttgggatcggtgtacttaccacagcagaaaaacaaggtaaattaaaacctgaacatcaaaatttagcacgagatgtgatgtgtcagatgaatttgatcggtgctgaatttgccaaagttgatgagatcaccgcaatgaccgatgtcaccggtttcgggttactcggacacttaacagaaatctgccaaggttcaaacttgcgtgccgaagtttatttcgatcaaatccaaaccttagacggtgtcagagagcacatcgcacaaggtgctgtaccaggcggaactacccgtaatttcgacagctacggacatctgatttcgccgttaagtgatgaacaaaaagcgattttatgcgacccgcaaacgtcaggtggtttattaattgccgttaagccacaagcggttgaaagtgtgaaacaaattgcaaaaaatgccaatgtcgccctttaccctgtcggcagattattgaaagcggaaagtggtaaggtattgattgaagtaaaataacaataattcccccctttgaaaaaggggggctaggggggattttattaggcaaggtgaaatatccagattgttaaatccccctcaatccccctttttcaaagggggaagtaaattttggagaatccccaaatgaaacaaaacattgatgtggtaattgtcggcggtgcggtgacgggttctgtacttgccttagcgttaagttcagtaagcggacaccaattgcaaattgcaatcgtagaaaaaaatgagccaaactatgcacaacaaggcggttttgacgcacgttcaatcgcctttgcttacggcagtttgcaaaagttagctcaaattcgaccgcttgccacggaacaaaatttagctcaactggtttaccgtattgcaacccccatcaaacaaattcacgtttcagatcaaggacatttcggcaaaacaaccttaaaagccgacgaactacgtttatccgaattaggtgtggtagtggaattagccaaactgggcgagcaactgaccgcattaatcgccaagcaaccaaacattcagctattctgccctgataccgtcgcccatatcgaacgcacagaacagcactgccacattaccctaaacagcggaacacaattaacgtccaaattgttagttgcctctgacggcattcaatctcaaattgcccagcaatgtggcgtaacaatccaatttatcaaggattatcaacaatccgccattattgccaatgttatcctgtctgaaccacaccaaaaccacgcctttgaacgtttcacaaaacaggggccttttgcattattaccacttaatgaaaaaatgatgtcgctggtttggtgtatggaagatccgacagaagcaatggcaatgtcagacagcgactttttacacgccttgcaacaacaattcggctggaagctcggcaaatttttacaagtcagcaagcggtttgtttatcccctttcttcacaaaaaagcgaaagccatattcaccaccgactagccattgtcggcaatgcctcccagttactacaccctgtcgcaggacaagggttcaatcttggaatgcgagatctatttgaattggcaacccttgtcggtcaagcctttgcacaaggcgaagatttcggcgaagcaaaatggctacaacagtttgaacaacaccgccaagccgaccaaacccgaattatgcaaagcacaagcggtctgatttcgatttttggttgcgaatttttgcctattcaagtcgctcgtaaccttgccctatttggtttatctcatttttcactggctcgcaatgccgttgctcataaagcattaggctggtaattttcggtatatgtttaatcaacttcaacatcagttacacaaattcgtacaacgtggtttagataatcatctacgccttgccgtgacaggcttaagtcgcagtggtaaaaccgcattcatcaccagttttgtcgatcaactgctacacattggcacaggcgacaacgcccacttaaacctatttgcccctgctcgaaacggacaaattctttccgtaaaacgagtagaacaacacgatctcaccattccccgttttgaatacgacaaaaaccgccactgcttcgagaacgaacctgcgacttggtgtccatcgactacggggatcagcgaaattcgccttgcgatccgctaccaacgccgagatagcctgcttcgccatctcaaagaaacgagtacactctatctcgatatttttgattacccaggggaatggttattagatttaccgctactctcacaaagtttcaaagagtggtcgcaacatcaacagctggtacacaaaggcgaacgtgcagagttagcacaggcttggcttgctcaagttaagcaacttgaccttaccgccaaaacggacgaaaaccagcttgcaaaattaagtgaagattacaccgcttacctactcaaatgcaaagaagttggaatgcaatatattcaaccagggcgatttgtcctgccaaataccgaacggggtgcgcctgtctatcagttcttccccctacttgatttaacggaaaatgagtgggaacagctagaaaaaagtcctgaacatagcatttttcacaccctgaaaaaacgctatcgccactatcagcaaaaaatcgtcaaaccattttatgaagattacttctcacagtttgaccgccaagtgatcttagcggattgccttaccccactaaatcacagccatcaagcctttattgaaatgaaaacaggcttacaacagctatttaaacatttccattatggcaaccgctcgctttttagtcgcctattttcatcaaatatcgacaagttactgtttgttgccaccaaagccgatcatatcaccagcgaccaactaccgaatttagaaagcctaatgcgacagttagtgcaagaaggggggcgacacgctgaatttgaaggcattgacacaggctaccaagcgatttccgctatccgagcgaccgatccagtgatcgccacacaaaatggacaaagtttcaaagcgatccgtgggattcgctctagtgataaaaaactggttacactctaccctggtagcgttccaaaccgtttacccgacatcaactactggcaaaatcaccgttttgaatttgaccagtttgaaccgaaaaaaatcgactttgatcagccaatcccccatttaagaatggacgctgtattgcagtttttgctcgcagataggtttggttgataaattcccaacagaatagtgttagtaagcaaatgtaatataaaaaatttgggcatttgctacataataggctggatttaaggtacaatctcaccaatttttttaataaaaaatagcactatgagtaaaaaaccaaaagtagcttcaaatacgattgccttaaataaacgtgccagacacgaatattttatcgaagaagaaatcgaagctggtctagaattacaaggctgggaagtcaaatccctgcgagcaggtaaagccaatatcggtgatagttatgtgacatttcgcaacggcgaagcctttttattcggtggcactattaccccgttaaatgtcgcttctacccatattgtgtgcgacccaacccgtacccgtaagttattgttaaataagcgtgagttagacacgctttatggtaaagtcagccgtgatgggtttaccgttgtcgctctgtcgctttactggaaaaatgcgtgggcgaaagtcaaaatcggcttggcgaaagggaaaaaattgcacgataagcgtgaagatattaaagaccgtgagtggcaagttgctaaacagcggattatgaagaatgcgaaccgtgggtagtattacaagcggtaacatttctataaaattttgcaaaagtaaaaggacacaaaaatgatcgaccaaaaccttctacgtacgaaccttgaggaagtcgcacaaattttaaaactcaaacgtaacttcaaccttgatgttgctcgtgttactagccttgaagaacaacgcaaagcattgcaagttaaagcagaaaatttacaggcagaacgtaatgctcgttcaaaaaatatcggcgcagcgaaagcgcgtggcgaagatatttctgcgttattagcagaagtggacacgatgggtaacgaattagatgcagcaaaagtggaattagataaagtccaagcggaaattcgtgaactgctattaaacattcctaacttacctgccgatgaagtgccagtgggtaaagatgatagcgaaaatcttgaagtatctcgttggggtacgccacgtcaatttgactttgaaatcaaagatcacgttacccttggtgaaggcttaggcggtttggatttccctgctggtgtgaaattaactggaagtcgtttcgtcgttatgaaaagtggtattgcacgtttacaccgtgccttatctcaatttatgttagatttacacacagaacaacacggctatgtggaaacctatgtgccttatcttgtaaaccacgataccctttacggcacagggcaattaccaaaattcggcgaagatctgttccatactcaaccgttagaaggacaagatccaaatgcggtacaaaaaccttacgctttaatcccaaccgcagaagtgccagtcactaatcttgtgcgtgatgaaatcttagacgaagaaagtttaccactgaaactgaccgctcacaccccgtgcttccgttcagaagcaggctcttacggtcgtgatacccgtggcttaattcgtatgcaccagttcgataaagtagaaatggtacaaatcgtcgcccctgaaaaatcaatggaagcccttgaagaattaacaggacacgcagaaaaagtgttgcagttgctcaatctgccataccgcaaaatgttactctgctctggcgatatgggctttggttcaagcaaaacctacgatttagaagtgtggctgccagcacaaaacacctaccgtgagatttcatcttgctcaaatatgtgggatttccaagctcgccgtatgcaagcacgttgcaaagcgaaaggggataagaaaactcgcttagttcacaccttaaatggctcaggtttagctgtcggacgtacgcttgttgccgtacttgaaaactaccaaaatgcagatggttctattaccgtgcctgaagtgttgaaaccgtatatgggtggtgtagaggttattaaataatccctacaagcgatctctttttatcaatttattaccaaagtaggggcggaccgatgtgtccgcccttgtttcgtattgtttaggaggagatatcactctgctcctatgaagtaacttagagctattatttcactatagtagataattaattttcaaattaagcatttatctaattttattttttgaggtaatcaatggcagcagaaggtgcaagtcaattagttagtgtagtgacccttttaggggcggcaattattgcggtacctatttttaaacgtttgggcttaggctctgttttgggatatttagctgcagggcttgcgataggtccttttggtttaaaacttttctcagatccccaagcgatcattcacgttgccgaattaggtgtcgtgatgtttctgtttatcattgggttagagatgaaaccatctcacttatgggggctgcgtcgtcaaattttcggcttaggcagtatgcaagtggtcgtttgtgcggtcttgcttacgtttgttggtatggctttcggctattcttggcaaatttcttttgttggtggggcgggctttgttttaacatctactgcaattgtaatgcaagtgttgagcgaacgagacgatattgctagtcctcgtggtcagcgaatggtgtcaatcttgctttttgaagatctgattattgtgcctctactagccattgtcacctttcttgcaccgacagatccaaatcatattgccgatccccaacctatttggcagaaaatcggtatcgcagggttatctgtgaccgcattggtggtggtcggtatttgggtactcaacccgattttccgtattctagcaaaaaccaaaatccgtgaattaatgacggcagccgcactatttgtggttttaggctctgcgttattaatggaggaaggtggattatcaacagcaatgggtgcttttgtcgcaggggttttactctccgaatcaagtttccgtcaccaattagaggccgatattgagccatttagagggttattacttggcttattcttcttaggtgtgggaatggcattagatctaaacattgtgtttgataactgggttctaatcctttcggcagtgattgcaatgatggcagtgaaatcattgtgtattttattaatagccaaacttgctaaaagtagcaccagcgatgcaatggatagagctgttgtgatggctcaaggtggtgaatttgcctttgtactatatgcagcatcggcaacacaaggggtgatttctgcagaaattcaagcaaatctaaccgctattgtcgtattttcaatgatttttgccccaatcaccatcattttacataacaaattcgtagcacctcgttttgcaaacaaagctggggaacgtgaagccgctcatattgaagaacagcacccgattatcttagttgggattgggcgttatggacaaatcgtcaatcatatcctcacgatgtctggctatcaccctactattattgatcttaacgaagcgcaaatcgaaggggcgaaaaagtacggaattaaaagctattatggcaatgctactcgtccagaattacttcacaatgctgggattgaaacggcggaattattgatcgttgcagtagatgataagcatcaagcgatacatattgtggagctggctcgttctatgaacccgaatatcaaaattatcgcaagggcatatgaccgagttcacgtctttgaactttacaaagcaggagcagataaacaagtgcgtgagacctttgattcagccttacgcagtgggcgtgcggccttaaaaatgctaggtgttgaggaagaagttgctgatgaaatttgtgactactattttgaacgagatcgccataatgtgaaattaatggcggaagtctatgatcctaatttagaactctttaagaatgaagaaatgcgaaaaattgcactagctgaagatcaggaaacaatgctcgaaattcagaatattttggacagagcaagggagaaaaaagaagctgggttctttaattccccgcactaaataagaaaaggttctgaagatagtttttctgtgtaagacagtaaataattgctctaaagagcaagtttcatcgtaaagattaaacctaatctgccagttctataattacagctcctgccagattaggcatgcttctacggttctgatcaacaagcggttatttatttaacaccgcttgcaacgctaccccaatgtcagccaaactacgcacagtttttacgcctgcgccttcaagagctgcaaatttttcatctgcagtgccttttccgccagagataatcgcccctgcgtgtcccatacgttttccttttggtgcggtaacgccagcaatatagctcaccacaggtttagtcacgttcgctttgataaaggctgctgcttcttcttctgcggaaccaccaatttcaccgatcattataatcgcttcagtttcggggtcagcttggaatagtgttagaatatcaatgaagtttgaacctggaatagggtcgccaccgatcccaacacaagtcgattgaccaaaaccgtagtctgttgtttgtttaactgcttcataagtcaatgttcctgaacgagaaacaatcccgattttaccttttttatgaatgctgcctggcataatcccgattttgcactcatttggggtaatcacgccagggcagttagggccgatcattctcacgcctgtttggtttaaacgctgtttcacttgaagcatatctaaggttgggataccttctgtgatacaaacgacaagctgaatacctgcatcaatggcttctaaaatagcatctttacaacccggtgctggtacataaataaccgttgctgtcgcccctgtagcttccactgcttcacgcacggtattaaatactggtaaacccaagtgtgttgtgccacctttgcctggtgaaacaccgccgacaagttgtgtgccataatcaagggcttgttgtgaatggaatgtgccttgtccgcctgtaaaaccttggcagattactttggtatctttgttgattaaaatagacattatttaccccctgccgcttttactgcttctacagccgcatctgttaaggttgctgctgcaatgatatttaagccacttttcgctaaaatttcacgtccaagttctgcgttgtttccttctaggcgaacgacaacaggtacgtttactcctacttcattaacggctgcgataatcccgtcagcgattaagtcacaacggacgataccgccgaaaatattgacgagaacagctttcactgctttgtcagacaagatgattttaaatgcttccgcaactcgctctttggttgcaccaccacctacatctaagaagtttgctgggaaaccgccgtgtaatttgacgatatccattgttcccattgcaagtccagcaccgtttaccatacaaccgatgttaccatctaaggcaacatagttaagttggtgcgactcggcaagggcttcacgcgggtcatcttggctaggatcgtgtattgcggcaagttcaggctggcgatataacgcattaccatctaccaccattttggcatctaagcaaagtaaattgccttcagtggtaacgacaagtgggttgatttcgagtaaggaaagatctttttctacaaagagtttagcctgctgtgtgaagataaaactaaattgtttgatttgatcgcctgttaaaccaagtttaaacgctagttcacgcccttgatatgccattccacctacaagcggatcgatagcgactttatgtagcaattcaggggttttagccgcaacttcttcgatattcattcccccagcacttgaagccataaaaacgactttttgtgatgagcggtcaattactgcccctaaataaagttcacgggcaatccctgctgtttcctcaacatatagggtattaacaggctgaccatttgcgtctgtttggaaagtcactaagcgtttaccgagccatttgtctgcaaattcacgcacttctgcttcatttcgtaccagtttgacaccgccagctttaccacgaccgcctgcgtggacttggcacttaattgcccaagcatcgcctttgagttgtttgattgcttcaaccgcttcatctgctgttttacaagcaatgccttggctgacaggaagtttatatttggcaaagatctgtttgccttggtattcgtgtaggttcatagagttggggttcctatgtgattaaaactgttttcccccctttttcaaagggggaaatgttcattctaaatttctaacaacaaacgtgttggatcttcgagtaaatctttgatggctactaagaaaccaacagactctcgcccatcaatcaaacggtgatcatagctcaatgcaagatacatcattggacgaataaccacctgaccgtctacagccacagggcgatctttaatagcgtgcatacctaaaatagcactttgcggtggattgataatcggcgtggacattaatgaaccaaagacaccgccattagtgatagtgaagtttccacctgtcaagtcttctacagtcaatttgccatcgcgtcctttttctgccagtgctttaatggctttttcaatgtctgccattgaaagtttgtcgcaatcgcgtaacacaggggtaactaaaccacgaggggtagaaacagcgatactgacatcaaaatagttgtgatacaccacatcatcgccatcaatagaagcattcacttcgggataacgtttcaatgcttccaccactgctttgatatagaacgacataaagcctaaacgcacaccgtgttgtttttcaaatttttcaccgtattgcttacgcagatccataatcggcttcatatctacttcattgaatgtggtgagcatcgccgtagtatttttcgcctctaataaacgttctgcaatgcgtttacgcaagcgggtcataggcacacgtttttcactacgagcagagtaagccactgtgctgatcgtattttcaactttctcagccactttcgcattacgtttagccacaacagcttcaatatcttcacgagtaattctgccacctacacctgaacctttcacctcactagcttctaaaccgtgttctgcaagtaaacggcgaacacttggacctaatgcgtcagccgagctattatctggctctaaagaggcggtttgacgatctgaaggggttgcttcatttactggtttaattgtcgctaaagacacatcacctgcttgctgagtaactaaaatacctaaaacttgtttacttacaacagttgccccttcgccttgttgaatttcggtaatcacaccatcgctagtcgcaggcacttcgagaaccactttatcggtttcaatttctacaataacttcatcacgttttacgctatcgccaacttttttatgccaagtcgcaacggtcgcatctgcaacggattcgggtaaatctggaacgaggatttcgattgtcatttgttgtttccttctatttaaattctcattcccccctttgaaaaaggggggctaggggggatttttataagctaatgctgatattgagatcgttaaatcccccttaatccccctttttcaaagggggaaattacatcaattaaacgcttaatgcctcatcaaccaactgcgtctgctgtttggtatgaagtgacatatatccgaccgctggtgaagcggaagctgggcgacctgcatatttcaatgtcgcattctctggaatagaggcttcgaagttgtgtttgctacaataccaaaccccttgatttaatggctcttcttgacaccaaacataatcagtaacatgagcataaggcataagtgcttttttcacatcttcatgtggataagggtaaagttgttcaatacgaataatcgctacatcggttttctcacgctggcgacgttcttctagtaaatcgtaatagactttacctgaacaaagtaccacacgcttaacctgtgcaggatcgagattatctaattccccgatcaccgttttaaactcaccgttgatcaactcatctaaagttgaaacagcaagcgggtggcgtagcagtgattttggcgaaatcgcaatcagtggacgacgcattttacggatcgcttgacgacgtaacatatggtaaacctgtgctggtgttgatggaatacagacttgcatattttgttctgcacaaagttgtaagtaacgttccaaacgagctgatgagtgttcaggaccttgaccttcatagccgtgtggcagtagcatcactaaaccgcacatacgtccccatttttgttcaccagaactaataaactggtcgataacaatctgagcaccgttcgcaaagtcaccaaactgagcttcccaaatcgtcaatgtttttggatcggtcgttgcataaccatattcaaatgccagtaccgcttcttcggaaagtaccgagtcccacacctcaaaacgcccttggtttgcgtgcaaatgcgttaaaggcacatagcctgtgccatcattttgattatgcacaacagcgtgacggtggaagaaggtaccacgaccagcatcttcacccgatagacgaacgtgagtaccatcatcaagcagggttgcataagccatcgtctcagccataccccagtcaagcagtttattgccttgatacatctcacgacggtcgttataaattttttcaacacgagggtgtgggcgtaacgcttctggatattcgcacacacgttttgcaatttctaagaaacgagcttcagggaatttgctctcatacggcgatgtccattcataattgagatattgcaaccaatccattgatgcagtgtccatttctcgccattcaggcacaacacgatcaccattgtctaatgcatcacggtagaggttcatcatctcaatttcatcatcacctgtaatcaccccttcagcaatcaaacgatccgcataaactttacgaggtgtcgggtgtttcttaataagaccgtacatcatcggctgagtagccaaaggttcatcagcctcattatgaccgtgacgacgataagaaattaaatcaataaaaatatcacgtttaaataaacaacgatattccaccgccattctcgctgcaaatgccaccgcttcaggatcatcaccattaacgtgaataatcggggcttggatcatcttggcaatatcggtacagtattccgtagaacgggtatcgtttggattagaagtcgtaaaaccgatctggttattgatcacgatacggattgttccgcctactttgtaacctctcgcatttgacatattcaaggtttcttgaacaaccccttgacctgccactgccgagtcgccgtgaaccgtgatcgccaatactttcttatgttcagtatcgtgaatacgagtctgtcttgcacgcacagaaccaatcaccacagggctaacaatttccaagtgtgaagggttaaatgcaagagcaaggtgaacgtgtttaccgtccacatcaaaatcagacgagaaaccctgatggtatttcacatcacctgtacgattatcatcagcgtgtttaccagcaaactcatcaaaaagttcagcaggtttcttacctaacacattgactaacatattcaaacgaccacggtgggccattcccatcactacattttccataccttgacgaccagcgtgacggataatctctttcatcatcggaataaaagcatcagacccctcaagcgagaaacgttttgccccagggaatttcgcccctaaataacgctccaaaccatcagcagcggtcagttccgttaataaatttactttttcttctttagtgaacaacggcttattcagcacactctctattttcgcctgaagccaatttttctgctccatatcctgaatgtgcataaattccaaaccgatactaccgcaataggtttcctttaacgcctcagcaagttcgcctagcttcatcgtatctttgttataaacataacgcccgatagtaaaggtttcttctaaatctttatcactgaaaccgtggtaacggtaatcgagttcaggaacctgtgaggttttccaacgataataattaagcggatctaatttagcttccaaatgtccacggaagcggtaggcattaatgaactgtaaaactttaacgagttttgcactggcttcaggatcaatcactgtcaccgcctcactgcgattttcacgcgctaaacgacggaaataatcacgaacgctggaatgaggttgctctacttgggtagcttttggcagttgagcaaataccgcttgccaacttgcatcaacgctatcagtatcttctagatactgctcgtagatttcctcaacataagactgatttgccccacctaatgcagtagttgcaatccaatcgtcaaagtttttatgttgcataaagacctaaccttatttttatctatttacaaagttgttaaatttgctgtcattatatacatttcagtacaaataaaggcaaaaaagtcaaagagaaatgcttacttataaatcagtcacacaaatccccccaattatgacggattttttaaagaaaaactgtgatataagtcgaatttttacaaaaaattaacattgtaaagaagggaatttgatggtagaagatagaaagaaaggaaatgcctcttattcaataagtttgacagcatacactattaaactaaatgcaatgccatacataattaaccctgtgacaaaatctaaaatctgccaagttcgacgtttttcaaagtaaggggaaagcaagccggctccataacctaccccaaaaaaccacaaaaatgaacaaattaatgctccgatcaagaaatgtattttttctgcgaaacttaaagtgccaccgataccgccgacaatcaccacagtgtcaatataaacgtgtggattaagtaatgtaatcgcaagggtaatggcgatcactttctttaaagacgacttagcttgcccttgttgtgccaatagctgacttgagccttgataagcagcgataaaagagcgactaccataagtgaataaaaaaatcgcaccaaacagagcaagcaataaactagcggtaggtgactgcgaaataagcgagccaagccccaatacaccaatactcatcaatgcaacatcacaaagaaagcagagcagtgccacccaaaaaacgtgctgttttaaaatcccctgcttcaataaaaatgcattttgtgcaccaatagacacaatcagcccaaaacagaccacaaaaccgtgtaaaaaactttccatcacttaatttctccctcatacaagcggacgattatacccaaatatttcatatatttgtcgaggttattcgttaaattttgtgtggggctatgtcagacactaatttattggaggaaggtataaatgagcgcagatagaaattctccatttttattcaatagtagaatggagaatttccaaatgtctagagagtgtatcttagtctattagttataaaatcattttataactaacaacttactcgcattactcatcatatccgctactttcggctgagaagataattgcgtttcgttcattggttcaattttccaaatgtctttcgcataatctaacacagagcggtctgatgagaagtagcccatattcgcaatgttgatgatcgcagaacgtgtccacgctttcttattgcggaagtaggttgccactttctcttgagcatctacatagctacggaaatccgcacaggcttgatagaagtcacctgatgagagaattaactcttgataacgatatggatcttctggtgagaatttaccatttaagatttgtgaaattgcttcgtttaattctgcatctttttcgtagtagtgatatggtgagtagccgttgcgacgtaactcttccacttgttctacggtgttaccgaagataaagatgttgtcgttacctacacgatctaaaatttccacgtttgcaccgtcaagggtaccgattgtcaatgcaccgtttagggcaaatttcatatttgatgtacctgatgcttctgtaccagcaagggaaatttgctcagacacatctgctgctggaataattaattgtgcaaggcttacgctgtagttcggaataaagacaactttgattaaatcacgaatatggctgtcgttgttgatcacatttgcaacatcgttgattaaacgaatcacttttttcgctgcatagtaagcacttgctgctttacctgcaaagataaagacgcgtggctgccaatctgctgttgggtttcttaaaatacggttatagtgagcaatgatgtgtaacacatttaattgctgacgtttgtatttgtgaatacgtttaatttgaacgtcaaaaatcgcttcagggttgagtttaattccttgagtttgttctacataagcggcgagtttacgtttattttctactttaaccgcagccacttctacttgaacatcagtatcatcaacaaaggcattgaacttgtctaactgagttaaattggtacgccattctttgccaatacgtttatctaaaattgcagcaagtccaggattagcgatatgaatccagcgacgtggggttacaccatttgttacgttggtgaagcgatctgggtagatcttcgcaaaatcggcaaaaatagactccaccattaagtctgagtgaattttggctacgccattgactttgcctgatgcaatcacggctaaccacgccatacgaatacgacggtcgccttgttcgtcaataatagatacacgacggattaattcttcatcatttgggaattgctgacgaacctcttgtaagaaccaatcgttgatttcaaaaataatttgtaaatgacgtggtaagatacgagccaccatctccacaggccaagtttctaacgcttcgctcattaaagtgtggttggtgtagaagaatactttgcgagtcgtattccatgcctgttcccaactataacctttttcgtcaattaaaatgcgcattaactcaggaatcgcaagggtagggtgggtgtcgttaaggtggattgccactttttccgcaagatttaagcaagatcccgattccacttcatgacgacgaacgatgtcttgtactgatgcagagcaaaggaaatattcttggcgtaaacgtaattcacgaccgttgtaagttgaatcgtctgggtaaagtacacgagaaacgttttctgagctattttgttggctcattgctgcaaaatagtcaccacggttaaagtctgctaaaccaaatagtttttcccctgcgtgtgcagaccatagacgtaagctgttggttgcagtggttttaaatcctgggacaagctggtcgtgggcttgagcaatgatttcttcatcaggttgccatacggtttttttgccttcttgccaagttctgccaccaaaacgtacagggaattttttacttgaacgtaagtaaggccacgcaaattcattttctaaccaataatctggattttcaacttgttcgccattttttatctcttggcggaacataccgtattcataacgaataccgtagccaatcgcagggatcttcattgctgcaagactgtccatataacatgcagccaagcgacctaagccgccgttacctaagcctggatcgccttcttcattaataatgtcttcaagattttgacctagctcgtcaaacgcagctcgaattagatcataaacaccttctgcaatcatagcattactgaaggttcttcccattaaaaattccatagaaagataataaacacgacggcttgtatttgccgcttggctacgacgagtttgtaaccaagattccgtagaaagatcacgcacaacacgcaatgccgcatttaaccagttacgtttgcttgcttcacgcggttctacaccaagagcaaaaacaagtttatgcaaaatggcatttttgacattttgaatgttctcagggctaagatgtgtgtttgactgagcgatagtcattcattactcctattaaataaaacgatagaaagaataaaaaaacgacgcattttacaatacttttgtgaagtttcttaccaaattacgaaaaattgcgcttacttactgaactatactgttgaaaaagtagaaacagcgaagtaatgtttgatttttcttaaattttcattagaatacgcactcggttttttaaccgtcaaatttagggaaatagctgggtcgcctgctatttttgtatcaatggaaccttaggttccctttttatttatgagaatttaattatgtcattcaaatttgaagctgaagttcgttcggcgcaaggtaagggtgcgagccgccgcctgcgtcacaatggtcaagttcctgcaatcatctacggtggtaaagcagaagctgtatcaatcattttagaccacgataaagtaaacaacgcacaagtacacgatgcgttctacaacgaagtgttaactatcgttgttgcgggtaaagaagagcaagtaaaagtacaagcgattcaacgtcatccaactaaaccaaaacttgttcacttagactttaaacgtatttaaccccatgtagttaaacactatttctcagactttgtatctgttagtttttttaatttaaagtcagattactacgagatagtttaggaataaatttcaagtagttccaagccccttttatcagcggataaaggggcttttaactataataaataggggctagataactaacttaaaccgcctttaactaattatgtttaaatggaaatttgagctttaagttactgtgattaaaacgctatttgcattccttcaaatacaattccaaatgtactttggaaatactgttaaacttgagtaaatgacgtttatcttggctctaaaaatgctcaattctgtttatatgttttttttctatggagtggtataactcagtgccacagtcaatgaatgctttgccgttgaagattctgtattaggtatgatttcaggcaaagcagcgaatatgaaaactgtcgttattcctgctaaggcagagtgggatgatccacgttggtcgttggcagattataagttagagcagatttctgacttgctaggattaataaaatcatcataaatttgatatagattgtattttcatttgaaaaaccgcagaaaagcggtttttcctatttattctgattgtttaatgataagattgttcgaatttcaatctttgttatgtgtttgtgtggtgagtgaaggagatgttatgaagaaagttcgtagatattcagaagcaacattagtgtcactacttgtgactgcttgtggtggtggagataattcctcaaatatgacacctattaatagcggttcagaaaaaatagatgaaacatcgatttcttcacctatattggtggaatcagagaatacaaaatctgattctattatttcagaattaaaagatccttctgtaccagaagctccgaagcaagatgaaacggtatccgaagtacccgttacaccaaatgatgaaaaagtcgaagaaaccgtaactccatcaactgagcctactgtaccagaagcgccgaagtcagatgaaacagcatcggatacacctgttatatcaagtgaagaaaaggacgaagagccagctgatacaacgactaaaactacggaatctccaaatgttgatgtttcaatgacatcaatagtcagtgatcatattttaccgccaaattatcaacctaaagatccttctagattatttgatgaagcagataaatttgctagccgtaatggattaatcgaaaagttacgtcctcaacaacaagcgacaataagtgatgaatatagtgttcaaaagattggcgttattgatacggatttcgtcaaagatgataaaacttttggaaatcgtttacttctaaatcaaggtttatggaggcaagctaaggggcaaaaacatgatcacgggtcgcaagttgctgcggtcattgctaagtataactcgacatcttggatttatggctatactgcagaatcatcaggaatgacgagcccgagtaatttgcattttgaagcggctcaagaacagggaataaaaatctttaataactcttatggtacagcacctagcaatgagttggtgaaatataggggatggacgtatttaacgagtcacttattacataagcaaatagcagaaatggctgaaaatggcagcatctttgtttgggcagtaggtaatgaggggcagttaaaaggatatggcgctcaagcggttacggaagctcatattcctgtggcatataagcaggcgaaaaaaggctggattgccgttgcttcaattacaggacaatggaaaagtccctattcgagcagagtaggagaagatgcaaaaaattggggaattgcaacttatggtgatcatcaggtatttggtgataggcatgtacaaggcacttcttttgctgcaccagttgtctctgcagcggttgctaaggtttgggaaaaattcccttggatggataaccatttggttactcaaaccattctttctacggctgatcagttaggtacttcaaatgtgactatcgggcctaataaagatatcggttggggtgtgcttaaccttgagcgagcattaaaaggtcctgcacgttttgataaacggctattagtcgaaggtgaggagtttgtcgttgcgaagttcgatcatcgaaattatgccgatcaagatcgcctaacttggagtaacaatattgcaggagatgctggctttaagaagcaaggcactggctcgctttatttgacaggatataatacttatacaggcgatactgttattgatggcggtgttttagggttgtctggcaagttagacaattccaacgtgacaattaatacaagcggtacgttacttgcaaaaaataacgaaaaaccagtagaaataggtcaatccgttactaacaatggctcacttgatgtctatggcaaagggctaagtattggtggtaattatacggcggataaagatgctcgtactgtcattgatattcatacagcattgcttgaaattaaaggcactgccgatatgcaaaattctcgaattttagcggatgtggagaaaatcaatgatgtaccaacgcaaagtgagagtctaagaaccattttaaaagcaggtaatttagtcaattacaataatttttatacagtatctgatcacattgcaccttatattttagtcagtaagatagaaaaacaaggtaacgagatccaagcaacatataaacgtaatcaaactgcaaatgtattgcgaagtgttggtacagtttctcgtagtgcagaaaatacaagtacaaacttagataaagtgcttgatgaagtggctgcaaatccaacgagttcgattaaagcagatagtgtatctattattaatgcgaagcctatgtcagttgcaagtaccgtagagtctttatcggctgaaatttacgcatcatcacaaaatatgatcgtcaatgaaaatcgacttttcagtcaaaacattgcagagagagcattccgctcgtttcaagatgagaaaagtgatgtatatgcagtaacaaaccgccaatcttatcgaatttcgcaaaatggttatgcgaatgctgaaattggaggcaatcaaagttatgttggtgcagataaacaaacagatcatctgttattaggtatatctgcctatcatagcagacaaaaagccgatttcgagcgctctgcgggatctgcaaaattgcatcagcaaggtggtgcgatttatgcgggttaccaattagacaataactatttgctagcacagcttggaatggcaaatgcgaaaaacaagattaagcgttcaattttaatgccaaatgaaacacgccgtgtcgaaacagaggttaaatcaaagctttatcatttctatacggaattaggacatcgtattaaatttgaacaaggtgaaataagtccgtttatcggataccaatttgattctgtttatcaaaaagcctttgacgaaggaaaaaactttggtattcaagcgaatcgtactcaatataacttaaatagttatttgctagggttacgtgccaccatgaaatggggagatttgagcttaaatacgaccttatctcaccgtatgacccaaaaagcagaaaatgcgtttggctttaatgctcgctatatcggtgcggaaagtgaaattgaattacaaggtatttcacctgcaaaatatgtcactatggcgaagttgggactgaattatcaaattagcgaagctcttcatcttttcggggaatatgcgattgctcgtcaaaaaggtggggaaaaatggcaaaacgtgagtgtaggaatgaagtatcagttttagtcactttttgcaaaaaatcaggctaaagtgaccgcttgtatatcatttgcttgtgaaataagcctttttggactattatcacaggcgattacattgctgttaaaagcaatgagacagacaatttaggggcgtatcttacgccccattatttatttaagagaaaaaacaatggcaagagagttttcaagagcagatcgtgtagcacaagagctacaaaaagagattgcaattattttacaacgtgaggtgaaagatccgcgtattggtatggtgacggtgtctgatgtggaaatcagtcgtgatttagcctatgccaaagtgtttgtgactttcttgtttgatagtgatgaaagtgcggtagaacgtggcttagaaggcttaaataaagcatctggctatattcgtaccttagtgggtaaagcgatgcgtttacgcatcgtgcctgaacttcgtttcgtttacgatcaatccttagtggaagggatgcgtatgtcaaaccttgtgacaaatgtgatccgtaaagatcaagaacgctacgttgaagaagagtaacaatgggcagaccaaagaaaaaaggacgtgatgttcacggtgttttcttattggataagtcgcaaggcgtgagttctaacgacattatgcagaaggtaaaacgcctgtttaatgcgaataaagctgggcatacgggggcgttagatccgcttgctacgggtatgttgccgatctgtttaggtgaggcgactaagttttctcagtttttgttagaggcggataagcgttatcgggtgatcgcaaaattgggggagcggacggatacttctgatgctgatgggcaagtggtgcaaaggcgtgaagttaaggtagacacttcggatattttggtagctcttgaggcatttcgtggtgaaattttgcaagtgccaacgatgttttctgccttaaagcataatggtaaacccctttatgaatatgcgagagcaggcattactgtggagcgtgaggctcgcccgattacgatttttgagctgttatttgttgagtatcaagctccttatttgacgttggaagtacattgttctaagggaacttatattcggacgttggttgatgatttgggggaggcgttgggttgtggcgctcacgttacaatgttgcgtcgtttggcagttgctgattatcctgttgagaagatgatgagcttagaagccttgcaaaatttagcggaaaatcagccgcttgttgagttagatcagttgttgttgccgatggatagtgcggtggctcgtttgcctcatttggatttagctgatgaacagacaaaagcagtgggttttgggcaacgtgtgaaatttgataatccgcagggaatttatggacaagtacggttgttttcagcagaaaagctgtttttaggcgttgctgaaattactgcggataatgtgattagaccaagtagaatggtcaatagataaagtaagatgataaagagatcctatttaaccatatcaatggcgtgcttggtgttggcagggtgtgctaattctgagcaagagtatcctaaggtggcgttggaggctaagtatcctaatgcccgttctttagctcattttgatgattatgtgagttttttaaagaaaaaagcggcgaatgagggggtttccgctgaggtgctaaatacggcgttgaatattcaatatgtgcctcgtgccgttgagttagatcagcaacaagctagtcgtcgacgtgatcctaatttacctccgccaccgccaaatccaaatggggtgacgaattatttgaataagaccttaacccaagcaaaagtggacgtggcggcacaacgttggtggcaatatcagcctcaattaaccaaagcaagccagaaatatggggtgcaaaaagagtatttgatggcgttatggggtatggaaagtagcttcgggcgttatcagggcaattttgatgtgttgtctgtgttggcgacactggcatttgatggtcgccgagagaagttgtttactcaagaatttgtcaatgcaatgaagatgttgcaacagggaaccttagtgcgtgccgagatgaaaggctcgtgggctggggcaatggggcagacgcagtttatgccaacctcttatttgaactatgcggcagatggcgataacgatgggcgtaaggatatttggaaaaatcagtatgatgcctttgcttctattgcgaattatctggcaactgttggctgggataaggacttgccgtggggggtagaggttaagttggctcaacctatcgatctctctttttctgggattgagttgaataaagcaaaaagccttgctgagtggcaggcgtggggtgtttatttagcctatccaacggctcaagaaacaacaaaactgaatgcgttgagttcagagaagttgtggttggttcgtcctgataaagaggtagggcgagcgttcttggtgtcgaataatttccgtacgattttagattggaataagtcgaataattttgcggtgagtatcgggaaatttgcagatcgtattttgcagagcgtagagtagggaagaacgatggcgacctatatcgtgggagatttgcacggctgttttgatgaatttcagttgttgcttgagcaagctaattttgatccgcagtatgatgaactttggctaacgggtgatttggttgctcgtggcgagaactctttggcttgtttgcgttatgtgaaggctttgggggagagggcaactgtggtgttgggtaatcacgatgtgcatttactttcgacactgcagggaattaaagcggtgaagcctaaagataaggttgatgcgatttttgaggcggaagatcgtttggaattgcaaaattggttacgctctcgaccgcttgtggcacaacaccctgttcatcaatttttgttagtccacgcaggagtaagcccagaatgggatttagcgaccactttagcttgtgcaagggaagtggaagcggtgttacaaggtgagcaatttgcagattttcttgctcagatgtatggcaattcaccagaccagtggcgtgcggatttgcaaggcattgagcgttggcgttatgcattaaatgtgtttacgcgtatgcgtttttgttatgcggataagcggttggattttgattgtaaattaccagtcgaagaagccccagagggcttaaaaccttggtttgaactagataatccgttttatcgccagcaaccgattatttttgggcattgggcgagtttaattggttatcaaactccagatacgatttatgcgttggatacaggctgtgtttggggtaatcatttgacgatgttacgttgggaagataaacatatttttacacaaaaacgcttaaatttggattaaaaacaagcggttggtttccctcgctattgcgttgtttttgctttttctttagaatagacctcgtttttatgcgactatagctcagttggttagagtaccaccttgacatggtgggggtcactggttcgagtccagctagtcgcaccatatttctaaatcatttcgtatcaatccatatcaaatgatatataaaagccttgtaaaacaaggctttttacatttctgctgtatcaatccatatcaaactatatcatcctgtatcacaattttggtattatatctggtattatgttttagtattttttcattatgtaataccaaaattaagaaaaatgacgcatttttcttaataccaaaatgattttggtaataccaaatgagatatatatggcagttacagttaagcctttaagcgttactgaatgtaataatgcaaagcctaaagagaaagaatattcactttctgacggtttaggtttgttcctacttgttagagctacaggggttaaaatttggcgtttccaatattataaaccttttaccaagaaacgaacattaattagtttaggggcttttccgtcagtttcactcaaagaagctcgtgaaattcgtgatctttatcgctctttattggcaaaaaatgtcgatccgttagattatcgcctacagcaagaaaaagcggctttagaaagccaagttctcactctatcctcgatggctactgagtggttggtattgaaaaaaaatgaggtagatacgggcaggttaaaggttgtgacctacaacgatattgaaaagcgactaaatcggcatttgttgaaactgcttggtcactatcctattgcggacatctcagcaccaattgcgattgaaaaactaaaaccattagaacgagaaaggaagctagatactttgcatcgtatgatcgggtatttaaaccagattatgatttatgcagtaaatcgaggggctattaaatataacccaacagcagacattggaaaggtttttttgaaacccgtcgtagaaaataatcctactattcgtcctgaattattaggcaaactgtttgaagatttacaaaatagtacgctagaaattgaaactcgttgtgcattagaattgttgatcttaacagcagggagagcaggagctattacacaacttgaatggtctgaagtgaattttgaggaaaagattttggatattccaaaagagaaaatgaaggggcgacaagggaaagttcaggattttgtgcttccgctatctactcaagcgattaaaattttacagcttttacaaaaattaaatcgttatcacagtcgttttgttttccctagtcgtaaaaatccgcaccagccaattagtaaagaaacgcctaataaggcactgcaaagaatgggttatcgcaatgtattgactgctcacggactaagatcggtatttagcacagcaatgaatgaggctgagtttaattccgaaattattgaggtgtgcttggctcattttgaatactccagtgtacgaggtacatacaataaagcaaaatacttaactcaacgagctgaatatatgcaatggtgggggaattttgttgagcaagcagctgaggggaaagggttatgcagttgaggtgcattcactctgaattgtatcaatatagtggtttatttgttcattagaccaaaaatttttacctccgatcagaagtggctttgggaaatgtttgtcatttttcattcttctgttaattgttggtacactgacgtaaagcagtgtagcgacagattttttgtcaaataacatttttgttgtattttccatcttttcctccaataaaaaacctagctttcgctaggcttgttcgttgatccataaaataaaaccgcccataaagagcggttggttgtggttaaaatcttgctaatcgttgttgattaagctgtggtaatgcttgctcaataaaaggatcaagccatacgttaaattcgtgtgtgatgtcgtaggcttttcctgcaatatcgtttttaacatagccagaaatgcccaaatcttcgtacagtttacgatgaaatacttccacatcttttgcaaaagctctggctcttactaggtatttggcaatttgttctgctttttcgtgtggaagaacgacatcaggcttaggttcaagcggtgcgatttgttgttcattttccgaaatttcacgatcaagaatatctagcacccatttacgaaaatctttggcgactttggtgcgggcgaacattgcgataaggtgagctccacgcaaagagaagacgcgaacttgttgttttccgcctgcggtttgcagttcgataagtgcggtcatttctgcagtaaattcgtctgcgttgcggtcgtagatcaacttgattgatttatcaggttgagcatattctaatgctgtacctaaatcagttgccgttaagaatgtgtggttgtttttgttgataaccgaaagagtagtgttttgaaatgttaatgtagtcattttgactgtcctttaagctgagtttaaaaactcatcacaagcaacgccaattactggtgatgaactgatcaaggttggcgtaccgttgcttaaagggaaacggcggatctttcgatcccctcaatcagcccatcattgactacttttaaagggggtatcaaattgatgtaccctttgaaaggtttgattttctgattttcggctataaaaaaaagccaccatttaggcgactatcattattccgcctttaagcaattcaggacgccaatcccgactttctgttgaaagtgggggtatcttaaactgaattgggggcggttgtcaatgcggttttttaacgagaaccgcaaaactcgccttgttgcctaccacagcctcaaggattataattgtaaacctaccacagcttacaattaggaatttcatatggaagcggttgcgactttactcaatacgcttgtttctcgtattttatttggtcatttcactatgttccttgtgttcttatttgttggcttcgcttttatccctgctgaatgggcgttataccttaataataaaacgcctgcctttttccctgattggttttcctttgcaaatttcggttcatttgtttttgcttgtgtggcgacaatgatttggattttggtcacgaaacctattgtcagaaaagtagaagaaatcaatcgtttttataaaaacaaggcgattttagagtcgctttctgatgatgaaatagcgattgtgtacgctatcacaaataaccatttccgtcccactgcacttgattcaaacgctgatgtgattacgttgcttgccaaaggggttattgttcggaaaggtttctattggggagatacattatatcaactcactccgtctttcagagcttgttttttaaaagagtttgctaagtctactgattgcaaaagaggataaaaactacctcctttcaaaatatcaatatcacttgtttaactcgtgatgataaagtttctgagtactaaccactttgccaattaaggctatcacaaaactatgttgcgtttccttatcttggtttttaaaataggtgtataaggttgtttctgggctttctcgttcaagaaactggtcaattaagtaaatatggtcttggaggttcattttgattacctttagtcacgattgcccacattgtgggactaagaaaagtgggtttgaagtgaaacgccactatgaaaataaaaaatattccaattattctatcttttcgttgatggctacttgtaacacttgtgccagtgctattgttggggcttttgatgtttatgacgagagttacggtcaagacatcaagaaagcaaggtctcttttagaggttcctaaccaatataatttaactgagattcttggcactaaagacattgaattttatcctaatgaaagaaaaacagctgaaattccagggcatttacctgaaagtgtcaaagaagaattgcttacagcagaagatttattcttagaggtttctgcaaaaccgcattttattaaacctgccggtaatgcgtatcgctcaactttagaacgtgctttatgtgaacttgctgaaaacgataatcgagcaaaacttaataagcgaattgagaaactttttgatgacggaaaactcacaaaagatttaaagaatttcgctttgcatattcgtacgttaagtgcggaagcttcacacgcttataatgattttacgttagaagaattgagagagttaagattatttattcagctgtttttgcaatacaccttcacgttacctgcaatgattcctgatgaatcaaaggctgacacttctactacagagagttaataatctctgagtttgaggtaaaaaacacccacctgttacagtgggcgaacggatcatcattatgattacgggtgttttaagtgattaccgtgtacacttttgtttgttgccattcagaaccgctctcagcaagagtgaaaaattcacattaaaaaagcctcttggttagcctgaaagcggttttgaatggtgcgttgatttgctacgctggctcaacgctaagcctcgatagccatctcgtgggtatgcacgaaatggtcaaatttattacttgcgtttgtgctacctgattcactgccagtgcttaacctttccacaagtaatcacaccgcttgagctatggctttcacatagcttgttgataccatctcacctttggcaagcggtgcgtttttgtctaaattgtgtcgagatgaaataatggaattagccgcctttttggagtaatctacgcattaaccttgctatttttgaaagcgggttttcagggatatatactgaaagatgtatctcgccatcaacggtcgcttgggacattgctttgactttttcttgcgcctcttcaaatgagttggcataaacttctgttgcccacttctttccgccgaagctataagaaacagcatagcatttcattttttcgtgcataaggagttacctctatgtattttcaaattttccaaggtgttaatggtcggtggtattggcgattaaaatccgccaatcacgaaaccattgcttctagcgaaggatatacaactaaacaaaactgcttgcactgcataggtttagtgatggataccacgcgaaaaacacctgtttatgaagtttagtgttcaagccctgttttctacagggcttttatttcatctcgatttttaaagagcattgagccgtagctcgttttgatgggtgtatattatctaaaagataaaaagataacaatagataaataataaaaatttaatggtttattatctattttttattatctatttgattacaaaggaaaataaattttaagaaagatgtttgattgctcaacaaataaacaagcgtgggttgcaagcggtcgtttttggtgaggattttacggattttagatactgaaactatgtactcttatgatttagagacagataaatcattagcgaatataattagttttagtgttaattgagtagtttttctgctgtcctatgcaaataatagtgctaaactatgcaaaaaattttaatatccaacatttatttgcaatgaatgaaatccagataagagagctattgatcaaagaattagctaagcaacatccacataatacggagttcttggctgagttgcctattgctaatttttctcgccgagtagatctagtgatggcaaacggtagcttgtctggttttgagataaaaagcgaacaagactctttactgcggttggttggacagctagaaacttatacacgatactttgaaaatgtgacggtagtttgtgctacaaaacatttacgtaatgtaaaggagatggtttcatctgatgtgggaatttgggagtttaacggtgagatgttaattgaacatcaagccccaacttataggccattacctaaatcaagttggctaagttttttaaatgtggttggattgaaagccttgttaaaagcctatcaattaaaggtaacaggcctgaaagatgagttagtggcaagagccttatctctagaagaagaacagattagaggttttctattaacttatttgaaatgccaatttcctcaaattcaagaaaataggtatgcagcaaaattaaagagacagataacgtctattgaaaatctggatatgaatttaagttcaatggatactaccttggaagaggaagggtttattacccttccctctggattaaaagttcgtcctatgcttcgtcaataaatcctaaagctcttgcctcttgtagttcatcgtatgggtctgtatttggctctgcattccagtaatcaatttgttttgataggtgaatgttcatacgagctgaaatccaaggggctggagcttttgcatattcttctcctatagctgccgagaagattttttgctctccccagttatgaggggaatttaaatgaggatattcctcaacgagattttttgcaatttgagggtacccatcgcctcttgctccagctattctacttacaatccattcattattcattggtaaatcaattcgagcagaccaagcataattccggtcatcatcatagatgacagaatgaatagaactatgatcaccatatatagccacactttctccaccaatgctattgaaaagttgatgctctaatatatcaatactgccattgcccgtattatcagtaaattgtgctggagacattgggaagctagttgagagtacacaaattgttagtgatggctcttgtgaacgtagttgattgatggtgttaatacacattttctgatgatgtgcaacattatcacgaatatattggcaatcaataaatacaatcacattgctaatatcctgcaaggcggaaattgcgttaataaccaacggcgtatccagtaaataatctctaattctgaaagcgagtttttgtttatttttttcaaaatagatagcttgctgagtcaccgttctttgcctagtagatagttgtacaacagggatagcgtattgatatttcttgacaaaactaatccattcttgaaaatgagatgcttcattttttagcataaaactgtctggagagttcacttccattttattccatactgaaaagtcggattttggcggtaaatctataataaaagggcgttcgctaaatgcagtgtcaatgtttagcatagcacgctcaaatccatattgtagccagttatgtaaggtaatcaacggaataattttatcttttctctcatctgttaattcccttaatgcggctatttcagcaacacgagagcgtagcgttgggtaataattgaaatgattgaaatttattgtattcataattactcctgtttagtttgacgaggggtcgcttgtggtaagacattttgctgttcttggttttgtattaaaatggtgatggtatattgctgattctcaatcgtcctttttgagacgcttaattcagtatttaaacttgaaattacctgttgttgctctttattctcttgcttaagctcttcgagctctttttctcttttacaatgcaaattgtaggagataaatgtatcaataatatgtccgacccatagtaataacgcagcaatccagcctgctaaaagcaagttgttctcattgttttgaaaaatgctataagctgacaagacaacgccgatcaatccgataaaatcaaagcctttatatttcatttcgtttacccaataaaattcaactgttggctttggtggacttttactctagcgtggataaataactggtcttgattttcttcagtgatactccacttttcatagagtttgttatctgaaatcaccaataattgatcgcctgtattttgcaatcttttcacatacaaatgtcctttgtatgtaaatacataaacaccatcaccagcaaactcatttacgctaatatcaacaaaaagcatatcacctgatgaaaatgttgggtgcatagaatcaccacttaaattaatgattctgatgtattgaggtgccatattacgaaagagtgaataaaattgctcaggcacataacgcatctgattgacaacttcaactaattcagtgcttgatccgaagcctgcactagcactcacatctaatacatcaatgatgacaaaattatttatatcttgttcctgtaattctttttcttcattgcctctcattgcattaatgacgacggattgatcgagatgtatttgatccaaccatcctctaggtttattcataccatcttctagcttggcggcaattttgtcgccgatacctttgggttttccgttttgaatggcgtttttattcttaatttgtaaaagataactaactgcaatacctgttctatttgctaattcagacgtatttttagcctcatcaattagacgtagtaaattatcgtgtctgatttcttttaaaggtctcatattacctcctgactaaataactacctctattttattatcatttcgataataattaaatatgatctaattaattgcttttgttttacctttaagataatataaatattatctatcaaagaaaaaaggtactatggatgcaattacaagaatacttagatatttcaaaacgaggtgaaatggctcgtttatcaaaagcgataggggttgctcagcccattgtgtcattttgggtgagtggtcgtcgtcaagttccagcagagcgttgtccagaaattgaaaaatttacggaagggaaggtgacgtgtgaagagctacgccctgatgtgaattgggctgtattacgaaattcaggcaaataaaaacccacgctggaacgtgggttagttacggaggttttcacttatgaatgaacatcataccgagttgcattctagcgaaaaatcgtccttttggcaagagatggagtatcgaaagcgatgttatgccgaactagagcgtcgtaattttgcaggtaacgtggactatgacgagatttttaaccagattgataaggatttaagcgatgaatgcagtagtaaaagttaaagaaacaccgatttttaagttaggcgaaaacagacaatcacaagaggctaggaaagtgagtgttgatgatggatttacggcaattccaaatgagcttctaaaggcaattttacgctcaaaagtattgggctggaaaggctcttacttgttggcaaccattcttaaaacgctttcttggcataaagaaagtgattggtttactcactctcaagtctgcgaaatgatgggcattgaaccaacaaaatatcatgtcaatcaactttcagcagcacgtaaagagcttatcaaagagcaagtcttatttgaagatggtaaaaaaacgggtgtaaatctagatgtttttaactgggaaatggtgaatcccgaaaaagtagggagttcccgaaataatagggaattagttcccgaaattgtagggaataagtatcccgaaaaagtagggaacacaaaagaaactattacaaaagaaaaaataaataatacccccttaccccctaaaggggaatcggctatcgccgatgaacaaccgcaagcggtgaaatgtgaacaacattctgcaaaaccagaaaagattaaatcaccgcctatggactatcaggcggtagctgatttgtataaccaagctaatcagaattcgggttcaagattgccgatggtggaaaaaatcaatgatgctcgtcggaaagggattaaaaaattaatggctgagcttagagagccaagtttggaatgtgctgagctgtatttcaatgcgttgtttgcaagcctgcgtccgtttcatactggtgaaaatggcggttgggtggctaattttgattgggcaattcgccctgcgacggtgctgaaagttcgtgaaggagcgttgtgatgtctgaaaatctgcgaaaaatcacttacgaggtcgaggtaagtaccgttggttctctgttgaatggtggattgacggctcaggcgagagaggtgttgagttggttaaaacctgagatgtttttgacgttcaagctaggtgaaatctattcaaacattcaacgccaagcgagcaaggataatctgattgatatgttgttactgagttctgagtacggtgttcagcttgccgatatggcggaaaccataaaatcagtggtgtctgcatcaaacttaacgggatatgctacgaaggtttttaatttctatcagcgtagagaagtgttgaaagtgcttgtgagccttgctggtgagttgaatttagctcgtgatgaacagttagatgcgattgcaacaaagggcgttgagcatatttctgcgttgctgaataagagtgcgagtgttgcacctacgggaatggggagtttgcttgatggctattatcaactactgcaagacaggcataaacctgaatttaaacggcgtttgttgtttactggtattcaagccttggatgacattttgcaaggcattgatgaaaccgatatttgtgtcgttggtgggcgttctggtaatggtaaaaccgaaacggcaattacgtttacgaaaaacattttagagcaaggtggttcggtgttgtttttctctcttgagatgagcagacaacaaattatggatcgtctgattgccagtgcaagcggtgttaattctgcaaaacttcgtaatcctgaatggttgagtgatgaagattttgctcgaatgagtgaggctacaagtgtgatgaaagatcaaaagctctttgtggtggataaaggagctttgtctgttgaagagattacggcgatcacagaaaggcatttggctgagcataaaaagttaaatgcagtggtggttgattatattggtttggttaatcatggggcgttagatgggcgagtgaaccgtacttatcagatcggagaaaccgtagagcgattaaaggcattttctaaacaagttcacgtcccgtttattttactttcgcagttaagccgagatgcagagggttctaccccaaataatgcaaacttgagtgattccaaggcgttagagaatgttgcaagccaaatcattatggttcacaaccagcgagataaggaaacaaatgaacctgcgagatatacgcattggattgtgacaaagaaccgtaacggcaaggttgggactgcttatgttgagttccaaaatggacgatttattgagtgtgatcaggcattagcttgggaatctttccagaagaaaaatgaacaacagagaagagcgaataaggggttttaggtgagtttggattttattaagaaggtaggtgggtattttagaaaagagcaggttggtaggtaaggaggttgataggtatggagcaaaggttggtaggtatggagcataaacaaaaatactttttacgcactgagaaaattaaaaacaatgcccttgaatttgtgaaagcgttgccaatagatgagaaaaagccgttagtggttgaagtgaagcctattactcgcaaccttgagcaaaatgccaaattccacgcaatgtgcggcgatattgctaaacaggtgcaatttaacggcgaatggctaccgcttgaagcgtggaaggttcttttaatttctgctcacgcagaagcaacgaaagaaggttcttgtttggtcacaggattggaaggcgaattagtgaatattcgtgagagtacggctcaaatgagcgtaaaacgaatggcaagtttaatcgaatatgcaacttcgtggggtgtttctaatggggtgcattttaatgacagatggaatttttgggggatgaaataacctacgcttagtggttaagcgtaggtgtaagcgttaagcggttaagattttatccgctgcgattttagctaagaagttgctacggtttttatactctttgtgaaccgcaacaaaatcatcaatgcgtttgatgagatagctagggagggtgatgttgatgcgttcggcttttccgagtaaatggctaatatcaacatcaacaaagccgaaaaagaagtcatattctgcaaaatcagggtttttgcggtggttatcaatggaggttggcatcggaatttcttctccatcttcaactaagccttcaaggtggaacacgatggcttctttgacattttgatatgcttcttcgagggtatcgccagcagagaagcaccctggaatatcaggcacgataacgccgtaagcgtgagtttcgtcacctggttcaattgcaattgggtataacatattttgtccttgtggttatagcagggctattttagccccgcttgtttaagtattgagagttcagttcctttttttaaatcctttttcggatgaggcactgttactcgcccttgtttagttggatgtttgaattgatggtggcttccacttgttgcaactaagtaccaaccgtccgcttcaatcattttaattatggttttgctatccacattattgtgctcctttgttgtttttcatgtgtgtattatacttatttttatgtttttatcaactgtttatatgtaagatgtgtattttaggtgaataaatgaaattttactgcccaaactgccaatcaattcttaaagactggcgtaggttttctgaaaagtcagagattaataaggagaagccgtttaagtgtactggcttgaagtgcggtaagcggtggagtgagaaagaattggaggcatttaatgataaagccgaaagtgaaaaagcgtaaatgcaaatgctgtggtggtgagtttaagtctgcggatagctttagaaaatggtgtagtgctgaatgtggtgtgaaacttgccaaaatagcccaagagaaagcacgtcagaaagccatagaaaagcgaaatcgagaagaaagggcaaagattaaagcaacgagagaacgcttaaaatctcgttctgaatggcttaaagacgctcaggctgtttttaatgaatacattcgtttacgagataaagacgacccttgtatttcgtgccggcgttttcatcaagggcagtatcacgctgggcattatcgcacggtaaaagcgatgccagagctgagatttaatgaggacaatgttcataaacaatgtagtgcttgtaacaatcatttgagcggaaatatcacagaataccgtatcaaccttgtgcgtaaaatcggggtagagcgagtagaagcattggaaggctatcaccctcctgtgaagtggtcggctgaggattgtaaggaaattattaaaacgtatagggcgaagattaaggggttgaagcgtggcggataaactgttggaagaaccaaagcaagtgtggattgagaacttgttaaacctttggggggagtgggcatttagtgggttggattttgaaagccgtatgaatatgttggcaagattgatgttacaagccgaacctagccgtatttctaaacctgttcgggagatgtgtgatgatgagttggggttagtgattagttctgtgattggttattgcattaaaaatccttgtccgcaggattataagtatcttgaggctaaatatgtgtatgggttatcggtgtatgcgattgcgaagtatcagtgggagaaagataagtctaaaacgttacgaacttggcagcgtaaagttggagaaagtatcaaagcttctgagtgggttgttgcaaagtttctcgatcttgctattaaaaatcataaaagtggagcctctcccacaatttgtagtaaatacctgtttctgagataatacattcagacacaggtattttattatgaaccgaaaaactaacttcacgccttggcagcggaatttgccaaaaacctaaaaacaccagaagaccttcaatcaaattttcacggatgctcaagaaaatcaccgtcgaggctgcgttaaatggtgaaactgaccgaccatcttggttatgaaaaacatcagcctagaaaaggtaaaaatgcacgtaacggttacacatctaagaccgtcatttgtgatgaaggtgagatagaaattgagacgcctcgtgaccgtgattggagttgctgaaaatgaaggtgcgaagttactgggcaaatgtgctgacagagcttctaaaatacgaggctttaaaagacatttttattgcctgtgtagacggttttaaaaggcttcccagaagaccatcaatgcagtctatcctaaaacgaagattcagctttgcattgtgcatttagtgcgtaacagcttgaaattcgtttcgtggaaagattacaaagccgtcaccgcagatttaaagcaggtttatcaggcctctacggaagtacaagctcgcgaaaatctgaccgcactttcgcaaaaatggcaggcaaaatacccgcttgtggcgaaaggctgggaagataactgggcaaatattgccacattttttgattatccggctgatattcgtaaagcgatttataccacgaatgccgtggaatcgcttaatagcgtgattcgtcgcgtgattaaaaaacgaaatgtattcccgacggatgattccgtttttaaagtgatttggcttgcgattaaagatgcatcaaaaaaatggacaatgccgattcagaaccggaaaccggcgatgaatcgatttatgattgattttggtgatcgcctagacgatcaccgttaagttgaaatgggtgtttacacagaatttgggatagggtctaaatattttttcatattattcctccatatttactatttttacttgataaattccttttttctcattttcccattggatattataaataattctagcctcagaaccatatgatacgattatatcagcagaacaaactctaattttcttttctttattgaaacctttttcagaagcattcttgctgtcaataaagcgaatatagtctccatacatttttttaaagctatcgttaaagatttgtcctaaaagtgatttgacttctttatcatcacattttggaagctcagggctaaggcagccggataaaaagaatgaagatagcaaagtggacacaaaaaaataactgattttttcataatattatgcctttggataatcaccgaatctattatctccggttttactgtctaaacaagtaaatacgaataaaacgataacaccaattaatggcactaaactgataagtacccaccaaccgctgcgatcggtatcgtgtaaacgtcttaccaaaactgctaggctaggtaataaaacagccagtgcatataaaccacttagcacaccactgcccgcttcatagctaaacaaacctaatacgccatctaaaatgcttagaataacaaacgcaataaagttgaatagtgtgaacatccaatattctttacgacgtgcacgacctgcgaatgttgcataatttttaagtacattaagataccaattcataataaaatttccttatagagttgagtaaaaaagaggctttattttaatttagaataaaaaatgctaaaatccacagtatttatcctttaccccccgagttaattcccaaactcccacaatgcataggtgttatatgaaagtaaatgaaaaaattaaattattaagagaatctcgccagtggacacaggaagaaatggcacaaaaactaagtatgacaactaaaggttatgcaaaaattgagagaggggaaactatttcaaatttaccaagagttgaacaaatcgctgaagtttttaatatggatatttgtgagttattagcttatggtgaagaaggtaaaatttatattaataacactgataataatttgactaattcatttatttctttaggcaatgggactgaagaaatacaacgtttacaattaatgcttgcgcataaagacgaattattagcacataaagatgatattattgaaactcaaaagcgagaattagctttattacgagaaatgattgaaaaattaaaataagatctatcccgaccctatcccaaattctgtgtaaacacccatttcaacttaacggtgatcgtctaggcgatcaccaaaatcaatcatcaatcgattcatcgccagtttccagttctgaatcggcattgtccatttttttgatgcatctttaatcgcaagccaaatcactttgaaaactgaatcatccgtcgggaatacatttcgttttttaatcacgcgacgaatcacgctattaagcgattccacggcattcgtggtataaatcgctttacgaatgtcagccggataatcaaaaaatgtggcaatatttgcccagttatcttcccagcctttcgccacaagcgggtattttgcctgccatttttgcgaaagtgcggtcagattttcgcgagcttgtgcttccgtcggggcctgataaacctgctttaaatctgcggtgacggctttgtaatctttccacgaaacgaatttcaagctgttacgcactaaatgcacaatgcaaagctgaattttcgttttagataaccaagatggtcggtcagttcatcatttaacgcggcctcgacggttaatttcttgagcatccgtgaaaattgattgaggtttctggtgtttttaggtttttggcaaattccgctgccaaggcgtgaagttgttttcgttcataataaaatacctgtgtctgaatgtattatctcagaaacaggtatttacacaaattgtgggagaggctcgaagttggactgttgcaccattttccctaaagcagaaatttcccatttctgcttttattttataaaatccccataaaaacaaatgcttacatagtatttgataactaattacacactaaaaaccacgttttctaccccctgttttttataaaaaacagtcatttcctgatcgattttgatctgttctaaaattaattgcacacatttgcacacatttgcacacatttgcacacatttgcacacatcaactgcacacattcacaatatcggtgcgtgcttgatacacaagggatagatcgtgatgcacaataaaaatccgtcagttaaaaatggggatattgtgcgaaaggtaagaacaaagggcgaatggttgtgggtgtggatttgggggtaacaaaaagccccgatgggtcggggcgttaaatgagttgttgatatttttcaggaaaacgttctggaaaggtttcttgaaattcttcagcaattaacactaaatcggcaagtacacttttaatacgttgatgtgcatcaggggatataaaatcaaggattaagtaaacgtcatcttcaaagtcgtgtttggcataaacaagatagttgtcactttttcgtgattgccctgcttttccttgccatttagtaaaatccgcttctgatacggcaacatgtagtttgtgaatacttgctaaaagtgaacgtggattttcttcaaaacgtccataattgccgatagttgatgggtaaatttgacgataactcgcttcaaatgtcagcaatccttctgccaatgggcgaagtggttcaagcaatgtaagtctagggtgaacaaagactttagccattgatgccgtaccgtctgttactgtctgcgataagctcgtctaaatcggcttgggtgaaattgcttgtactaggtacaaccatatagtgccctaattcttgacgtaaggtgattgtaaaaaggttaaaagaagcgacttcgttcatatagtctttaaaggtcgctctgtcatttaactgttcttggaaatgatgataataattttggcgaatatctttcactaatttattgagcattaaatcaatgaaaatcagatcgtctatgactttctcaggcgttttcattgaacgaacgacagcgtttaataatgaaacaccttgcgtcaattcttttaatcccgcaaaaaataattctgtttggctttctgattgttgtgtaagtaaggttgaagccttttttacttgattaatgacctgcaaaacatcgctctgttttggatatgcttcaatttcttgactaaaaaaagacgtaaaaatgcccattgcaagacttacgtccttcaatgattttgccttttctgtaaatgattttttcatagccacctcgttatttcaggcggatcatagttttacttgctgtattctgcaagtaaaaaccccgattgttcggggcttttcaactgggtcacaaactgggtactgggtcacaaactgggtactgggtcacttatcccaatatcgactgcgtgctttcgcttgggcgttgcgttgttgcttttcaagctctcgtgcgacaaggcgagcaatctcttcagcactctgccctgcggttgcattgacggtgatattgaccgactgattaacaggcggtggggcttgccgttggatttgcgttggggcaatcagtggacggttatccacttttaccgcaggcataggctgtgccagtgccaccgtagaggctaaagcagccatacctgcaacaccgccgtaatttaagcggttgagattcgccacaccaattcggcttgtggcttctttggtcataatgtactcgccgccgtgataaatcccttttggttcaaacttaccaccgttaccagcataaccacctgaccattttggtttatttggcacattgttagtgcttggatcataattcgggtcgtacatcatatttgccatattggcagtattttcaatttgtttggcgtgttcaggcggaacaattttacttgccactttacccacaccatcgctgacactattaatgcgagtttcaagccctaaaaattccattgccttattaaaagcattggtgatagatgatgtaatgccattccataatcccatcacggtatttttcaggctttcaaatttattgccaatggatttagtcactgtatcgacaacgacactccagttgtttacggcaaaaataatcccgttaatggcgtttacaaaccagctatccgcaaatttcgttttgagccaatcccacgctgtgccaatggcgtttttgactttttcccaattgaaatagagtaaggcaagaataccaataattgcagtaatggctagcccgattgggttagatgcaaaggcaatagcaacagcacgaatgccagtgattaagccagaaaataacaattttccgtagcgtaacaccgaaccaaaaacagcgggcattgcattccatactttcgccaacgcaccacctgcacgcacaagcaaacctgctttcgttgagccatcatctaaagttttaccaaataataaggctttacctatgccccatactccattgagtttgtctaacagcaaaataaatcgcccgaatgggtaataaatcaaacttaatgtagcagtaagtaatccaaatgcgcccattgcagcaataataccaacagtccatttagcaatagtgactgttaattcgggatttgctttaatccaactattaatcacatcaagaacacctccaatgtatgacatcgcctccaccagagtctcttttagtttattaccaatttcactattagtattaaaaagttgatttttgaaaatctgccatttagccgaaagcgtagtcaaacgtgtttcaaattcacgagtcatactgccttttgcttcaacgctattggcaagggcaatttgtcgcttccactcttctgtatttgaaacaagtaatgctagggttttggtatgctcagtaccaacaagatcagcaattaaacctaaacgtttttgttcaggcattttttttcaaagcatcaactaagttcataatcgtgccttgagcatcttttaccatacctatttcaacttttgaggcattcaatcccaaatttgataaggcatttgctactggctttttcttacttgcagatgcaaggcgagtaaaaatggcattgacggcagttgctgattgttcttctgcagcccctgcagtttgcaaagttgaacctaatgcagccatatttttctcagaaatttttgcaatacctgcaatccctgaaactcgattcataaaaccaatgatctctgtgccttttgaaatggcattatcatctaaatagttgattgcatcggctaattcacggctactttctgctgataatttaaagttcttactcactttcccaaattgttcaacaagttcatcaggattaagtgcatcaaatgcagttgccatttgcgtgttaattctgacaaattcttctagttgctctttaggcacatccattcgagcagcagcggtaatcatttctgcaatttgagtggttgttaagggcaattcttttgataaatcttggattttttctttccaaagatcatattctggggtgaatttaccgcttgcatcttttagtccttgtacttggcgtgcaacacctgccattgcgtcttcaaactccataaattgtgcaacaggttttacaagttgagtaccaataacatagctctgcaccatagcacgttgccctaatgtgccaagttgttcactacgatcttttaaattttgtacacgttgagcatataaagcactttctttagatttctgatttaatttactcaaacggttttcttgagtcaaaatttcctgatttgctaacttcattttgtagctcaattcttgttgagcctgcgataatcgtttcgtattgataccattactatctaaagcagaacgagtttcacgtagtttctgattatgtttaatctgttcagcctctaattttttaactgcattgcgtgctttatcaaaggctttttgcattttttgtgttggttgtgcggtggcattaagttgctgtgctaatgcttgagccttatttttcgcttcttgaattgccttattactttcgaaaacagccatttttgtctgtctaaattgatcaatcagcttttgctgttgttccagagattttaaatttgccttggttttcaataatgcttcagacattttgtttgcctgagttgcgacagatttcaacggagtcgaaattttatcgaccgcagaaagtaatacttgaagttttaatgaattgcttatatagttatctcatagaaaaattttaataggagtagaatatgtttgccttattaattgaaatttttggttggttttttattattgcttgtatctttactctcattgcagattctattgatttcttcagaaaccttttttaaaggcggtctaaccgcctttttactgtcctgccaacgccttaatcacaaaattttcaatcatttcaatatcttcatcggtaaagcctaacaactcacgctgatcatatttcaccttccaatttgcacttctcaccactcgaccttttaacccgtactggtgaatttgtgcaatatgtgcgtcactgccactgtaacccaactcgatattatccccagcggttcttaacttcataaatcgggctgacttcaattttaagaacattgcattttgtttaatctttcccttgcgtttcttacgttgtactttgcgtggcgtgtacgacgagccgtcaggattttgctgtgcggtaatacgtctgcgttggctacgagccaattcacgcccgatttgttgatatagcaaccgtcgccgtggtttgctgatatttttgagcaacgcattaaacgctgatttaaccttgataatgtcgtctgtcgccattattccatcgctcccattcgctcatacacctgttcccctttcacaaaatagtcagccgttccagaggttgccattcggtcggctgtggctcttcggcgtggtgagcttggtaatgatcgccttcttgtttgacaataacacgctcggtcagtggaattttgatgtaaatatcgtgggtggcgttgttgtttgggtcaatttcaaaggtgatgctgtcctgtttgttgggattggttatcagctccgattgttgcaagcggacaaattccatcacaggcacaaacagtaaatcagggtgttcagggaaatcttccaccacaatttctaagtcgtagagatattgataactgagtgatgtcgcccctgtcgtccagattttgccgttggcatagtaaatctgtaactgctcaggatttttggcaaaatagggaatggttttggtgagcaggtcacgcaatttgtctggtttaatcatttgcgatagcctttttgtttgtattcataaatttgttggcagtcaatgcaacgggtgcaaccttgcacgttttggcgacgggcttcgggaattggttcgtcgcaatcttcgcaatgggtcaggctgtaagcggtcggtttgttgcgaagttttgcaagggcaaattctctttctttttcggcaagctcattggctcggtcaatttggtctttcatcgctttttctcgttgggttaaatagcgatattgtgagtaagtagcaaaggcggggcgaatggttgtgggtgtggatttgggggtaacaaaaagccccgatgggtcgaggctgtggagttagttttttgtaacaggtttaagagttccttccgcttttgctttttgataggcttgacggaactcttttaatttttggcgtttaagttcaacggcggtcatttttttcattattccctcctgtataggtcggtgttttaataataaagcaatcttgttgatcgcctaaatttgatactgtttcaaagtctgacataaaggaactcggattgcaacacattttactgtacattcttgctagtgatgggcgatctgcaacgaaaacatagcaatcaggcttgaataaaaggtagtgttcatacactaatttttcaaggtgtgatttcagagctttaatttccgttttaccaaattgatgattcaacggtgacgcatataaatcttcattgcctgtttcaatatattccttaacagcaaatttaattgaatgtgtttttttatgctgaatgatttctgcaatagtcggatcttgttctaaaaataatagagtatctttatcatcagaaaaaatcgccatataagtgacattgacaatttgaaattcggtagagatataaataatcccactatcgttgtcttgtgttttggtaaaatgataagagagcatttatctgtaatattctgctgtttaaaaactcaggcaatcctaagacaaagctctctgtctgtcaatgaagtgattattccgcaatacgcttattgtaaccttccacacacgcttcccagccttgaatttccacctggcaaagctcaatcgtcgtcaaactttggtcgagcgattttgcaagatcagcgttggtctttatctcgaacctggggctgtggcactgctttatttgggggcaaaggagcggaattggctttactgttcgatactgtaccgcttctttggttgagcaaccgactaacgccagtaggcacaggctgatagctccaagattgattgttttccagttcaagtaaaatttcattggtgcgtttctccgcttgggtgagcttagttaaaacttgttgatgtaatttatccacctgcttttgatactgcagaatatgttggtttgcctgttctagctggttggctaggctttggttatccgctcgcactaaagcaatttcttcttgtttggattggttgtccgcctgcagtgttttgcgttcataacagagaaaggcattaatgcagacaccaatcagcaaggcgataatcatcgctttgccaaaacttttctcaatcataccgcttataatgctaaacatagtgctttttccttttctcgtctgatttctaaaccacgcagttttttgccattggcatagacccaacggctaaactgttcacacattgcagggctgtaaccttgattggcgagtttgaacaaggtcgaatgtcgcattgttccgcaacctgcattgaaggtaattgatgtcaatgcgtcaaacgctccttgtggcatttttttgccgttggcgtagcggtttacgcaccgttccgcttcggctaaatcttttgcccagcggtcagcaatttctttgtcgctgtaaattttgcgttcaatcttaccgcttgtggcttcggttgaaccaatgccgacggtgagtacattcgcagggcaaacataaggatctcgtctgcacccttcagtgttgccgataatgtctaagccttttggactggtgcggatttcagggtgattaagctgtactaagccgataattgcaccgataccgcagaccatcgctccgccgaatttaagatttttgttcatcgtctaaaatgtcctttaagttgattttataacgctcaagggctttttctttcagtttgatttctcggtctttgtagtaccaattcatcaatagggtaaacaagccgaataaaatccccattattacgccccgtcggctgcgtggtttgctcggtttagtcggtgtcggcttggtttaactgcttctgaagttttttaacactgccttgcacaccgatgtttaaattcagttctaatgcccgttctaagtagctgagtgccgtttcaggctgtgtcgtttcaagtagcaagccgatttcacggtagagccttgctcgactttcgtctggcatatctttctctttggtgagttcgtccactcgtaacaagtagctcacttcaaacggcttttgcaccttctgggcttttttcgctgcgtcagcaaactcttcagcaagcattgagcaaagcgaacgactaaagccgtcaggcaatgtcaggtcttgatgaatggcgtaatcggcaatttgtaaagcaaggtgatactcgccacaatccaccgaccatacttgccacgtcatcagtacattgtcctgtttgccgttgcccgcactcaatgccccttcaatccacggcaaatagtggtgcagaatgctttttttataactggctcgctgttccattgaggcaatggctttcaggtcttttttatgacgggccagtaagtagagcattttttcgtattcgtcgaggttttctagttgagcttgctcagaagattgagcaagctccgcagttactcgcaaatagtgggcttgagttggtcgcattaaccgcctactccagtagtatcaggtgaaccaagcatactaatgtttttcaacagggcgacttgtgcataattttcgacaacgaaatcatcgttagaagaaacgaaatttttacccgtaaaaatgtggttgtaatccacaccgttgtcttgtgctacacctgcaaggtaagtgttaaatttggtcgctgtttctggtctcatattctgtcctttttagaaaacacgttcattatttaattcaccacccgtaatttcagggcgtggcgtgtagccgtgttctggctcactgccgataacatcaacacggctttgtaaagcggtgagatcggcggataatttttcaaaatctgcacacaatgccattttttccgcttcggtttgttttagcttatcttctagctctgtaaatttttctgctaaaagcaactgtgcctgttcgtgttcagcaaaacgagcttcaacgtcggctttatgttgggctgtgtcagctttttctttactaaacatcgctttcattttttcaaagaatgacactggctcttctgcaaaggtaagcgaacattccaccgcttcagtggtaaagatttcgccttgctttgcaccgtctttcgttgtgaaagaaagatattgtgtgcctaagctggctggcgtgtcagtcacggctaaacctgtcaaataggctttgcctgttttggcaaaattggtgcgaacttcaatagaggtataaaccttctgcttgcttttcactaactcgactaattcatctgtcggctcaatttgtgcataaagctgtaatttgccttcatcattctcttctgccttaacggctaacacatcaccgtagcattttgaatgggcaagttcagggtcgaacccaaacaagtgaaaatgttcaaggttgatacgagcgccgtaggttttcgggtcgtacgtttcggcaatatcagaaagccactggcgttcgatctgacgaccgtccaccgttgctccttctgtggctaccacaaaccagttggattttttcggcataaatgcttcctcgaaatgagaatgttcaaaattgccgatatggtgattggattttcaaacaggtgcaaagcgttgcggttgttaagcaggatttaacaaaagggactgttctacaaacgccgtccgtttcataacaatagccatattttcaacgatgacgcaaaacaatgacggatattgcaacaaaccaagcggaacagaccgctttaattaatatgaatacccaccgtgaagcccaattaaagtattgggcaggctattcactcacggaaattgccaaaatgcttaacattcccgtgtccactatcgccagctggaagaaacgggaaaaatgggacgaagcacctttgtttgaacgtgtgagcggtaatattgagaaccgttatatgttgctgttacaaaaggacgttaaaacagggtacgattttaaagagttggattttttaatgcaccgccgagagtagaaggcggtgattatcgtgtgttgcatacggatacctttcctgctcggcggtaatgtacctcttgcattttgcattgtgcgagcttgcacaaacatcaaggtcaaatgttctgtagaagatcagacttgatctgacaaatcattataaaaatgagagtttcccgtttagaatatgagtgtctaaaattcaatctaaacaaaaaaggaaactctcatgttttattacttacaatccgctcattaaacacaagactggtttactcaatttagcagaagagctcggaaatatttctcaagcttgtaaagcgatgggaatgagccgagatacattctatcgctatcaacaagccgtagagcaaggcggtgttgaagcattacttaatcaaactcgtcgggtaccgaatatcaaaaatcgagtagacgagcacattgagcaagctgttgtaaaatttgccttagattttccggcttacttatcagcaaacatttgttgatacttatagcaaggttgcttttgcaaagctctacacaataaaaaccgcaattgccgctgcagatatgctcaatgataaagtcctaccgttctttgaagcccaaggattaccgatgttgcgtattctcaccgaccgtggcagtgaatattgtggcaaagtggaaaatcacgattatgagctttatttagcgataaatgacatagagcatactaaaacgaaagtgaagcatccacagacgaatggtatctgtgaacgtttccataagactatcttacaagaattttaccaagtcgcatttaggaagaaaatatatacggatttagctacattacaagctgatttagatgagtggttaatgtattataatcaccatcgaatacatcaaggaaaaatgtgctgtggcagaactccgatggcaacattacttgatggaaaagggatttgggcagaaaagaatttaagctcaaattaatctgacagacacggtaattttaagcggggctgtcagattaggtttgatcttctacagctaaagaagcaataacggccatcattgcataaccaaatgtacccattttgaactcctgtttttagattgaaagaaattctaacataaaaataacaagctgtttttgtttttctactttattacacaaaacatcaatcagcattattttgatcgtctgcaaatttcttcattaattggctcatttgctggcaatgtttttcaaatttacgacaatgtgggcaatacaataaatggattcttacccctattttttctttaagcaataacggtctttcttgagcttcagagaccaatttcgtcacttcttgacatttcattttttgcccccaaaaatagatttactggataaacattgttgcaattgtaagcgtgaacgatacaacaaagtatgtagattggcttgactaatttctgctgtatggcaaatttcattagcagagagttctaaatactctcgcatcataaacacgtgcgcttgttttgctggaagtttagtgagacacagttcaaaaataatccaaaattcatcggaataaacggcattttcgggctgttgccattcttgtggataacactcctctcgccaatacccatcttgatcaaaaaatacattgctatcgttttcatcatctcgcaaatcactttcaagaactaaacgatctttttgacgcagatagtcaataattttatttttcaaaatagcaaatacccaagttttaaatgcggcatcacgtttaaaactatctaaatttttaagtgcgttgagcaatgcttcttgcaccatatcttctgctaactgactgtctcgtagctgaagatgagcaaattttagcatttgttctctaattgctgccatttgagatgaattaatttcttttaaaatcatagtgttatatatttttctaaaaaaatgaaaaatttttgtaaggatttccctcttacaccgactaataaggtgaaagggaaacttttcgtaaaaactaacctatcttaaccttaacaaatctttttacaagaggaaaaatttatgaaaactttacttaaagtattaatgacaacttctttagtttctattgctacaatcaatacagcaaatgcagaaatgatggatgattgcaaaaataaaatgagagcagattgccaaactatggaaaatatgaaacattctgaaatgaaaaaaaatcatatgatgaagtctgatgatatgaaaaaggatggaatgatgaagtctgatgatatgaaaaaggatggaatgatgaaatctgatgatatgaaaaaagatcatatgatgaaatctgacaaaatgaaaaaagaaaagatgtaatttaccatctaaaaataattctaataaatcgagcagtagtatatttacacactaatacctctactgcttatttcagaattagagaaaattcgaaggagaatatatgaaatctcataaaaccgtattatttacccttattatgtctgctatatctaataattctctagcaataaatcatactaataattcaagtaaggaaatgagtaaaatgacacaaactcaaaatgagaatattcgtgaaatttatttagctggtggctgtttctggggaattgaagcctatatggaacgtatttatggcgtaaaaaatgctacgtcaggctatgccaatggtaaaaccgataaaacgcattatcatattatcggaaaaaccgatcatgcagaaaccgtgcatataacttacgatgctaataaaatttcattagaaaaattacttaaatattattttcaggtcatagacccgactagcctgaataaacagggaaatgatcgtggtagacaataccgcacgggaatttattatcaaaatgagcaagataaagctattattctaaaagaaattgaagcgctacaaacgaaatataaagacaaaattcaagtggaagttgaaccacttaaacattacatcttagcagaagagtatcaccaagattacttaaagaaaaatccaaacggttattgtcacattgatttagaacaagcaaataatattattattgatcctaaagattatccaaagccaagtgatgaagaattaaaagctaaattaacacctttacaatacagtgtgacacagaaaaagaataccgaacgttcatttagtaatgaatattgggataacaaaaaagatggactttatgtggatattaccacaggggagccgctattttcttctagagataaatatgattcgggctgcggttggccaagtttcacaaaaccaattgacaaaaatgtggtgacttatcaaaaagataccagttttaatatgattagaacggaagtcttaagtcgcagcggtaaagctcatttaggtcacgtatttgatgacggtcctaaagataaaggtggattgcgttattgcatcaacagcgctgctgttaaatttattcctcttgagcaaatggaaaaagaaaattatggatatttaattaacttaatcaaaggaaaataaaatgttcgaccagaatttactcatcagcagtgtatttttagctggattagcctcttttttatctccttgcattttcccaattgtgcccatctattttggcatattaagtaaaggtggtaaaaaggtattaaatacactcctatttattatgggattatcactcacatttgttagccttggttttagttttggctttttaggtgatttattattaaatgatactacgcgtgttattgctggaattattgttattattcttggtattcatcaacttggtatcataaaaatcaatttcttagaacaaactaaattagttgaaattaaaacaaatggtaaaagcgcttctgtagaagcttttgtattgggtttaacttttagtcttggctggacgccttgtatcggaccaattttagcttcagtgctagcattatcaggcgatgaaggttctgctctatacggtggtgcaatgatgtttgtttatgtattaggtttagccctaccttttattatcttttcattcttttctgatgaattattaaaaagagctaaatcacttaacaagcacttagataaatttaaaatcattggtggaacactaattattttaatgggattattgttaatcactaataacttacatagttttatgtaatataggagaaatataagatgaaaaaaataatgggcttacttctcatgctatttagctttaatgcttttgctgaagaaaataaaaatttggcagacattcaatttaaagatctcgataacaatatcgtttctttagaaaagtataaaggaaaaaatgtctatgtaaaaatgtgggcatcttggtgtccgatttgtttggctggcttggctgaaattgatgatttaagcgctgatcaaaataaaaattttgaagttattactattgtttctccagataaaaaaggggaaaaatcaactgaaaaatttattgaatggtataaaggactggactataaaaatgtcgttgtactattagatgaacaaggtgaagtgctgaaaagagccaaagtcagaggttacccttccaatgtttttttagattctgaattaaacgttaaaaaagttgtaccagggcatttatcaacgacacaaattactgaaagtattaactcaaaataaaaaataaaacctaatctaacgatcaaatataaaatgaaccgttaggttaggtttatttttttataagctaagttgtagaagatcagacttgatctgacaaatcattataaaaatgagagtttcccgtttagaccctatcccaaattctgtgtaaacacccatttcaacttaacggtgatcgtctaagcgatcaccaaaatcaatcatcaatcgattcatcgccggtttccggttctgaatcggcattgtccatttttttgatgcatctttaatcgcaagccaaatcactttgaaaactgaatcatccgtcgggaatacatttcgttttttaatcacgcgacgaatcacgctattaagcgattccacggcattcgtggtataaatcgctttacgaatatcagccagataatcaaaaaatgtggcaattatttgcccagttatcttcccagcctttcgccacaagcgggtattttgcctgccattatagagcttttagtcgttatctaggacagccccaagatattttacacacattatgctatctctttactaagagtataaataatgctaaagcgataatttagtaaattgattttttctaataaaaagtacctataatttgagatattactttttctcttttgatgaagagtcagtagtactgttttgagatagcatgttttttgtaaaagaaagtttactatttagaaatatttttctattccgtgtgatttttctagctaaattctgtattttaattaaaatatgcgtgttcatttttattgacaggtaattgtatgaaaaacaaaacattaggaagtaccttaattgttgcaggtacgacaatcggggctggaatgcttgctatgcctttgacatcggcaggtatcggctttggttttacgtttttacttttggttgcactttggttattactttgctttagtgccttattattcgttgaagtgtatcaaactgtggacagtgacgcagggcttggtactttggcagaaaaatattatggccctttcgggcgtatagtttcaacaaccgttttaattgtatttctttacgctattttatccgcttatgtatcaggcggtagttcacttcttgctgcatttttaccaactattattgatgctgaaaccactacacgtatttcaggtgtaatttttaccgtggtatttgggatatttattattttaggtacgaccagtgttgatgcggtaaatcgtttattatttaccacgaaaatcctcgcttttatcttggtgttattcttactgttgccaaaagtgtctattgataatttaatggcaatgcctattgataatgcactgttaatttcagcaagtccaattttctttaccgcatttggtttccacggttcaattccaagtttgaacaaatatttagaaggcaatgtgaaagcgttgcgtatttctattgttgtgggtacatccattccgttagttgcctacattttatggcaattggcaacgcacggcgtattaactcaaacagaatttttacaaattttagaaaaagatccgacattaaacggtttggctgaagcggctagacaaattacaggtagttcaattattggtgcaatggtgcgaattttctcggtattagctttgatcacttcattcttaggtgtggcacttggtctatttgaagcattagaagatcttttaaaacgtgtaaatataaatgcaggaagagtgagtttaggtgcattaacctttattccgccaatgttatttgccttcttctatccacaaggctttattgcagctctaggctatgctgggcaaatgtttgctttctatgcgattgtattaccaattgcaatggtttggaaattacgtcgtcaaaatctaaatttaccatatcaagtaaaaggtggttctatttccctattactcgctttagttattggggtatttatcgtgatggtaccatttttgattgaaagtggatggctaccaaaagtggttggataatttgttgaatagcaagtacaaaaattaagtcattttgtattatgaaaaaatacactgagtgtaattatttttttacattgagaatttttcgttacgttttgattttgttttgctagaatgcctaggatttttatttcaggagtttttatgaaaaataaaattttaggcagtgccttaatgattgcaggcacaaccattggtgcaggaatgttagcaatgccattaacttccgcaggaatgggctttggaatgacgttggtattgttagtgggattatggttgcttctcacttatactggattactgtttatggaagtctatcagaccgctgcacagcaagatgttggggtagcaacccttgctgaacagtattttggaatgcctggtcgcgtattagcgacagtgagcctacttgtgctactttatgcacttttagctgcctacattacaggcggtggctctcttgtttcaggattattacctgaaatgggagaaggtgataccactttaaaagtcagcattttgcttttcacctttattttaggtgcgtttgttgtcgtaggcattaaaggggtagacggtttaactcgtgttctttttatcggtaaaatcgttgcatttgtatttgtgctgttaatgatgtttccaaaagcaaaattagaaaacttaacagcagtgccactagataacttattagttatttcagcgatcccgattttcttcacctcttacggctttcacgttattatgggtagtatcaatagctaccttgatgcggatattcgtaaaattagaattgcggtgattatcggtacagtgatccctctcggtgcttatttactatggcaattagcaacacacggcgtattaagccaaggcgaatttgtcaccttattaaaccaagatccaaccctaaatggcttagttaaagcaacaagtcaaattacaggcagtaccattttaggcgagatggtgcgtattttctcagcgttggctttaatcacctccttcttaggggtagcaatgggtatttttgaaggggttggcgatttactaaaacgtgtaaacttgccagcaaatcgagcgattttgacacctttaacctttatccctccgcttgcatttgccttattctatccaaacggctttattgcagccttaggttatgcaggtttactctttgctttctacggattaattttacctatcggtttagcgtggaaagttcgccaagcacaccctaacttaccttaccgtgtagcaggtggttctatcggtttaattttggctttcattatgggtattgtgattattgttatcccattcctaatgcaaaacggtattttacctactgttgctggttagaggtatattgcttaggtttctattctgcaccttagttaattggtaaagccaaatctctttggggtgcagatccatatcaggttcctttaattttgtctctatgcctttattggaatattcttagggtaaaaagacagcttcttatcgttttttatctaatttttctggttgctcaattaaaattagaatggcggagttaccgccccattctcttggtgcttgatgtaacgcaatcactttcgggtgttggacaagccaacgagggatttggtatttcaatgcccttgtgccatagcctgtcataatgctggcacaataaatcccttctcgctcacaagctaaaattaaactcgccagctcttttttggcattttctttggtcaaaccgtgtaaatctaaaaagagttcagggtgaaagtcaccacgacgaagctgttttaaaatataaggatcaacatcttcccgacggtatttcactttatcattttcttcggttaataacggctcatattcatcggaaaaataaaacaatgtatccgctttttcttttaattctctgatctcattgatttttttacgcggttcaactttaggaacaaaggtatcttgtttgattttctttgttcccttaatcgcttctcgaaacaaagccaattcatcattttctaacataatatttccttttaaattaatcagcccattctaacacaaagggaaatatggtataaaacggcaatttttcaaaataggtattaaatatgtacgaacataaccttgaacttcttgatgaaatcgcttcatcgcctgttgctgacgatcttgccactattttagatatgatgcgttgggcatacagctactttaacgcctctgatctctattacggacacggacacgacaatgcgtgggatgaagccaatcaactggttttaaccgctcttgcattgccaatggacgtgccagaaacactctacgcttcacgcttaacctgtgtagaaaaagaacgtattattgaaatggtcgagcaacgtttaggcttacgcaaacctgttgcttacttaacaaattcggcgtggttctctggcttagagttttacgttgatgaacgagtgatagtgccacgttcccctatcggcgaattaattcaacagggttttacggggatcttacgagctgaaccaaaacgcattttagatatgtgtacaggaagtggctgtattgcgattgcttgtgccgacaaatttccgaatgcggaaattgatgcagttgatctctctgttgatgcgttaaatgtagctgaaatcaatattgaacgacacaatatggctcatcgggtattcccattccaatcagatctgttcgacgatctaccacaagatcgctatgatttaatcgtgaccaatccgccttatgttgatcaagaagacttagacgatatgccagaagaatttcaccacgaacccgaaatggcattaggttcgggggtggatggcttggatattaccaaacgcattttagctcaagcggcagatttcttatccgataacggtgtattagtctgcgaagtgggtaacagtatggtacatttaattgaacaattcccaagcgtgccattccactggcttgaatttaaaaatggtgggttaggggtgtttagcttaacccgtgagcagttagtggcgaatagacatttattcttttaactcatcgggtttgttatatttcctgtattttagtacgtatataaagattaaattcagtaatttttagaaaattttcgttataatagaacccaatttttattaggaggaatatccatggctaccatcaaagatgttgctaaattggctggggtttcaaccactaccgtttctcacgttatcaataaaactcgctttgtggcagaagatactacaaaagccgtatgggatgcgattgccagcctaaattactcgcctagtgccgttgctcgaagcttaaaagtgaatacaacaaaatcaattggtatgattatcacaacaagcgaagccccgtactttgcggaaattgtgcttgccgttgaagaatactgctatcgtcaaggctattcgctatttttatgtaatacccaaaatgatgctgaaaaagtacaaaaccatttagatatgttaattaaaaaacgggttgatggcattttggtaatgtgttccgaatatacggaaaattccttggcgttatttaatggcacgaatgtacctatggtggttatggattggggtccgaatgatggtaagagtgaccgtattatagatcacagccttgatggtggttatatggcaaccaaacatttaattgataatggacattgtgatattgcgattattgcgggttatctttataaaacaaccgcaaaagcccgttatgatggttttgttaaggcaatgacggaagcaggtctgttgatccgcaaagagtggatttttgaaaatgactttcagcctgagggcggttatgaaagtatgaataatttgctcaaacaggataagttacccaccgctgtgatctgtggttgtgatgcaatggcgttaggtgtgatttcagccattacagaaaaaaggctttctgttccgcaggatatttccgtgattggctatgataatatccatagttcacgtttctatgcaccgcctttgacaactattcatcaatctaaaacacgtttagggcaaatggcaattgataccttattagagcgtattcaacagcataatgagcaaccgtctgagcctgttactcctaaagtattggaattttatccagaattagtggtgcgtagttcggttcgcaacctaaatcaataaggacgttagaatggaactattaattgagtttttcagcagctatggttattgggcagtatttctagtcttactcgcctgtggctttggtttgcctattcctgaagatatcacattagtgtctggtggggtgatttctggtttaggatacaccaatgttcattggatgttgtttgtcagtatgctgggcgtattagtgggcgacagtaccatgtactggttgggtcgtatttacggcgagaagattttgcaatttcctcttattcgccgtattgcaaccccagaacgcttcgcaacagtacaggaacgctttgaaaaacagggctggaaattgctttttgtagcacgttttttacctggtcttcgtgctgtggtgtatctggtttcgggtatcacacgccgagtaacctttactcgctttgtgttagtggatttctttgctgccattatttctgtaccaatttgggtctatttaggggacttcggtgcaaagaacctagactggctacatcaacaaattcaaaaaggacagatggcaatttggcttatgttattgattggcgtagccattgtattttggaaatggaaaaagtctcataaagtaaattgaaaaacataaaaaaagcccctataacaggggctactcggaaagcaaatttgtgatttgggttattggacataacacttatttttgttgctgtaagattacatcaattttttgagtttttcaaattttaggcatagtagacaaaagtgttggtaaaaagtgggctaaagccttatagcacaaggctttaagctcactttttgaaatatgaacaaaaaactgtcctttttgccttaagaacaatatccaaaaatatcactgttccattagaactattcaacgttatattgaaaaatcccccaaagctaaattaattcctttacaacaaacctatctcaatattattgcagacgtgaccttctttggtcgtgaatttggtgtattagttttaatagataccttatctaaatcaccgctttcattagatttccgcctattatttctaacttttattgataaaagttgaaaaattcttgttattttattcttagttttgtgtaactcttgtttttttttttttttttactaatagcgtgcggggacatttgtgcatcctgaaaatgtaaataaaggtttacgatgttttattaggaaaaacagcttgtagggtgggtcttgacccaccatgtagccgtaacatattgattttattggtgggttaaaacccaccctacaatattcaatccatctaatatatggtttgtcaaggagttaacttcccccgcttgcgggggaagtgcccgagcgaaagcgagggcgatgggggcatttgtgcatcctgaaaatgtaaataaaggtttatgattttttattaggaaaaacagtagagaaggttattatgaataaaatatttagagttatttggagccatactcaacaggcttgggtggttgtgtctgagttagtaaagtctcataccaaaacatccacttgcacggataaaagagctcaagtatgcacctcagattattttttagataaacagcaagataaatttaaattaagtcttttaagtctagtattactaggtatattttttagtccatcagctgctgctaacacaacaaataacgcacaaccatatcttcaagatggtgctactacatcgaatggatatgacgacggttctattggtattggtaaagagagtaaggtttcgtatggtgctgttgctatcggtcagaagtcaaaagctgaagctaggcataatattgcgataggttttgactcaaatgcaggaacaagcgtaaactctgttgcgataggctacaatactcaagtaactgggaaggaaggaattgccatcgggaaacagtcaaatgcgggagagaaatctgttgtcttaggcggacaagccaaggggacaagtactcaaacagttgtagtaggtaaccttgctattgcaagtaagttacaatctattgctatcggtgcgagaagtaagtctaccaatgagtacggtattgcggttggtggtggtgcaactgctactggaaaaaacgccgttgctgttggtagggagtcgaaaggtgctgggacagattccattgcgataggtaattctgcgagaacaacaggggcagactctgttgttgtgggtgccaatatcaatgtgacagatggacaattagtggcaattggataccaagcaagtgctaaaagtcgttctactgccttgggttataaagcctctgccggtggtatgcactctgttgctgtgggtgaagaagccaaaacaaatgatggtgctgctagagcaaccgcacttggtaataataccgttgtcaccgtgggtggcggtgtggcattgggttatggctctaaggcagatagagcaggtgatattgaaggggcaaaacagtcttattctgtaacagcagcaagcagtgttgataacggctttaaatctacaggaagtgttgataacaatcctattggtgcggtttctgtgggtaataacaacatcaaacgccaaatcgtcaatgtggcggcaggtaaagaattaaccgatgcggtaaacgtggcgcagcttcaatctttaaccctgaaaattgagggaaatgagaataagcataacggtgtaaatgctaatttaagcagtgctgacagacctaaagtcggcttgtggagtggtacgctcaaggtaaaaggcgacaacggtcttacttcccatgctaatggcgatacgattacggttaaattaaccgatgatactaaaagcaaaattgataagattgacaatttaggttggaaacttgcaattactcagggagcgagggggcaagcaattccaacggaacatcttatcaaaatgagcgatacggcaaccgtaacctttaccgctggaaataatattaaattagaacaaaacagcggaaatattacgatttctacgattggtaagttaattgcaaagactgaatgggaaaatgatggtttgaaaattacttatacggatggtatgcatgacattatcaagaaaggtgaaaaaggagatcgtggtgaaaaaggagatcgtggcgaaaaaggtctaaaaggtgatacaggtcagagaggtgcagctggccctgcgggtccagcgggtcctatgggtccagcaggggctgctggtctagtagggccaatgggccctcaaggtcctgcgggtccacctggtcctgtgggtccagcaggggctgctggtcctaagggggataaaggcgaaccaggacaagcgggtccagcgggaccacgaggacctgcgggtcctaaaggagatagaggtccaaaaggtgatacaggtgagagaggtgcaactggccctgcgggtccagcgggacctaagggtgacaaaggtgatacgggtccagcaggaccacgaggccctgcgggtccaacgggaccacaaggacctacgggtccaacgggatcacaagaccctgcgggtccaactggaaattcggaattaaaaggcattacgtcgattgccaatggtaacgacgccaccaaggcgaatggggctaagattaccttgtctgcaggttctacagataaaacagttaatgttaatgatgcgaaaattaccaatgtggcggctggtacagcagatactgatgcggtaaatgtgagccagttaaatactaaggcagcagccgcaagaactgaagttgaagcgggtaaaaatgtgaaagtgacttcaaaaacgggggcaaatggtcagaatatttacaatgtgagcgtgtctggagatttaagcgacattacttcaattagtaatggcgatacgaaagtatctttaggtaaagataagcaaggaaatccagttgtaaatatgaatggcgccagaattaccaacgttggagatggtagtgctgagggcgatattgtgaatgttcgtcagctcaacaaagtggtttcttctgtgaatacaggatttaatcaattatcaagagatattggtcgtgttgatgttaatgcaagagcgggtattgcttctgctggggcgatggctaatttgccacaaatttctttaccaggtaaaagtgctatttctgtttctaatgcacaatatcgcgggcaatctgcctatgctataggttattccagaatttctgataatggcaaatggcttattcgagcgtctgttagcagtaatactcagcgggatactatgattggaggaggggtaggttttgtgtggtaatctagcacctataaattagaatttcatgctcaatgccattgttattttaacaatggcattaatatctattggatttaatttatttgtggaagaaaaggttttatgacaggatgaacaaaagtacctctgaatattatttttctttccatgcttttggatattgtgcttaaggcaaaaaggacagttttttgttcatatttcaaaaagtgagcttaaagccttgtactataaggctttagcccactttttaccaacacttttgtctactatgccaaattttatttgcataaaaacacaatttttttatttttatgataaaaatcaaattttatgttcctaatttagtagccaagctctgccataatgtttcatatgacctgctttttgtcctgcttgatgtccaattccttgataaaggtcgaaatgttgtcccttcactgcgcccccaacatctaatgctaccattaggcggaattcatggcgaccattccagttaccattgtgatcaagtataggcatctcaattaataatacacttcctgttggaatgaggcgcttatctgatgcaactgatgctaaaggaactaatgggactcttgctgagccttttacttctagtgttggatctcggcggaagtaaacaaaagaattatttctttccagtagtgactgcaatctgtgaggattttctttactccatttacgaattgcttgaatagagatattctctttcgctatttctccatcttctactaacaaacgaccgatactggtgtaagcatagccatttttatctccgtaggctaaatgatgtagcctaccaccaccgatatcaacaaagccactaccttgtacttccatcaaaaagttttccagcattgaattagtataagccaattctaaacctttgccagccagcgcaccgcggtaaatttgagctcttgagtattttttatttcctttaggaattgcataaagaggatgatgaaattcaccttctggacgtattcttgctgggattacagggatataatagcctgtcatcagtacattttggtacccatcctgccctcgcatttgttgaatttggactccgtaatgttttaaatctttaatttttcctccatgggataaccaagtaaagagcttattatatgtttttacatgatgcttcattaggttagttgaatggttttgaatatgagcaagttgttgtaaaaaatccttttgattaacaatgttattatttatctgaatatccgatatattcactaatggtacattagatggaataaatttacgttggtgaaatttagctcctaattttgttatttctgtattaggctgctcggatatttttgtagaacaagcagtaaataatgttagggtgctaagtaaaattatttttgaataagttttataaaacatatttgttcccttaaaaatatatatcaggtaaaattttttcttacctgatgttcataaaagtgtcataaaagacagaggagagtaatcatggaaatagttttgaatcttatttagattaaaacgtcacccacaaccgatcttgtttctacacgaacttctttaagtttcactttcaccgcttgcccgatttggtaagccttctcgcctttgatgtagagtgcaatctcttctgggctaaataacatttcttctttgttattatgcagagttgagaatggaacaaaaaccgaagctccattctcaatgactttaacacgcaagccaccacgagaaacatcgtggatttcaccgtcaaattctacgttttgttctaccattggcgcaagataacgagcataaagccagtcggcaatatcacgttcaaccatacgattttgcttacgagcttcttgtaagcgagctaaaacggtttcttcgacaggttttgctgtttgatttgcaaggacttgtttaattaaacgatgattgaccatatcgccatatttacgaattggcgatgtccaagttgcataatggctgatgcctaaacctaaatgcggagctgaggttgctttaaattcagcaaaagttaaatagcgacgtaaccacatttctaagaaattttcagggaattgctcaatatcacgacgcatttcgcaatagccttcaagggtacttaaacgctcaggggagtagcgttcagataaactctctcgattttcatcattggaaagtgtatccagtaagaatttgcgagcaggctctaggtttttgctatcaaaacctgagtgggtattaaatacacctgtgtgtgcatatttatctaaaaactgtgcggcacagatgttggcaataatcattgcctcttcgatcatttggttagcgatacggcgatattcaatgtgaattgctttgactgcgccgtcttcagctaactcaaagctgtaatcgccttgctctttaaatagcaatgcatttttgctacgccagtcgatacgagcaagggtaaattgatacaaccagtcgatttgctgtgcggtttctgcatagtctggtgtccagtgattttcgactttttcgagataatcagacacttcgtcatagaccaaacgagctttagattgaacccaagctgacacaaagcgagcttcacctaccacattgccgcttaaatctgtttcaatatagccgactaatgctgggcgtttttcattcggcacgagagagcaaagatcatcggacagctctcgtggcaacatcggaatgttaaaaccaggaagatagttggtgaaacagcgttggcgagcggctttttcaattgcagactgctcaggaatgtaagcggtcggatcggcaattgcaacgactaaacgccagcctgtttgcgtgccgttctcggtaattggttcaacgtataacgcatcgtccatatctttagtgctggcactgtcaatggtagtaaaatagaggtgagttagatcttcgcgctcaacttgatcctgtaattcatagcttttctcattcgcaacaggttcacgaggctgttcgtggcgagctaaagttacccaccacggcgcgaaattatcgtccgctttacagataaattgcgtgacttgagcaaagaaaaagcgatcatcacgaagagggtgtgttttcaactgtgccaccacccagtcgccattttcaagggtttctgtgacttttttctgcgtattggctggaataaagttattgatacttgggtgatcaacggctaattgcaatttcccgtctttgttaaaacgcacttgagcgataaaacgttctaacattggctctaataacgagtcaatttcaacttgctctttatcgccatcacgcttcacaacagctttgaccttatcgccgtgcatcacttttttcatttccacagggggaatgaaatagctatttttctcacattctaaaaagccataacttttatctgacgttttcacaacgccttcaacatattctttgcttgcttcaatctgttgttttaattgagctaatagggggttattttggaacatagattctcgtattgataaaaataaaaagcggtgcgaaatgcaccgatataactagaaaattatagcggatttcaggcaggctgtctgagaaatttatgattttttcgatcgctatcgaaaaaatagcaaagcaagctagccaaaatatttttataccttaggctataaaatagctgaaaaattgtactgtgtacgttatactaaggttgtttgaatggaaacagaagaatatcttacttttattgaaaccaaagtttttgaagaagaccgaaaagcattaatgtctgatgatgaatatcagaaatttcaggcttatttattagaatctcacgaattaggcgattttattcagaatactggtggttgccaaaaaattcgctggaaactagaaagtaataacaagggcaaaagtggtggtgtaagggtgatttactatgttgtaaccaaacagggaaaattattattaatgatgatgtatgctaaaagcaaacaagacaatatgagtgataaacaaaaagcaatgttaaaagcggttgtatctcaattaagtgaggagtaaagatggaaaaagaactttttgaacgtctaatggaaagtgcgagagaaatggtcgccattgaaaaaggcgaaatagaagtaccaccgcatcgtattcatatccataaaatcccgaatgtcaaagcgattagaacccagcaccagatgaaacaagcggaatttgcttcccttttaggcgtaagccaaaaccttgtgcagtcgtgggaaattggcagacgaaccccaaatggcgctgcacggaaattgcttgcgattattgaacaacagccagaacttatccctgtattacaagggctttaggctttcattcaatgcaacagataaaactaccacaattttagtacgcggagattattatgcccaaacgcccatcaggaattgattctacactctttttattagagattttacgccgtatccccaaaaagccttatcgtttaactacgtctgagatattcgaaagtatgaaaaaggcaggctttgaaaaagataagcgaagtattcagcgtgcattaaaaaccttaagcgagcattttgacgatttggaatgtgatgatcgtgacaatgaatatgcgtattgttggcttgagagatcagtcggcatttccgtgccgatgttgaatgaacaacaagcgttaatcttaaaattagcggaacagcaacttaaatatctcttgcctgcgaatattatgtcgtcaatggaacccttttttaaacaggcagaaaaaattgtgggagcagggacgagtaaccccgaacatcagtggctcgggaaaatttgtagcgtaccgactagccagccacttatcccagctaaagtgaaagaggacgtttttacagctgtcagtaccgcacttttccaaaataagttactacatattgaataccaaaaccaagccggcaaaaaacataaagcacagattatgccgttggcaattgcacaacaaggggcaagcacctatttagtcgctcgttatgatgggtttgacgataaccgcttacttgccttacatcgtatcaaaaaagctgaattatcaacctttagctttgaacgcccaaaagactttaacttaaaacagtaccaagatgaagggaatttaggttttggtagtggtgggaaagtgaaactgacattttccattgctcgttgggccggcttccatttaaccgaaacgccactttcaaaagatcaaattacactcgaagaaagcgaagagcattaccgcttccaagcgactgttgctgatacggatatgttgcaatggtggataagacgttttggagaagatatttgggatattcagaaagagagtgtttagtgcgacatatcttgtcgcattgctgaatataatcagtttataacaagatttaatcatttgattgaagggtaaaatatgcatttatcagtaaattttaatcaagataaagataaaacattggacatcgctcaactagctacattttttaaaatgtggaaagagggtgtttttcttgagccttcggaagaaaaaaaggaattagtgattcctgatcgtgaaaaattacaatacttttttaatgagtataaagaagcacgagtaccgatggaagaagaaaaggctttaggcatgaaggttaatgtatggaaaaccgcaaacttggggcgttatgaggttcgcaatagtaaagttttacgctggtttttagatatgcatgaagatcacggacaaggaagtttcttcttaaaagcgttgtatgacagtctaggttgggataagtcatcctttcctttcccaagcgtttatcgggcaacggaagaatgttgtcctttaggagatgaaagtgaacgagtcgatattgaaattgaatctgacgaagtgttgctatttattgaggtaaaaattgatgctttagaaggtaaagagcagctaaaaagatatcatgatgttgccaaaataaaagcaggttcaagagaatggaaaattatttatttaacaaaagatggtattgttaaatatgatcaggaagataaacaaagtttatcggataaagaaaaaattataggtctttcttggacgcattttgcgaaagttttgcagaagcaaataagacaagagctaagaaaaaatccaaataaccgcagtttatggttagccgaacagtttgtagaacacatcttaactttttaatatgagggaaactaaaatgagtagacaagcagctttcaaattaatcattgaaaacattcagatgtttgatgaagcttcacatttaattaatgatgactttgattctgagctttttaatgctgtagataatgtgattaaagagttcgagtttgattttgagtgtaaaggaaaatttaattctgctgaaaatagattttcaacattttatccttcatactggttagcaaattcgtcagatgatacggatgcaaataattgctacgctcattattattttggttttgaatgtgatgaaacgggtaaaaaaattcattattgggggattacttctttattttcaaaagttgaaggaatggttttaggattctatagttggaaaaaacaattcccaaaatgcggcaataaagattggaaagagttcatgatagaacagaataaaaaatatcctgagctaggaaaattaggctttaaatttaatactaaaggctatgatttttatctaccaattaaatctttagatcctaagctagtcattgaaaactatcctgattccttagaagatgcaatggagccgattcgtgatgcgttaaaaacgttaaaagaagcccatccgatttttaacgaaattgttgaagcggcgaaaaagaaatttggcacaaactagggcttgttgatgttttgagattgcaaaatcatcaagaggtgtttatttaatatcccagcacgtcagagccgtactgggttacgcataattcagcccctttggggctgagaattagagtggcaaagccactcaactatacgtaacctagtacgcattttgcgtgctaggtataaaattataagcacaaaacattaacaagccttaaagtaattttcatgcgacatatcttgtcgtgttaaccattatatttaatagctccaatcaacaaggagatctatatgtctaaaaaagtgcaatttaccggcataggcttgcaaggtaatgagttcgtaaaaaatcacgaaaattcaccgcttgttacatcttttcattatattgagcaacttacagaagttatggcagtggatactgaagcattctcacttctgtttgtagaaaataatgagagagatttacagctgtgttatcagtttgcaaaatcattccaatttgattgcttatctgtagtcgtattaccaacaagaagggaaagtctgcatagtaattgtcataagtggctacttgatttagaaaagcgcatagatatccttattgcattaaataagccattaccagtagactgtatgttacttaaagagacggacttatttgatgctattacagtaataatagatttgatttcagagaataatttaattaatgttgatgtggaagatattaaaacagtttcttatggtgcaaaagaaatagacttttactcttttgaaatagagcgaaaaggagagacaattagtgctgatgatgtaattactcatttattatcaaaaagccacaagaaaataaaagaaataaatggtgcagttatctcaattacatcagatgaaaaccttcttttggatgaatatcatatgattatggaatccatatcgtcccttatttctgaggattgtacaatcatagcttctacaaatgagcctctcccacaatttgtgtaaatacctgtttctgagataatacattcagacacaggtattttattatgaacgaaaaacaacttcacgctttggcagcggaatttgccaaaaacctaaaaacaccagaagacctcaatcaattttcacggatgctcaagaaaatcaccgtcgaggctgcgttaaatggtgaactggccgaccatcttggttatgaaaaacatcagcctagaaaaggtaaaaatgcacgtaacggttacacatctaagaccgtcatttgtgatgaaggtgagatagaaattgagacgcctcgtgaccgtgatggcacctttgaaccgcaacttatcaagaaaaaccaaacccgcatcacaggaatggatgagcagattattgccttatatgccaagggtttaagtaatcaggaaatcgttgaaatgttcaaagaactctatgatgcggatgtatcaaccagcctgatttctcgcgttaccgacgccgtgaaagaacgcgtaatggcatggcaaaatcgcccacttgatgcggtttatccaattgtttacctagattgtatcgtagtttcagctttgcattgtgcatttagtgcgtaacagcttgaaattcgtttcgtggaaagattacaaagccgtcactgcagatttaaagcaggtttatcaggccccgacggaagtacaagctcgcgaaaatctgaccgcactttcgcaaaaatggcaggcaaaatacccgcttgtggcgaaaggctgggaagataactgggcaaatattgccacattttttgattatccggctgatattcgtaaagcgatttataccacgaatgccgtggaatcacttaatagcgtgattcgtcgcgtgattaaaaaacgaaatgtattcccgacggatgattcagttttcaaagtgatttggcttgcgattaaagatgcatcaaaaaaatggacaatgccgattcagaactggaaaccggcgatgaatcgatttatgattgattttgatgatcgcctagacgatcaccgttaagttgaaatgggtgtttacacagaatttgggatatggtcgtttttgtaaattttcacaaaaacttcttagttccttttgaattcttacgtttcatttccatattcatatcttaccggtccgactttgatttataccataaaacagtgcgatacatcttgtcgctatactcaataaaatactattgtgaaataggataggagatagttttatgagcaatcaatatcaattaaacccacctacggtttcagtttatgcagagcatttaatgttgaaactcttatttgagcataaaggctttcctgaaatttttagagagaatggctggcgagatgatgatattgcaactgcattaggcttaccgccagaaatggaaaatatcgacaatgtaagatcagttgtaaaagagcttttacaggctcgttataaagaaacaaatttttccgaagatgtgtctgaacgttggaaaatggcatatcaaaatattgaaaaattaagtgagattgtagagctaaatgaagcagaaaagaacatttttcgttttgttttccacttgagagcagaaaaacagatgaaagatttgatgtgctatcttccgcatatcaatttaagccaagctattgaaattgttgcggatattttatcgttgagtaaagatgatgtaagaaaggttttcagcaaaaaacagaaattatttgcttatggattaatggagttttctcatagccctgatcgattagaagagtatttggggtggggagatacattagactttgacgactttttaactcaacctttaacggaagagatgttattggctcgttgcactttaccaactgaaaagccgagcctttctctttctcactttgagcatattaaatcaacctatgaattaatgctttctcatttgaaatttagcattgataacgctaaaaaagggacgaacattttaatttatggttcgccaggaacagggaaaaccgagcttgcagggttattgagcgaagcattgaatgtatcaagttatacgatggcatatatggatgaagatgatgatgtacttggtggaaaaagacggttagaaaattgccgtttagctcaacgtttattgcgagataaaagtacggtcattatttttgatgaaatcgaagatgtgtttgccagcagttttatggaacgctctgtggcacaggagaacaaggcgtgggttaatcagtttttggaaaataatgatgtaccgatgatctggctgtcaaattcggtcagttgtattgataacgcttatttacgccgttttgatcttgtgttcgaaatgcctgatttgccatttagtcataaagaaaagttaattcgttctattgtcaatgaacagttatctcacgattacattcgccatttttcacaagtaaaagccttgtcgcctgcgataattacgcgtggattgacggtgatgaaacaggcgtattctgattgttctcaacaggattttgccgaaaaaacgttaaattggtttaatcaaatgttgaaatcgcaaggttttaagaaaatcgaaccgcttgtggaagggaaaattagctacaacttagattgggtcgcttgcaatgatgatatttataaaattactgaagggttaaagcggactaaacggggtagaatttgttgttatggtccaccaggaacgggcaaaacagcttgggcgaattggttggggcaagagttgggaatgtcagtattgatttgccaaggttcagatttgttggataaatatgtaggtggaacagagaaaaaaattgctcaagcctttgctcaagccaaagaaaataatatggtgttagtctttgatgaaattgatactttcttgtttgctcgtgaaaatgggcaacgtagttgggagcgcagtcaagttaatgaaatgctgacccaaattgagaaatttgaaggattattggtggtctcaacgaatttaatggatgggcttgatcctgccgctttacgccgttttgatcttaaattgcattttaattatctcaagccggaacaagcgattaaatttgctcaagaacaagtcaataaattgagcttgcctgatttaactgatgttgaacaagatcgcattgctcaattaagaaatctgacccctggtgattttgccgcagtcgctcgccgacatcgttttgcaccgtttgataatcttgatgaatggttaaaggcgattaaagcagagtgtgagattaaacaagggaaagtggcaagacggattgggttttgataaatggaaaagtattagtatttaaaaaggcatagtagacaaagggcaggaataaaacctgcccttatgcatcaatttaaaaagcaattactcttcgcccaactcacccattgcagtaatgctaaagcctgcatcaacgtgtaacacttcacctgttacgcctgaagcaagatcagaacataagaatgcagctgagttacctacatcttcaattgttactgtgcgacgtaatgctgcggtttgttcgaatgctgcaagcattttcttgaagtttttgatgcctgatgccgcaagcgtacgaattggacctgcagagatcgcattaacacggataccttctttacctaaatcagctgccatcacgcgagttgctgcttcaagtgatgcttttgccaaacacatcacgttatagttagggattgcacgttctgcacctaagtaagaaagggttaataatgctgcgtctttgtttaagaatggacgtgctgcttgtgccattgccacaaagctgtatgcactgatgtcgtgggcgatgcgatagccttcacgagttgcggcatttacatagtcaccgtctaattgatcacctggtgcgaaggcgattgcgtgaacaaaaccgtcaaatttttcccattttttgcttaattctgcaaagcagtttgtgatactttcatcggttgctacatctaacggtaatacgatgtctgaaccaaactctttggcaaactcttcaacgcgtggttgaagtttgtcgttcaaataggtaaaggctaattctgcaccttgtgctttcattgcttttgcaataccgtaagcaatcgaacggttgcttgctaaacctgttactaaaatacgttttccagctaaaaagcccataaatctgtcctctgtttaaataaaaagatgccaaattggcgaaaattgtggcgattataacgaaaaattagggtgtcgagcaaatataagcggtcagatccgagctgttttttgcaaattccatcatttcgccacaaaattttaacttttcccttgaaatcagccatttcacccttattatagagggaaattttttatagatttacattttgttgtttaattgaatattagagtagagaatgggtagaaaacgcagtgcaagttcatctcgttggcttgcagaacatttcaaagatcaattcgttcaaaaggcacacaagcaaaaacttcgttctcgtgcctattttaagttagatgaaattcaacaaactgaccgcttgtttaaacacggtatgacagtagtggatttaggggctgcgccaggtggatggtcgcaatacgttgtcacgcaaattggtgataaagggcgtgtgatagcttgtgatattttggatatgaacccgattgtcggggtcgattttttgcagggcgatttctgtgaggaaagcgttctaaatgcgttgttagagagagtaggggagggaaaagttgatgtggtgatgtcagatatggctccaaactttagcggtatgccttctgtggatattcctcgtgcgatgtatttggtggaattagcgttagatatgtgccgtcaagtgttagcaccaaaaggcagttttgttgtcaaagttttccaaggggaaggatttgatgattatctgcgtgaaattcgttcattatttaacgtagtaaaagtgcgtaaacctgaggcttctcgtgatcgttctcgtgaagtttatattgtggcgaccggctataaaggataatgtagcttatcctgtaaaattatagtaatcttaacaagtttttgattaaaaggaggtacaaaccttgaacgatatgtttaaaaatattttgctttgggcggtaattggtattacgttgatgacggctttccaaggctttgaaagcaattttaatagtgcgaatacagtggaatattcgacttttattgacgatctgaaacaaaaccgcctcagagaagtgaattttaagagtaacaatgaaacgattactgtggcaaaggttgatggttcagaatatcaaacggtaatgccgatgtatgaccgtgatttgttaaatgatctcttaaataaaaacgtcaaggtaattgctgaacctgcagaacgtcgtggattgttatcgcaaattttgatttcttggtttccgatgattatgctgattggtttctgggtgttctatatgcgtcaaatgcaaggcggtggcggtcgtggtgcaatgggctttggtaagagcaaggcaaaaatgattgcccctgatcgaatcaaaacacgccttactgatgtggcaggttgtgatgaagcaaaagaggaagtcgctgaggttgtggacttcttgcgtgacccaacaaaattccagaaattaggcggacgtattccaaaagggattttgatggtaggtcctcctggtacgggtaaaaccttattagcaaaagcgattgcaggggaagcaaatgtgccgttctttacaatggctggttcagatttcgttgaaatgtttgttggtgtaggtgcttctcgtgtgcgtgatctcttcgatcaagcgaagaaaaatgccccttgtattatctttattgatgagattgatgcggtcggtcgtaagcgtggcggtgctggttttagtggtggtcacgatgagcgtgaacagaccctaaaccaaatgcttgtagaaatggacggttttgagggtagtgaaggtattattattatcgctgcgactaaccgtgcagatgtgcttgataacgctttaactcgtccaggtcgttttgaccgccaagtgacggtagatctcccgaatgtgaaaggacgtgagcagattttgaaagttcatatgaaaaaagtaccgcttgcagcagatgtagatccgatggttgttgctcgtggtacccctggttattcaggcgctcagcttgctaaccttgtgaatgaagctgcgttatttgcagctcgtcaaaataaacgtgttgtaacaatggacgattttgagaaagctcgagataaaatcaatatggggccagaacgtcgttcaaatacaatgacggaaaaagagattatcaatacggcttatcacgaagcgggacacgtgattgtaggttatttaatgccagaacacgatccactgaataaagtgaccattgtacctcgtgggcaagcattaggttttgcacagtttttacctgagggagatcgtgttagtgaaacctttactaaattagaaagccaactttctaccttatttgcagggcgtatcgctgagggtattatttttggtgaagataaaattaccacaggagcttcatcagatattcaccgtgcgacacaaattgcaagagcaatggtaacgcaatggggcttttcaaaagagctagggccattgttctatcaaaatgaagatggaatgggggcaattaagggcgtttccgaagcgtcgcaaaaattgattgaccaagagatgcgtaaaatcattgatcgtaattatgagcgagcgaaacagacattattggataatatcgacatcttacacgcaatgaaagatgcgttattaaaatatgaaacgcttgatcgcaagcaaattgatgatttaatgaaccgcagacctgttggtgagccgtcaggttggagcaattcggggaacgatgatgaagataaagcatcaacggttcaagatgataaacctgaagaaaaatctgtggataatcaggatttaggcgatgcagttgcaagccgagaagcagaaggcaaactgtagttttctaataaaggcagagggtatcttctgcctttattattctcaaattgtattatctttcggcatagtagacaaaatcgttgctggttcagtaaaaactaagccccttaaaaaagcccttgtggttcgccgtcgtcagcttgtcgatatgcgagtagcagagctaaatcgtttgcaacaaagccacgaaacccagttggatgttgaataacttttttgtgtgtgaacacagttgctacgaaaacatttggcataatagaccaaaatgttggtgataattaaaggaaataattaaaaccagcacttttgtctactatgctaatattttaaattatccgttcatcaatacttccaactgctcttgaacttccagccattccatttcaacttcttccaactgttttttggttgccactcgctttgccaaagtgtctgtcaatttggctttattttccacgtcgtaaatttcgggggaagccagcgtttcttctagggttgttaaactagcggtgagcttctctaactctttttccaactgcgtcagctttttacgcagtggggcggcttgttggcgtaattcggcttcttggcgtttttgctctttgcggtttaccgcactgttttcattgtgacaagcggtcggattgtctgctttttttgcaaattccaactgagcatttagctcatttagccatttttgatagtcttctaaattgccgttaaattcttccactttgccgtcgtgaactaagtaaaattcattgacggtactgcgtaataaatgacggtcgtgggagacgatcaccaacgatccttcatattgtgtcagcgcttctgttaaggcttgacgcatatcgagatctaggtggttggtcggttcgtcgagtagcagtaagttcgggcgttgccatacgataagcgcaagcacaaggcgagctttttcaccgccagagaaagaattgaccgcttgtttgactttatcgccgtgaaacgcaaaaccgcccaaatagttgcgtagttcctgttcggttttttcaggggcaaggcgagctaaatgccacaaggcactttcatctgctcttaaggtgtctaattgatgttgagcgaagtaaccaagttgaacgccttttgctagttgtgtatgtcctgattgtgcttgaatttcgcctgcaagtagcttaattaaggtggatttccctgcaccgtttcgtcctaataaaccaatgcgagaacctggtacaagattaagtttgaccgattgcaacacggttctttctccatagcctgcactgactttttccattattaacaaagggttaggcagtgaaagtggttctctaaactcaaaggaaaacgggctgtcggcataagctggggcaatcagttccattttttcaagggctttgacacgactttgagcctgttttgctttggtggctttggctttaaagcggtcgataaatttttgtaaatgggcgattttttgttgctgttgctggtaagctgcattttgttgagcgagtttcgtcgctcgttggatttcaaacgcactgtaattacctgtgtaatcaaacaatttttgctgttcaatatgcagaactcggtcgataatcggatcgagaaaatctcggtcgtgggaaatgagcaataaggtgccacgatagttgcttaaccagcgttcaagccagatcacagcatctaaatctaagtggttggttggctcgtcaagtagcaacaaatcggaacgacaaattaaagcttgagccaaatttaaccgcattcgccaaccacctgaaaaggattttactggcagttgaagctgttcggtactaaaacctaagccattaagtagagttgaagctctagattgaatggtccaagcgtcaatggtatccagttgggcgtgtaaggtggcaatcaaattgccgttattctcaaggttggcttgctcaagttgagcggtgagttgggtatattctcgatcgccttggattacataatccaatgcagagatatctaatgcgggtgtttcttggtttacccacgtaatcgaccagtttttcggatagctggcatcaccgccctctgcttgtagttcattttttaataaggcaaacagtgacgatttaccacagccgtttttgccgattaagccgactttttgccctgtatgaatggtcgcatttgcttgttcaagtaagatggtttgaccacgttttaaggttaaatctgtaaaaaaaatcattgaaaattaaataagttgtttggttttagggtaaatttattgcacaataacgaagattttgttttatgaggaaaagtaaatgtttgattcgttagttgtccaattcgttgttctttgggcggtcatcgaccctattggctccattccagtttatttggcaaaaaccgttggtttatcaccagaagatcgccgtaagattgcccgtaatgcgattttaattgcagcagggattttactctttttcttggtgttaggacaatggctacttgatgcaatgcaaattccattatcggcattccaaattgctggaggcttggtattattgctttttgcattaacaatgatttttggtgaaagtaagccagatcaagagatcaaaatgaaaagtaatctacacgaattagcggtatatccgttggcagtgccgtcaattgcatcaccaggggcaatgatggcggtggtgttattgacggataatcatcgttatagttttggtgatcaggtgattaccacggggattatgttatctgtactgttaattacctatattctctttttagtggcaaaccgtattcaacattttatcggacacgcaggggcggcgattattagtcgtgtaatgggtttaattctttctgcggttgctattaataatattttgctcgggttgaaagattttattacacaggcgcagatggggtgatgtattacttacaacaaaattatgtcataaatagatgtagcaactgtgtttacacacaaaaaagttattcaattttgacccacagattctgtggataagtagcgtgtagcgtcccatttttcattgcgtctaaccaacgcattcataatggttagcagtttacgcacacacgccataatagcgactttcttcgctttgccttttgcaaccaatcgggtgtaaaaggctttaaaaacaggttcaaagcgaattgccgatagtgctgccatatataaggcattacgaacaatcgctcgaccaccatagcaaaaggattttcctttccattgaccgctttcctgtggatgcggaataacgccaacgagtgaggcaattcttttgctgcttagcttgcctaattccggcaggcttgacatcatcacggcgacgcaatttttgccaacgcctttgatgtctgagataaggtcagctttatcactaaaatgcttactttggtcgtcgatatctttatcaagttcggcgattaatttatcaagcatttcaatgtgttgttggatattgtccaactgggtttcgtggctttgttgcaaacgatttagctctgctactcgcatatccacaagctgacgacggcgaaccacaagggcttccagctgttcttcttgctcagaaagcggaacatacaactgatgctctacttcgcctttaagctcacaagtgagcccatagaaagcgagattaaccgcatcttttgcatcggttttggctctcgtttgagattttgcaaactcactggctttcagtggattagcaataaatacacgataacctgctcgagcaagggcttttgccacgggaatttctaatccacccgttgcttcaagcgttatcagagccacattaaactggcttaaatagtccaaggtatgttgaatacctttggcgttattggtttcggttttggtctttttctgatgggaaaaaccaatcacgaaattgcgtttagcaacatcaataccacaataaatcggagcgttcatcggtaacctgccttgtattcgggtttatatttcaactgttcggttttgctgatgaagttatccacgcctacgctacagaacgagttttagctctagggacacccaagctgtggataacgttatggtttatgttgctagtttactataattttaatatacaagggacacactgagtgtgtccatttaaaaaagactgcccctcacaatttggcggacacacgcagtgtgtccctactacttatattaaggaacacccaatgtctttacttccactttctcaagcactcgatacgatgctaaaccaactaccacgtccaacatcacaagagattattccgcttgatcaagcggtaaaccgaatttgtgccgaggatattttctcaccgattaacgtgccgaattttgataactctgcaatggacggctatgcggtacgaatggcagatctagaacattccactacgctacaaatcgcaggtaaagcctttgcaggtaatccgtttctagctgaaatgccacaaggaagctgtgtacgaattatgacgggggcaaaagtgccagtggaagctgatgccgtagtgatgcaggaagatacgacgctgaatgccaatggtactgtcaccattaatcgcttaccgaagaaattgggggataatatccgtcgtattggtgaagatatgaagcaaggggaattggttctcgctaaaggtagcctattaaatgtagcaagcctaccactattggcttcgctagggattgataaagttgctgtttatccacgtttgaaagtcgctattctttcaacaggtgatgaattagtgtctgttggaaatccgttacaagaaggacagatttacgacaccaaccgttttaccgtccgtcttttgctagaaaaaaagcattgtgaaattgtcgattacggtattttgcctgatgatcctagtctgtttgagaagacctttaccgaagcacaacaaaacgccgatgtgttaatcacaagtggtggtgtgtccgttggcggagcggatttcaccaaagatatcttggaaaaacttgggcaaatcggtttttggaaaattgcgatgaaaccgggtaaaccttttgcatttggtaaattggaaaaagcgtggttctttggtttaccaggcaatcctgtgtctgctttagtcactttctatcaacttgttcagcctgcattattaaaactagtgggtagatccgatcaacatattgcaaacttttcaccaaatctgaccgcttacaccgctgttccgcttaagaaagctgttggtcgccaagatttccaacggggctttttctatgcgaatgaaaatggacaacttgaagtgaaaaccatcggtacacaaggctcacatatttttagtgcgtttaatgaaagcaactgttttattgtgcttgagcaagaacgtggcaatgttgccgtaggtgagcaagtgactattcagccgtttaaccatttattgagataaacacaatcaatgccctttttttcatcaattaaatttgttttataaaataaatatttgacacttatttagaaataggtaaaatgcacaccgttttcaagaacaattcaaatgcgggaatagctcagttggtagagcacgaccttgccaaggtcggggttgcgagttcgagcctcgtttcccgctccaatatattttcttaaggcgtgttagcaaagcggttatgcactggattgcaaatccatgtagatcggttcgactccggtacacgcctccatatctaaatttataattacttataacgtattgacttttaagcaataaattatttcgctaaatgtatggcgtatgcatctatatcctagataaaagatcaccctagaggagtgacaatgctcattaatctacaacttgaacaaattcttgatgaaaaactcaacagtaaagccattgcagattatgctccaaatggcttacaggtcgaaggtcgtcgtgaaattcgcaaaattatcacaggtgtcaccgctagtttacccttaattgaacaggctattgcgaaaagagccgatgcaatccttgttcatcacggctatttttggaaaagcgaaaacccttgtattcgtggtatgaaaggaaagcggatcaaacaactgctagtcaacgacatcaatctgtttggctatcatcttccccttgatatgcacacggaattaggcaacaacgctcaacttgcaaaacatattggggtaaaaaacttacaaggtttggaagataaagctctctctattcccgtctatggtgaattagatgaagcgatttcagcacaagagttagcgaacagactagaaaaagctcttaagcgtaaaccgattttatgtgacgaatttattgcagattttccacaaaaattaattaagactgttgctatctgtaccggcggtggacaaggttatattgatttagccgcaaataaacagatcgatgcctttattagcggtgagatttcagagcaaacgacccattcggcacgagaacaaggcatttactattttgcttgcggacaccacgcaaccgaaagagatggcgtgaaagccttaggtgaatggctggcaaaagagtatggattagaggtcgaatttattgatattgataatcccgcctgataagccccataaagttactttctcttgaaacccaaaagcacttttgataggggtctgaacaaataaagttgttttcattgggggcatagcaactattttgtctactatgcctatatatttagccctttatgttatctctcttcccctcaacaaattccgtatccaggttcgatttgtgcttaacccttgcaaaatatcttggctaaggggaagcggttcgccacaaatttggctcgctaataattcgcccaataaaaaggcggtggttaaacctcgtgagccaagccctgcgactaaatagagatttggatagcagttggcagtttcaatcggctctcgacggcgaaattgattatacaagttagcatattgcgttttttgtgcttcaaaatccggcacagcccccaccatcggcacacgatctcgaaatgccgcacgaatgccgactttggcaagatttcctgaaaaatcaagctgttgcgtccattcacaagcggtcaaattctgctgaagttttgcaatgttttgctcgtgttccactaaactgaactgttcatcggcattgtctcttaaatggcttgccccgatacaatgggtctgttgagctgagctcggcgttaaatagccatcataacaaaccacacattttaacttcgacaaggcttctgtcgttgggatttggctgacttgcccacgcacaggataaaggggaataccgtggctctgagcaaaatcggttaataaatgcccgtttgccaacactaaggtttgatgggcaaaggtttgcccttgatgttgccattgccattttcctgcaagccacacaggattttccacctgatgatttaacaccaccttcaagcctcgttgttgcaataaagcaaaggcattttgcacaaactgcacaggtgaaagccaaccgccctgagcaataaaagcaccaccattttgtaccgttaagcctattttttcactcaaatcttgagctgagcagagttgataaagttcgctatcccaaccttgctccgccattttttgcagtttgtgtgcggttttatcgttataagcatacaatgccacccctgaaaaatcgtgttcaaatgtgaccgcttgagccaactgcttaaaacgttgcaatgcataatcaaagctatgcacataaaaacgcacatttcgctcatcatcgtcgctgagttgtgggtaaatcgccccctgtaaattgccagacgcattttttgctaactgttcatctttacaataaagtgtgacctgtttgccccgttctagcaaagacaaggcaacagcaaggcttgcaataccgccaccgacaatcgccacatcatcgctctctgtttggttagattgataaaaataaggaaagcgaatgtggttttccgtttgattgtcaggcttctcgccccacagcatttcacgttttttgccgaaacctttacgttttttcacctcaaaaccgaccgcttgcaatccacggcggacattgcttgatgcggtaaaagtcgcaaaagatccgcccgcttgtgttaggcggaacatttgctgataaaggctttcgttccacatttcaggatttttgtcgggcgaaaagccatctaaaaaccagcaatcaatcagattgttataatagtcgcccagttgtggcaaattctctaataggttgccaaaccaaatatcaaggtaaatttgttcaaaatggtaacgctgacaaccgctctgtctaggctgccaacaagcggttaattgtgccgaaaagtttgcaaattgcggataatgttggtgaatttgctgtaattgttcggtttttatcggaaatttttcaaaagagataaaatagagccgtttaagtggtgaagtcggatattccgctaaaaattccttaaacttttctgccactgcaaaaaaattcagtcctgttccaaagcctgtttcggcaatcacaaagaaagatcgggggtgtcgttgccatttttcccacagttgattaccctcttgaaagacatagtggctctccgccagcccatcttgcgtagaaaaataaatatcatcaaactgtgctgaaacaggggtatttgattgattaaaatttaaagaagcaaaggtaatttttgacatagcttatcccataaataaaaatggtgagccagtcacccaactcaccatttcataaaatgcaacattagaaaatgttgattgcaaacatcacgattatgcccaatgcaccaacgactgttaataatgcatagcctagtgtacccatttttatactcctgtagaaataaataactcagacattctaaggtgatttttgaaaaaagcaataaatatactattgttcctatgtttcttaagagattttcataaatggtcctccccctttttttcttctaagagctagagaattatttctatgtttagaaagcataaatattcaaaaaatatttgtcattattacttaaacaacgtattatagccatctagacggaaaaacttctaaaacaaatttcttacaagcggtaagtattgacgtatttttttgcaatatcttaccgcttgttgaatttcttagggtgcgttaatgcaccaaataacaatcatggtgcgttagttgcgtaccctacaaggaataattatggctatcaatctatttacttcagaatctgtatccgaaggtcacccagataaaatcgcagaccaaatttcagatgcagtattagatgaaatcctcaaacaagacccgaaagcacgtgtagcgtgtgaaacctatgtaaaaacaggtatggcgcttgtgggcggtgaaatcaccacttctgcttgggtggatattgaaaacttaactcgccaagtgatttgcgacatcggttatacccattcagatatgggctttgatgcacactcttgtgcggtattaaatgctatcggtaaacaatcgccagacatcaatcaaggtgtagatcgtgctaacccgttagagcaaggtgcaggcgaccaagggattatgttcggttatgcgacaaatgaaacggaagtgttaatgccagctccagtcacttacgctcaccgcttaatggaacaacaagcgaaagtgcgtaaatcaggtaaattagactggttacgtccagatgcgaaaagccaattaacctttatttacgaagataacaaaattaaaggcattgatgccgtggtgctttcaactcaacacgctgaacacgttgatcagaaaacggtgtttgaaggtgtgatggaagagatcattaagccagtattaccaagtgaatggttaagccaaaacaccaaatactttatcaacccaactggtcgtttcgtgatcggcggtccaatgggcgactgtggtttaacgggtcgtaaaattatcgttgatacctacggcggtgcagctcgtcacggtggcggggctttctcgggtaaagatccgtcaaaagtggatagatcagctgcttacgctgcacgttatgttgcgaaaaatattgtcgcagcaggtttagcagatcgttgtgaaattcagctttcttatgctattggtattgcagagccgacatcaattatggtggaaaccttcggtactggtaaagtgagtaatgaagtgttagtgcgtttagtgcgtgaacatttcgatttacgtccatacggcttaatcaaaatgttagatttaatccgtccgatttatcgtgaaactgccgcttacggacacttcggtcgtgagcatttcccttgggaaaaaacggataaagcagaagcattgaagagtgcactaagataatgaaaatattgaagtagattatactgggattagtctacttcaatcactttttaagcatttggtatgcgacatagtagacaaaagtgttggtaaaaagtgggctaaagccttataacacaaggctttaagctcactttttgaaatatgaacaaaaaactgtcctttttgccttaagaacaatatccaaaaatatcactgttccattagaactattcaacgttatattgaaaaatcccccaaagctaaattaattcctttacaacaaacctatctcaatattatttcagacgtgaccttctttggtcgtgaatttggtgtattagttttaatagataccttatctaaatcaccgctttcattagatttccgcctattatttctaactttatattgataaaagttgaaaaattcctgttattttatctttacattgttttttttttttacaatgggagggttcatttgtacatcctgaaaatgtaaataaaggtttatgatgctttattaggaaaagcagcttgtagggtgggtcttgacccaccatgtagccgtaacatattgattttattggtgggttaaaacccgccctacaatattcaatccatctaatatatggtttgtcaaggagttaacttcccccgcaagcgggggaagtgcccgagcgaaagcgagggcgatgggggcatttgtgcatcctgaaaatgtaaataaaggtttatgattttttattaggaaaagcagtagagaaggttattttattatgaataaaatatttagagttatttggagtcatgttcaacaggcttgggtggttgtatctgagttagtaaagtctcataccaaaacatccgcttacacggataaaagagctcaagtatgcacctcagattattttttagataaacagcaagataaatttaaattaagtcttttaagtctagtattactaggtatattttttagtccagtaggtttagctgcatattttgaagatggttctggagccggaaggcgtgaatcagctgacgagggtactattggtattggtcaagggagtaacgttgggcctggttctattgtcatcggtaaggaggcaaaagctgaaggtaggactagtattgcgataggttatcaagctgaagcagtcctttacgaacccaatgccgtagccgttggggcaactgcacgagcattcagtcattctgcggcttatggttatggagcacaagcacgaggaacaggctctgttgcagtcggtgaaaatgctattgcaaatgaaaatagaggcactgcattgggtaacaattcatctgttagcgttttaggtggtgttgcattgggttatttctctagagcagatacggcagggggtattgaaggagcaaaacaaactttttctgtgacagaggtagcaagcactgttgagaatggatttaaatccacagaaagtgctaataataatcggattggtgcggtttctgttggtagcaatacttttagaaaggatggtagtagcataatcaaacgccaaatcgtcaacgttgcggcaggtacacaagataccgatgcggtaaacgtggcacagcttaaatcgctcaccatgcaaataggaggcgataacggcagtagtggcaaggtaggcatttggagtggtatgctcactgtaaaaggagaaaatggtattacttcctctgctaatggcagtacgattacggttagattagaggacgaactcaaaaataaaattgataggattgccgctatgggtaagttaattgaacgtacggaagaaacaaatgatggtctaaaaattatctatacagatggtacggataacactatcaagaaaggtgaaaaaggagatcgtggcgaaactggccctgcgggtccagcgggacctaggggtgaaccgggtcctaaaggtgagcaaggcccagcaggtccgattggtccagtgggtccagcaggggctgctggagcaacaggaccacaaggacctacgggtccagtggggccaattggaccacaaggtgtacctggtcctaagggggataaaggcgaacaaggtctaagaggtgaacaaggccctgcgggtgagcgaggagaaataggccctgcgggtccaacggggcctaggggtgaacagggtcctgaaggtaaacaaggtattcaaggacctgcgggtccagtaggtccaactggagcacaaggtgcacctggtcctgcaggtccaaaaggagatgcaggagaaaaaggcgataagggtgaccctggtgaagcaggagcagtgggccctcgaggtccagcgggtgcaactggtccagcgggaccacgaggccctgcgggtgagccaggcaagcagggtcctaggggagataaaggagaaactggtcctcgtgggtccaaaacggagaggcaggagcaaaggcaaagggtgacactggtgaagcaggaccagtaggccctcaaggtcctgtgggtgcagctggtccagcgggaccagcgggagagcgaggcgagcagggtcctaggggagataaaggtgaaactggtcctgcgggtccagcaggggctaagggtgaaccaggtcctagaggtgaacaaggtattcaaggacctgcgggtccaacgggaccacaaggaccgcagggaacagcgggtattcagggacctaagggtgaccgaggagaaactggccctgcgggtgcagctggccctgcgggtccaacggggcctaggggtgaacagggtcctaaaggtgaacaaggtattcaaggacctacgggtccaacgggaccacaaggaccgcagggaacagcgggtgctcagggacctaagggtgagcgaggaaatgtgagtgtcagcggtttaccgatggcgtatgcaacggaagacggcaaatcaattatcaatatgggcggtaatttctatttggaagaacctgctaaagatggttcgattaagttaattccagtggtgaatgttaaaggtaaattctcaaccaaaacgcaaaatccagatggcagtattacgcttaagtcattagcagtaaaagtgaatttggcaaatgaaactccgatggtattaggtaatgtcgctgaaggggtagcagatacggacgctgttaatgtgaaacagttgaaatctgcgaaaactgaagtggaatctaccgatcacagtgtggtgattaaagagcgtcagggcgataatcagcaaatcgtgtatgatttggcggttgctaaaacgaaactcactgcctctaaggataaacgcaccattagtgcagcagataaaggcaaccattttgcgacaggagatgaagtcgcagtagcaattaataccgcaacagcagccgcaagaactgaggttgaagcgggtaaaaatgtgaaagtgacttcaaaaacgggggcaaatggtcagaatatttacaatgtgagcgtgtctggagatttaagcgacattacttcaattagtaatggcgatacgaaagtatctttaggtaaagataagcaaggaaatccagttgtaaatatgaatggcgccagaattaccaacgttggagatggtagtgctgagggcgatattgtgaatgttcgtcagctcaacaaagtggtttcttctgtgaatacaggatttaatcaattatcaagagatattggtcgtgttgatgttaatgcaagagcgggtattgcttctgctgtagcgatggctaatttgccacaaatttttttaccaggtaaaagtgctatttctgtttctaatgcacaatatcgcgggcaatctgcctatgctataggttattccagaatttctgataatggcaaatggcttattcgagcgtctgttggcagtaatactcagcgggatactgcgattggaggaggggtaagttttgtgtggtaatctagcacctataaattagaatttcatgctcaatgccattgttattttaacaatggcattaatatctattggatttaatttatttgtggaagaaaaggttttatgacaggacgaacaaaagtatctctgaatattatttttctttccatgcttttggatattgtgcttaaggcaaaaaggacagttttttgttcatatttcaaaaagtgggcttaaagccttgtactataaggctttagcccactttttaccaacacttttgtctactatgccttttatgctattgacttaatactttatcatttctctttttgccattactgtagctagttttagctattttgtagtacggcaatataattacaatttatatccttattgatccaaaaattctttgttaaaggattaaaatggtatccgacgatttctttacattcaaaatcttcttgagagcaccatcttagcaactccgagggtttaataaatttttcgaaattgtgagtgcctttaggaagcattttgagaacatattctgcgcctataataatcaacatgtatgctttcgctgttctattaatggttgaaataaagagtaaaccatcttcctttaataaattcttacaactctgaataatagaatgaggattgggtacatgttcaagcacctccatacaggtaataatatcaaatttttcagtatccgttatacaatgttgttttagaaagtcttctacagtaatttgctgatagcaaatatttaagtgattagattctgcatgttgtctagcaactagtagagcatctgctgccatatcaatgccagtgacaatagctcctaaaccagccattgattcgcttagaattcctcccccacatccgatatcaagtactttttttccaaatagcccatttgttttgtcattgatataggcaagccttagtggattaagtagatgaataggcttaaagtctccttgaggatcccaccaagtttttgccattttttcaaatttctccacttcttgttgatcaatattattcataaattactcacgattattttaaagtagaaaataattagattgagagaggaatagaggacattgtgatttattcaatacttacagaagtaatgactatatcatgtttagggacatcagtatgccatccataattatgtgtagagataacttttattttatctacaatatccataccatctacaacttctccaaaaacagcatacccccattcttgaactacagttttgccaaatagttcttttgttcggtagtctaagaaagcattatctacaacattaatgaaaaattgtgaggtggctgaatgaggatctgctgtacgagccatcgcaatactaccccgtttattacttaaaccgttacttgcttcatttttaattggttctctggttggtttttctatcattcctacttccatacctccaccttgaatcatgaaattatcaataacacggtggaaaatagtattattgtaaaaaccttctttacaataagactcaaaatttgcagaagtaataggtgctttctcaaaatttagcataattttgatatcaccaagattagtatgtaatataaccatttttattccttaaatatgaaatgtaagtagaaacacagtatattattataagttttgacgaaattacaaaaactttcttaatggctaacgaaattacgtatgttcgatgatattttttacccaatccaaccccgaataaaaatcctcagagagataaggtttgagtttttgcaagttttcaatgataacggttttatcagggtggcaaaggttaatatgccccaattttctgcctgctcgaacttcttttccataccaatgcagttggctaaatggaatatctaaccattcattatgatgttcgatcccaataaggttcaccattacacttggtgcaataggtttaagctctggggttggtaaatcaagtaatgcacgcaaatgcaattcaaattgactgattgaacagcctaactgcgtccaatgtccactattgtgtacgcgtggagcgagttcatttatcagcagtttttcgcctactacaaaacattccattgccattacaccaacataattgagttcgtgcataatcgcagagagcatttgttctgcttgttgttggaatatttgctgatggggtagcgtgatatccgcaacgctgtaacgcaaaatgccgttttgttgtaagttatgggttacagggtagaagtgagtttcgccattacggaaccttgcacccactaaggaaacttcgccatcaaagggaataaatttttctgcaattacgtcaccaaataaatcagaggtaatttgttcgacattatctttagtgacaatccactgcccacgaccgtcatagccccctgtacgacgtttcactaccactttttcaccaatgttttcaaagacttgctgccattgctcaggagaacttaataactgccaaggcgatgtagagagattaagctgatcgagcaatgatttttgggtaaaacggtcggcaagttgtccgaaaacggaaagattgacaaagtttttatggttgcttaataaatttgttaaaggcgtttctgcccaacgctcaatttcagcggtaatcaaactgttttctgcgagatcgaatacgggatcgtcaaaggctaatggctggacttcaatgtctaatggcatacctgcataacgtaacattctgccaagttgtccgttaccaagaacataaataggggggtagagtgtgcttttttgcatagttatccttaatagtagggacacactgcgtgtgtccgtgacaaatattgtattgagtacccaatagaaatacggacacacgcagtgtgtccctacgtttaattatttaaaaatattccgccaacggtttttccaacgtttgattcaacaaaaccatcaacttaatgcgagctttctgtccgcttaatccttgggtgaaaatgaccccttgttgtttcagttgcttaccgccaccaagataatcatacacatcttgcgtaataccgttaaaggcacgggacaccaataccactgggatatttgcatttaatagggcggaaatccctgctagacaagatggcggtaggtttcctgcccctaaagcttcaaccactacgccgtcacaacggctttgagccagttgttctagtaagaagctatccataccgacataggctttgaccagttgaatgtttgatttttccaaacgatcaatcggaaagcgttcgtaagcggtcagatgttggaaataaattgcacggtttttggtaaccaaaccacaaggcccaaatgtgggcgtttggaaggttgctacgttagtggtatgggttttggtcacaaatttggcattatgaatttcatcattcatcaccaccaaaacacctttgttttggctttcattacttaatgccaccaaaatagcactttgtaggttaattaaaccgtcagagcctaattcattgctagaacgcattgcccctgtaatggcaacgggaacattcactttcaaggctaaatcaaggaaataggctgtttcttctaaggtgtctgtgccgtgtgtaatcacgatgccatcataaccttcggctaacactgcctgttcgatccgatcttttagcaactgccaatgtgccaaggtaatatggggcgaaggaacgtgtaaaatcgcttcttgataaagttgagcagggtgattgagtttagctaacgccgttaaaagtgggttttgagctgaaggcgatactttgccatcttcgccttcgctcattgaaatagttccacctgtgtggagaattaataattttttactcatttaaattcgtgggtctggattgtctaacacagattgtgtttgttcattgcggaaagatcgtaattttagtgcaatttcagggttaaatgcacctaaaatttgtgccgctaataatcctgcatttgcagccccagctggaccaatagcaagagtgccgacaggaatgccttttggcatttgaacgatagagtaaagactatccacgccactgagcattgagctttttacaggtacacccaagacaggaacaatggttttcgctgcaatcataccaggtagatgagccgccccgccagctcctgcaataatcactttgtaacctttttgttctgcggtttcggcaaattcaaacagtttatcgggcgtacgatgagctgaaacgacttcaacgtgataaggaatgttaaattgatcgagaatttgggttgcttcggacatagttgcccaatcgctttttgaacccattacaatggcgatttcgatgttggttgtcattttgtccctttggattgagtgtaatacaagcggtgagaagtgtatcacaaaaagcaaacgtttgcctaaagaaataatctgtgatgaagctaacattttaggctttgaaaaatagacaaaataagtggtttttgctatcttgaggtcaaatttgtctataaattttcaacaatttttgataaatcaaaaaaagtctttgaaaatcaaggcgatagacgctttcctaaaagtagctctacgaatatcagtagggctatttgccgtgttttattgatctaaaacaaaaataaataacggacttttggttaaagtttcaacggttggcaaaattgtaacaattttgcaatgttttattcatcagagaaaaaaaggaaaagactatgtcagaaatgttagaacatgacgtagatccattcgaaacgcaagaatggttagactcagtaaactctttagttaaagaagagggcactgagcgtgctcaatttattattcaacaagtaatgcaacatgctcgcactcagggtgtagggcttccatcaggcgtaacaactgattatgtaaacaccattccagtgtctgaacagcctgtttatccaggaaatcaagaaattgagcgtcgtattcgttcagcagttcgctggaatgcgattgcaatggtattacgtagccagaagaaagatttggatcttggtggtcacatttcaactttccaatctgctgcaaccatgtatgaagtttgttttaaccatttcttcaaagcagccacagataaagacggcggtgacttagtttattctcaaggtcatgccgcaccaggtatctatgcacgttctttcttagaaggtcgcttaaccgcagagcggttagataatttccgtcaagaagcttttgctgatggtttatcttcatacccacacccgaaattaatgcctgaatactggcaattctctaccgtatctatgggtttagggccggttaatgcgatttatcaagcacgtttcttaaaatatttaaataaccgtggtattaaagatacatcaggtcaaaccgtttatgccttcttaggtgacggtgagatggatgaaatcgagtctaaaggtgcattaaccgttgcaggtcgtgaaaaattagataacttgattttcgttattagctgtaaccttcaacgtttagacggtccagtaaatggtaacggtaaaatcgttcaagaattagaaggtttatttacaggtgccggctgggaagtcatcaaagtattatggggcagcaactgggataaattattcgctaaagatacgtcaggtaagttagcacaattaatgatggaagtggttgatggcgactacttaactttcaaatctaaagatggtgcttatgtacgtgaacacttcttcggtcgttatcctgagactgctgcattagttgcagatatgacagatgatgaaatttggcacttacgtcgtggtgcgcacgattcagagaaaatgtatgccgcatttgagcgtgcgaaacgttcaaataaaccagtggttatcttagctcaccaagtaaaaggctataaaatccctgaagcagaaagtaaaaatacggctcaccaatctaaaaaaatgtcattagatagcttaaaaggcttccgtgactacttccatttaccattaacggacgaacaagtagaaaacttagaatatgtaactttcccagaaggttcagaagagtacaactacttacacggtcgtcgtaaagaattaaatggttatttaccagcacgtaaaccgaaatttaccgtagagtacaaagttcctgcattatcagaattccaagcattattagatgcacaaccacgtgacatttcaaccacaatggcattctctcgcgtattaaatatcttattaaaagataaaaatatcggtcaaaccatcgttcctatcattgcggacgaagctcgtacctttggtatggaaggtttattccgtcaaatcggtatttataacccacatggtcaaaactatgtgccatcagaccgtgatttagtcgcttactaccgtgaagcaacagacggtcaagtgttacaagaaggtatcaacgagttaggtgcaacggcatcttgggttgcagcagcaacttcatactccgtgaacaaccagccgatgatcccattcttcatctactactccatgttcggcttccaacgtgttggcgatatgatgtggttagcaggtgaccaattagcgcgtggctttatgatcggtggtacatcaggccgtacaactttaaacggtgaaggtttacaacacgaagatggtcatagccatatccaagcaggcgttatcccgaactgtatcacttacgatccagcatttgcctttgaagtggctgttatcgttcaagacggtatcaaccgtatgtacggtgaaaaacaagaagatgtgttctattacctcacgacattgaatgaaattaccgaacaaccagcaatgcctgcaggtgcggaagaaggtatccgtaaaggtttatataagtttgaaacggtagaaggtaagggtaaaggtcacgttcaattgttaagttctggtgcaatcatgcgccatgtacgtgaagcggcacaaatccttgctaatgaatatggtgtcactgcagatgtcttctcagcaccttcattcaacgaattaggtcgtgacggtgcggatgctgctcgttggaacttattacacccaacagaaaccccacgcgtaccttatgtttcacaagtgttagcagatttaccaacagtcgcttcaactgactatatgaaactttacgcagaacaaatccgtgcgtatgtgccaagcaagcactaccatgttttaggtacagacggtttcggtcgttcagacagccgtgcaaacttacgtgaacactttgaagtagatgcacgttatgttgttgttgctgcgttaagtcaattagcgaaagaaggcacagtagaaaccaaagtggttgctgatgccattgcgaaatttggcttaaatgtagatcgtattaatccgttatacgcataaaatccccccttgcccccctttttcaaaggggggaatgattaaggaaaaataaaaatgtcaaaacaaattcaaattccagatatcggtggtgatgaagttaccgtaaccgaagtgatggtcaaagtgggcgatactattgctgctgaccaatctattatcaatgtagaaggtgacaaagcctctatggaagtaccagcaccagaagcaggtgtggtaaaagaagttttagtgaaagtgggcgataaagtgaccacaggttcaccaatgttagttttagaagcagcaggttcagcaccagcaccacaagcggtcgcagaagctgcaccagctccagcggcagcaccgacagcgagtgcagttgttgatgtcaatgtaccagatatcggtggcgatgaagtcaacgtaactgaaattatggttaaagtaggtgataccgttgctgttgatcaatctattatcaacgtagaaggcgacaaagcctctatggaagtgccagcaccaatcgcaggtgtggtaaaagaaattttagtgaaagtcggcgataaagtttcaactggctcattaattatgaaatttgaagtcgcaggtgcagcgccagcggcggcatctgctccagccccacaagcggcggcagcgcctgcaccagttgcagtggcgccagcacaatcaggtaatgtatctggtttaagccaagaacaagtggttgcaagtgcagtttatgcccacgcaaccccagtgattcgtcgcttagcgcgtgagtttggtgtaaacttagatcgtatcaaaggtacaggtcgcaaaggtcgtatcgttaaagaagatattcaagcttatgtgaaaactgcggttcaagtatttgaagatgtgaaatcaggtaaagctccagcagcaggcaatggcgtagcgaacggtgcaggtttaggcttattaccgtggccgaaagtcgatttcagcaaatttggtgaaattgaagaagttgaattaagccgtatcaataagatctcaggtgcgaacttacatcgtaactgggtgatgattccacacgttacacactttgatcgtacggacatcacagatttagagaatttccgtaaagaacaaaacaaactggctgaaaaacaaaaattagatgtgaaaatcacgccagtggtgttcattatgaaagcggtagcgaaagcgttagaagcgtacccacgtttcaacagctcaatttctgaagacggtcaaaaacttacccttaagaaatatattaatatcggcgttgcagtagatacaccaaacggcttagttgttccagtatttaaaaatgtgaacgagaaaggcattgttgagctttctcgtgaattaatggaagtgtctaagaaagcgcgtgaaggtaaattaactgccgcagatatgcaaggcggttgtttcaccatttcaagcttaggcggtatcggtacaacccacttcacaccaatagtgaatgcccctgaagttgcaattttaggcgtatcgaaatcagaaatgatgccacaatggaacggtaaagagtttgagccacgcttaatgcttccgttatcattatctttcgaccaccgtgtaattgacggtgcggatggtgctcgtttcttaagctacattaacggtgtacttgcggacattcgtcgtttagtaatgtaattgatataagcggtcagatttgcaaaattttctgcaaaaaagaccgcttattgtagggacgcaatgcttgcgtccgcggacacacgcagtgtgtccctacataagaggaaaaattttatgagccaagaaattaaaacacaagtagtggtactcggtgcaggtccagcaggttattctgcggctttccgttgtgccgatttaggtttagaaacagtcttagttgaacgttattcaacccttggtggtgtgtgcttaaacgtaggttgtattccgtctaaagcattattacacgttgcaaaaatcattgaagaagcaaaacgcgcagagcataatggtattacatttggcgaaccaactattgatttagacaaagtgcgtgcaggtaaagaagcggtagttgcaaaactgactggcggtttagcaggtatggcaaaagcgcgtaaagtgactgttgttgaaggtcaggcaacctttgctgatccacatacgctagttgctcgtgaccgtgatggacacccaacaaccattaaattcgacaatgcgattattgcagcaggttctcgcccaattcaattaccatttatcccacaccacgatccgcgtatttgggactcaacagacgcacttaaattaaaagaaattccgaaaaaattactcattatgggtggtggtatcatcggtttagaaatgggtacggtatatcaagccttaggttcagaagtggaagtggttgaaatgttcgaccaagttattccagcagcggataaagacgttgtagcaattttcaccaaacgcattgagaagaaattcaaattaatgcttgaaactaaagtgactgcagttgaagcaaaagacgacggtatctatgtttcaatggaaggcaaagcgtgcaacgatactaaacgctatgatgcagtattagtagctatcggtcgtgtaccgaacggcaaactattagatgcaggtaaagcaggtgtgaatgttgatgatcgtggctttatcgcggtagataaacaaatgcgaactaacgtgccacacatcttcgctatcggtgacatcgtgggtcagccaatgttagcacacaaaggtgttcacgaaggtcacgttgctgcagaagtaattgcaggacaaaaacattacttcgatccaaaagtgatcccatctattgcttatactgagccagaagtagcttgggtaggtaaaactgagaaagagtgtaaacaagaaggcttaaactacgaagtggcgaagttcccttgggctgcttcaggtcgtgcgattgcgtctgaatgtgcagacggtatgacaaaattaatcttcgataaagatacacatcgtttacttggtggtgcaattgtgggtactaacggtggtgaattgttaggtgaaatcggtttagcgattgaaatgggctgtgatgcagaagatattgcattaactatccacgctcacccaactctacacgagtctgtaggtcttgcagcagaggtatttgaaggctctatcacagaccttccaaatccaaaagcgaagaaaagataattagagcgcaataaaacctctcggaatgagaggttttatactaatatgtaacctcttttttctcagaaattttcccatttccctgctaaaatatgccttgtaaatttaatgtgtttttacaggatacccaatgacagaactcaaccaccaaatcagccaaattattgccgcagagttagcggtgcgatctgaacaaatttttgcagcgatgactttacttgatgaaggaaataccattccgtttatcgctcgttatcgtaaagaagtcacaggcggattggatgatactcaacttcgttattttgaaactcgtttactctatttgcgtgagctaaacgaccgccgtcaaactattttgaaatccattgaagagcaaggcaagctcaccgatgaactgcgtgagaaaattgaacaaacgcagagtaaaacggagcttgaagatctctatttgccgtataaaccaaaacgccgtactcgtgggcaaattgcgattgaagcagggcttgagtcgttggcggatagtctttggaacgatcctagccaagtgcctgaaacagtcgctgaagcctatgtggacgcagaaaaaggtgtggcagatgtgaaatctgcacttgatggggcaagatatattttgatggaacgtttttccgaagatgcagatctgcttgcaaaattacgtcaatatctgatcgctaatgccacccttgaagccaaggtgattgacggtaaggaagaagaaggcgagaaattccgtgactattttgctcacagtgagccgttgaaaaatgtgccgtcacatcgtgccttagcgatgttccgtgggcgtaatgagggtattttgtcgctcaatttgaatgccgatcctgatgcggaagaaggtagccgttcaagttattgtgaagagattattcgtgagcatttaggcgtacaacttcgtcagcaaccggcagacagttggcgttcacaggtgattgcatggacgtggaaaatcaaagcgttgttacaccttgaaacggaattaatgggggcattgcgagaaaaagcggaagaagaagcgattgatgtgtttgcacgtaatttatcagcattattaatggccgcacctgcaggggcaagaaatacgatgggattagacccaggtttgcgtactggagtgaaagtggctgtggtcgataatacgggtaaattattggataccgccacgatttatcctcatacgggacagatggacgttgcaatggtgaccatttataagctgattaaacagcataatgtggatttaattgcgattggtaacggcacggcttcccgtgaaacggaacgctttgccaaagaagtgattaaagagatcaaagagaataaaccgcaaactgtggtggtgagtgaagctggagcatctgtttattcggcttcagaattggccgcaacagagttccctgagcttgatgtatccttgcgtggtgcagtgtcgattgctcgccgtttacaagatccgttggcggaattggtgaaaattgaacctaaggcgattggtgtagggcaatatcagcacgatgtcaatcagtcgcaactggcgcgtaaacttgatgcggtagtcgaagattgtgtaaatgcggtaggtgtggacttaaataccgcttctgcaccattgcttgcacgtgtggcaggtatgacgaaaaccttagctcaaaatattgtggcttaccgtgatgaaaacgggcgttttaattcccgttctgatctgaaaaaagtcgctcgcttaggtccaaaagcctttgagcagtgtgttggttttatgcgaattttaggcggaaagaacccgcttgatgcttcaagtgttcacccagaagcctatcctgtagtggaaaaaatcttgcaagcaaccgcttctacgttaggtgagttgatgggtaattcaacgaaaattcatagtttgaatgccaaagattttgttgatgaacagtttggtttaccaacggtaaacgatattttcaaagagcttgaaaagccaggtcgtgatcctcgtggtgagttcaaaacggctatctttatggacggcgtagaagaaatcagcgatttgaaagtcggtatgattttagaaggcactgtcactaacgtaacgaacttcggggcgtttgtggatattggcgttcatcaagacggtttagtgcatatttcaatgttgtcgaacagctttgttgaagatccgcaccaagtggtgaaaacaggtgatgtggttaaagtgaaggtgttagaagtggatgtggctcgtaaacgtattgccttaacgatgcgtttggacgataagccaacggataaacgtgatacaagcggtgagaaacgcaaagagtttggcaaatccgaccgctcgcaaaagcctgaacgtcaaagttttggcaacaatgcttttgcagatgcgttgaaggggtggaagaagtaatctacttttttggtcgggacgatgacaaagtaatttggagcgttcttaccaccatctcactttgcctttgcttctgtcaaatttttcttgtttaattcaagtatctttgacatgttatcaggttatgctattccaccttccctcgtaagagggaagggaagtgaaagaaatgctatataagttagccccctaacgctttcaatcctaccgtcatatgtaatccgtaaaacaaggttctaccgagtaattcgccgatcaggattaacgcaaatccgctgaagctgatgagtgtagtgcgttttttcagtgcgactagcaataggataataccaacaacaatcaatccaaagcgaataaaggtgatagtgagataatcaggcacgagatctaatgccgtgaagatcgccgtttttacccctgtgagatattgatagttcaagtaggtgctaattgcagtggcaatcgctccaacaattgcaataccgacaaaggctttttgtaagttttcaccgcaacgtaccgcttgtaataaaccgaccgtcaaagcagaacctgctaataatgccccaaccaccgtttgagccagtacagtaaaaaagactaagggtaattcgtgtaatccagctcccattttatacctccttcggattggctaagaaaccgccttgatagttggtcggtttggcgttgttatttaaacgtaatgcaatgttcggctgggtgtagctcgaatctggcaacggggcgacatcacgaatttcaccatattttgctttaagttcatcgatcggtaatagatctaacgcacgtaatgggcaagattcgacgcacattggttttaaaccttgttcaactcgttcaaaacagccttcgatttggtcattctgccgagttgttggtttgtatttttaaaatctctcttgcaatttccattagctcggctatgctagctcccatttgattttctatggtagattttatggcaaaccaccaacctgttaaaggctcgattgcaattattaccgcaggctttttatttgcttgtgtcaatacgcttattcctaaattaacttccgtttcaacaattgatgccagtgttattgctctggtgcaataccttgttgcttttgtctttttaatgccaagtatggcaaatatgggcttttttcagtcgttgaggacaaagcattttggtatgcactgttttcgggtgtttttgtcggcaatcggtattcagtgttggacaatggctttagcttatcccattcccatttggcaggggattgcgttgttgatgacatcgcctctatttgtgactattggctcagggctgtttttgaaagagaaggtggatacaaaacgctggattgcgaccttcttgggatttgtgggggcgatgattattttagaaccttggtcagaaaattttgagtgggtggtgttattgcctgttgctgccgcatttttctgggcgtgttattcgttgatggtgaaaaagctctctagcgaagattcgccaaccacaatggtagcctatctatttattttaattaccccatttaacttgttgatcgcattgacgaatttaagccctgaaggatttagtttgccatcatttagtgattttggtttcttaattttattgggatttttttaccgcattggcacagcttgctgtcgctaaagcctatagtttggccgatgcttcttatattcaaccttttgattttattaagttgccattgaacgttttggcaggttggcttgtctttaactgggtgccgccaggtaagctatggttaggggcagcaattattattggggcgacgatgtatattacacacgccgaagcgaaacaatctcagcagaagtagatgatggcagaacaatctcaaacagagcaatcgacagcaaaaacaacggggagacgttgggtagctcgcgtaagcatttggctgatgaaaggcatattgggattgtgctttcctctttttttgctgatgtttgctattgattttgcaacaggctattgggtgcgagatcaaatttatattgatgtacgacaattaccccaacgggaatatgcgttggttctgggaaccgcaaaatattatccgtcaggctcgcctaatctttactacaaatatcgtttagatgcagctaaagcggtatttgagcatagcaaggtcaattatttattagttagcggtgataataagaccgcttactataatgagcccaaaatgatgacccatgatttacgccaaatggggattccgtggcagcgaattagacaggattatgctggttataatacgttagattcgattattcgggcggataaagtgtttcaattacaaccctttatcatcatttctcagcagtttcattgtgaacgagccttattcattgcaaaatttcaccaaattgaagcggtctgttttacggcaaaatatccagatgctcactataaagtgcggattcgtgaattttttgcacgaagtgcgatggcggtgagtttattgttagggaaagaggcgacaaccttggaaccttcacagatgaagatgataaaaaataattaaattcctgagtataggcatggattgatttatatcacccttttctattttttccagttagtgatacaatctgaatttatttttattcactaattacattatgagtcgtcaaaagaaaagtcgtcgtcttaccgacattatgcctgcaagaaaggcagataaacccttacaacctaaagcaaaagtgtctaagggccgtaaaccaacacgttatgaattagatttagctgcgcgtgaggaaaagaaaaaacgtaaacataaaggtttgccgtcaggctctcgcactaatgaagggaatgagcaaaaacaaaaagtagagaaagaggtaaaagatccgcgtatcggtagccgtaaaaaagtgccgttaatggtggaatttattaatcaaccagaaaaagaccgtgttattaaacctgtgccaattgaagttgagaaacctcgtttaagtccagagcaagagttagaacagttagaaaataatgaatgtttaaatcagctattagacgatttagaagcaggtaaaacattgtctgcacaagatcagaaatttgttgatgaatgtttagatcgcgttcacgaattaatgactgagttagggattcaagatgaagaagacgaatcagaagatttgctgcgtcaatttgaaacgatggacattaataatttccgttaaaaatgatgatgcgattttttctaattattttggcaattttgattgtgctgtcgatggcaggttacgcaatttccttatggcttaaattaaaaaaacagaaaaaacagttaaaagaggcacaacttaatcgctatcgttcgattatagagagcattgatgttattgggcgagcaatgctggcagagcaatgcggtttttctgaaggggtattacgattgaaaccattacttgatgtattgggcaaaaaattaagtcaatatccagcgatgtgggcactgtatcaagtggttgaatcaatgccaattttagaggctcgtaaggaattaaaacgtaatgaacgaatgagacttgacctagagcgtgaatcgaaagaggccgagttatctgagcagattaagcaggaacttcatcaattattaagcgacatagagcaatttaaacaagagttaaaataacaatgacagacattatttgggatattaatcttatccaaaaatataatcaatcaggacctcgctatacctcttacccaacagcgttagagtttaacgagtcttacaatgatgatgattttaaagctgctgctgcacgttatcctaataagccactttcactttatgtgcatattccattttgccataagctctgttatttctgtgcttgtaataaaatcattacacgccaccagcataaagtcgatatttatctggattatttagaaaaagagattaaataccgtgcggatttatttaaggatagaacagtaactcaaattcactggggcggtggtacgccaacctatcttgatgaagatcaatcgttacgtttgatggcgatgttacgcaaacattttaacgtgagcgataatgcagagatcagtattgaaatggatccgcgagagattgagttagaaatgctcgagcatttgcgtgaaattgggtttaaccgtattagtatggggatccaagatttcaataaagaggttcagaagctggttaatcgtgagcaagacgaggaatttatttttgcattaatgaaacgtgcaagagagctaggttttacctcaacgaatattgatttgatctacggtttaccgaaacaaacggtagaaagttttatgtttaccttagaacgtgtgattcagttaaatcctgatcgaatgagcgtgtttaactatgcccatttaccaagtcgttttgcagcacaaatcaaaattaaagatgaaatgttgccagcccctgaaacgaagctcgaaattttacagaaaacgattgaaactttaggtaacgcaggttataaatttatcggtatggatcactttgcaaagcctaatgatgaattggcgagtgctcaggcaaaaggggaattacatcgtaatttccaaggctatactacccaagaagatgcggatttgttaggcttaggggtatcggcaattagtttactgggggatagctacgctcaaaaccataaagagctgaaacagtattataccgaggtggaaatgcgtggtattgcattacacaaaggtttgagtatgactaaagatgactgtttacgccgtgatgtgatcaaagccctaatttgtaattttaagctagaatatgaccgctttgagcaagattatcagattgattttaatcagtactttgcagaggatttatcactattagcaccgttagcaaaagatggtttgctagagattggtgaaaaggggattgttgtttcgcctcgagggcgtttattgatcagaaatatctgtatgtgctttgatatttattcaagacagcaagctaaaagacaacaattttcaagaatcatttaatgataatgtttgcaaataaggcggttacataggcttatttgtttacaaatgtgagtagaatcaaattatgaaaccatatcgttatagtttactttctattgctattgttgcagcttgctgtagtcaatatgtaatagcagatttgagaatgcaatgtttacaaggaattcctacttttcagggggatattatacaaggtgatcagactcttctacctgtgtatattgagtcagatcgtatggaaatgaattatccttctgaggcaacatattttggtgaagttagtgttaagcaaggtaatcgttctcttattgcagaaaaagctaaggtagaacagaataacgaacagatgcgttttgcttatttaatcggtaaattcgattatcgggataatttcattaatgcgataggtaataatgcaaagattaatttgaacaactatgatgctcagttaggcggggtcgattaccatttagttggtcgacaaggaagaggtattgctgatgaagtcatgatagctgaacaagcccgtcgaatgaaaaatgcaacttttacagcttgtttacctcatgataactcctgggctattgaagctaatgaaatggttcagcatgttgaagaggaatatgctgaattatggcatgcgcgttttaaagtattgggtatacctattttctattctccttatttgcaatttccaataggggatcgtcgtcgttctggtttattggctccgagtgttggtcattcaagacgagatggttatatatatgcacagccaatatattggaatattgcttctaacatggatatgacatttgtaccaacatactattcaaaacgtggttggcagattgcacctgaactgcgttatttaacttatttaggagaaggtaaaatagccggtgaatatttaggtaaggatcgacttgaaaattgggcaaatcatagtaaatctcgttatatgctattttggcaacatgatatgagtttttttaataattggagattagctgttgattatacaagagttagtgatagtcggtacttttctgattttaattctatgtacgggaatagtactgatggttatgcggtacagcagtttaaattagggtactatcattcagattataatttttctatttcaggaaaaaaatttcagtcattttacgtaaaaaatgatagcactacctatcatgtgttaccaaagattgagcttaattactataaaaataatttagtttctgatgttgatttcaagatgtttgggcagatggcgcattttgttaatcaaaataaactcatgccatcagcgtggcgttttcatttagaacctagtttaaatgttccttttgttaaccagttaggaagtttagctttagaaactaagctatataccacctattatttacagaaactggggcaagcacaagcaataccgatagagtcacatatactccgggtattacctcaatttaagttggattttaaaactgtcttggaaaaggaaagacctttgtttaatgggttttcacaagtttttgagccaacaatacaatatttatatcgtccatataaaaatcaaggaaatattggagttagaaatcctaaatatttaggtttaggttatgactccgttttattgcagcaggattattactctttatttaatgaacgcagttatagtgggttggaccgcattgcctctgcgaatcaggttacgttaggcggtactacacgattttttagcgacaaaacaggaaaagaagtatttaactttagtgcaggacagattcaatatttatctccttcaagagttgatagtgagtcgttaaatagcgatacaaaacactcatcttcttggtcattagaatctaactggaaatttcattcaaactggaattggcatggaagttatcaatatgatacacgtctaaacgaaacatcgttagcaaatgtttcattacaatttaagcctaaaaataataacgtgattcagcttaattatcgttatgcaagcaaaaactatatagatcaaaatttaagtgataatcgctatgggcaggatattaagcaagttggaggtattatagcttggtcattgagcaataatgtatcaatagtaatgagccactatcaagatattgctttaaaaaaactggttgagagtcaattgggtttaaattatagcacttgttgttggagtgcaaatttttatacttctagacatttgatttcaactccgatggggaaaagcgatacaataaatgatttctactatgataatcgttttggtattaattttgaagttagatttaatggaaattatgaacataccgtgcctaagatgcttaaaaaaggaattcttccttatattgaagcgtttaatatcaattaaattttttagcctctttgatgaattaaaagaatcaatcaactaagattggttcttatgagtagtggcgaatattgatgaggtaataatgaaaaatccaaagcaatatgcccagcgttatgtcaattgggtattacgtttaggtaaagggaaatccgcattattgggtttgattattttagcggtgtttgcaatttttacacaaagcctattgagctggatatttactgggagcataaatactagcgatatttttcgttctattatttttggtctaacatcggctcctttcgtgatttatttttttaatctaattttagaaaaacttgaacgttctcgtattcgtttggagcaatcgttgaatgatctttccttgttacgtgaacaagatgctcgtttaaatgtagagttagaacaacaggctgaatttttacgttctttcttcgatgcttctccagatcttgttttttatcgtaatcaacatggggaatttctcggatgtaatagggcaatggaagttttaacgggacgttcagaaaaagagttacttcatcttactccaaaagatatttatcctaaagaaaccgctaaattaattctagatacagatagagatactctaattagtaatactggagttacttacgaacagtggattcgccattctaacaataaactttcctgctttgaaattcgtaaggtgccttactatgatagagtaaatgaatgtcactgtattatggggtttggaagagatattactgagcgtaaaagatatcaagaaatgattgaaaaaaatagccgagataagtcaacgttgatggccacaatcagtcatgagttacgaacacctctaaatggtatcattgggttaagccgcattttattagaaggtgaattatctgcacaacaaagagagtatttaaaaacaattaatattagtgctgtatcgttagggcatattttcagtgatattattgatttggaaaaaattgatagtcgccgcattgagttatttcgtagtgaagtagaattctcacaattaatcagtaacatcagccattttgctaatttaatggcagagcagaaaaaaattaaatttacaattcagtacgatgataatttacctgattttgtctgtgtagataatgctagacttagtcaaattttatggaatctagtgaataatgccgtcaaatttaccccttctgggggagagatttcactaaaagtggaacgtcgagatcatgatcattatgcttttattttgaaagattcagggattggcataaagaaaagtgagcagcgtaaaatttttgcaatgttttatcaatcagaaaattcccagggtaagaaagctcagggaagtggtattggtttagcaatatcgaaacgtatagctcgcttaatgggcggagatttaactgttgagagtgaattaaatcaaggttctgtttttactcttatcattcaagctgatgaagcaaatcattataaagaagtagcaataaatacacatgcactaaaagtattactggtagaggatattgaagtcaatattgtcgtcgcaaaagctatgttggataagtttgggtgtaatgttgatgttgcaatgacaggagcagaagcatttgagttatttgataaaaatagttatgacttaattttattagatattcagttgcctgatactacgggagtagaaatagcacaaaaattacgtcagaggtatgaggacggagatgttgattatctgcctttattaattgctttgacagcaaatattatgcaaaccaaagctgaatatcagcaacaaggaatggatgatgttttacgtaaaccactatcattagaggctttatctgaatgcttaaatagatattttgatgaagggtttttagaggaatcctcggacgatgtagtcttgtcagaaccgataaataaaatgtcttttgatcctaaaatgcttcaagagttggttgaggtaatgggtaaaaagaatgtgttatcaacattagatctctttgccaacttaatgcctaattatttagagaatttaaatgattatttacaggattggcaagagactggtgatatacagaaacgtaaatgtgttgcggatgaagcgcataaaatcaagggggcattggcatctgtgggcttagttcatttacaacaaattgcgcaattagctcaaagtgataatggaaatgagtgggaaaataatctcgtttcttgggttgaattattgaaagattggagggaagattggaatgaagcggttagatgggttagcaaaatagataatgtggaaaaattataggaatttctgcttttaatacaattaatatgtaatatcaagcactggttagatttccattgcaaaaataaatacatattcactattaaatgaattgtttccataaacaggtaattgcgttagaataagactaattagtcgtattctatttataaagttaatgaaacctgaaaacaaagcaaattttcaacgcattgtccgtgctacaggctattcaatgaaaggtctgaaaagtgcatatattcacgaagccgcatttcgtcaagaagtgtggctttctttttttctcattcctgtcggtttatatttaggcgatggggcaatcgaaaaaattctattagtcggttcggtgttgcttgtgttagtggctgagctactcaatagtgctgtagagtctgtggtggatcgtatcgggtctgaatatcatgaattatcaggtcgtgcgaaagatattggctctgccgctgtttttgttgcaatgcttatcacagggcttacttggttactgattttatgtttgtaatccagtgagtttttcacttatttctgtcaaaactaaaggagcttatatgaaatttaataaaactccacttgctttggctcttatgggagctactactgcgatggcgtatgaagcggataaaacctataggtttaccgtattacacgttaatgatacccacggtcatttctggaaaaatgataagggtgaatatggatttgctgctcaaaaaaccttgatcgacaaaatccgtaaggaagtggctgaaaaaggcggtgaggttgttttacttcacgcaggtgacttcaatacgggcgtacctgagtctgatatgcaaaatgcaagaccagatattgaaggcttgaatatgcttggttttgatgtggcagtgttgggtaatcacgagtttgacttccctctgcaagtgcttgatatgcaagaaaaatgggctaaattcccgttcatttctgcaaacgttatcaacaaaaaaacaaacaaacaccttgtaaaaccttatgttacgcttaataaaggtggcttgaaatttgcggtaatcggtttaactacagaagatacggcaaaacttggtaaccctgatgtgactgaaaatgtggtgtttaatgatccaattaaaaccgcaaaagaaacccttgcccaagtgaagaaaaccgaaaaaccagatgtaagtatcgcgcttactcatatgggctactactttgatgaacaacacggtatgaatgctccaggcgatgtatctcttgctcgtggcttggataaaggggcttttgacttgattatcggcggacatactcacgataccgtttgtgttgatgagaaaggcgtatttaaactcaaatatacaccgggtgaagagtgtaaacctgatttccaaaacggcacttggatcgttcaagcaggtgaatggggtaaattcttgggtcgtgctgattttgaatttaaaaatggtgaaacgaaactagtcaaatatgagcttatccctgtcaatcttaaacaaaaaattaagttagctgacggtaagagcgagtataaactgtatcaagaagagatccctgaagataaagctgtatttgagcacttgaaaaaatatcaagatgaaggcgataaattattgggtgtgaaagtcggtgaagtgaaaggtggtatccttgagggtgatcgtaaagttatccgtttccaccaaacgaatttaggtcgcttaattgctcaatcacaaatggaacgtgtgaaagccgatattggtattatgaactctggcgctatccgtgcttcaatcaatgaaggtgaggtcacttacaaaaatctgcttactgttcagccgttcggtaatatgattgcaaccgttgatttaacaggtaaagagttaattgattacctcaatgttgttgccctaaaagaagtcgatatgggtgcgtatccacaatttgcaggcgtgtctatggttgttgatcgtactgcaaaacaggtgtctgatgtgaaagtcggtggtaaaccgcttgatctcaataaaacttacaaagtgtctgtgcctgattactgtgcagcaggtggtgatggttatccaatcctgaaaaaacacccaagctatgtgaatacaggctttattgatgctgaaatgttgaaaaaatactttgaagaaaattcaccaattgatgcctcaaaatatgatccaaaagatgatgtgatctttaaataaaaatttacaaaacaatactatgtaataatctgcgacaaagttatttttaactttgtcgcttttttaatgtaataattactgtaaagcaatgcaattaccgtagtgaattatgatgaaaaagcctttgctgacaaagagccgagaaatatcgtagatgtgcttgcaaaaacagatgcttcagtaatgaatttcggtggtgaatccgctaccttacagggggtttatgttcgtggcttacagcttggtgcacgccaatttagtgtaaatggtttagcagggctttattctgcatacaatacaccgacaacagcggttggatctgctcaattaattaaaggtgcttcgacagcaacggttggtatggaccccctgaaggttctgctggtgcatcaatcaacatcgaaacgaagcgtgcaacggacgaagatattaacaaagtcggttttgcttggtttagtaacaatcgcttacaatagtcgttcgatttaggtcgtcgttttggtgcgaataaagagtggggcattcgtgtaagtggcaaataccgtgatggtgatacggctcgtcacgattacgatgagcgagcgaaagaaattgcgattggagcagattatcgtggtgagaaattacgagttggcgtagattatatgcaaagtaagcgtaaaacagacggtggcagagctcgtatccaagatatgcaaaacttaaaatttgcaatgccagttgcgccaaatggaaaaattaatcttaacccagattggcttggacagacgaccgaagataaaaccgcaatggcaacctttgagtatgatctgccttacaatatgatggtttcaggtggctttggacatatgaaatctcgttactcaggtgcatttggacaaattaactcaattaagcaaaatggtgattttagagtatcgggtattcgtggaatggactttgtttctcgtacaacaagcgggaacttaaaattacaaggtgaaactgaaacaggaccgattcttcacaattggagtctagcgtttgattcagtagaacgtcagcgtgaccacgatcaaagcagtaaaactaacggtgcaatttccgcaggatctatttattcaccaaagcgacagagtttatcggcggtacgttagacgtagtgcatggggtgattaatgcggtcgtttccaccattgaatttaccattatcctgtgggggctatcggggatcttggcgatctttggtgtagaaatcccgaaaggtgtggtgttctttatctatatttttattattgttgctaccttactttctgtgattatcggtcgcccactgattgcattgaatttcaataaagagaagctacaaggggattaccgttactctctgatccgtgtgcgagataacgccgaaagtatcgccttttattcgggcgaagccaaagaacaccgaaatttacaggcaaaattttctgcggtattgcgagaagccatttgttatccacatattgaagcaacggacgagcaaattaaacaggcaatggaaaaatgctgtttggataaatatctccacgcacttgatgatgataacgactggcaacttaccctttccccaggtgaattgcaacgggttgcctttgtgcgaattttactcagtaagccagagttgattttccttgatgaaacaacttccgcccttgatgaaccgacggagtctattctttaccgtaccattcggaaagtgctgccaaacagcaccattatcagtgtcggacaccgttgcaccttgtacccttatcataacaagcggattaatattactgcgggttgttgtggggtggaagagtgttgtatgaataggtagaaaacagaggggagagccttgtttcagtacgatgataaagttatttaggctgttcttacctctcactctgactttgtttctgccaaatctcccccagcccctctttgctaaagagggggtaggggagatttggcagaatagacaacgaagtgaggaaataatgatatagaaggtaaataaaagcagatttaggtttatcatcaacttgaccattataaatttctcacaaattccgaaataacaggcgatttttcagaaaatctctgtataatagccaagttttatttcttcgcattctaagaggcggctatcaaaagtaatttgatgtgtgagattacttttgctagtcgcaatttttaggaaataaaacaacaacaaatccaaaaattcataaggaacattcaaatgactccaatcgttaaacaatttaaatacggtcagcataccgtaactttagaaacaggggctattgctcgtcaagcaacagcagcagtaatggcaagtatggacgatacgacggtttttgttaccgttgtggcaaaaaaagaggtgaatgaaggccaagacttcttcccattaactgtagattatcaagagcgtacttacgcggcaggtcgtattccgggtggtttcttcaaacgtgaaggtcgtccatctgaaggcgaaaccttaatcgcgcgtttaattgaccgtccagttcgtccacttttccctgaaggtttcttcaacgaaattcaagtgattgcaacagtggtttctgttaatccacaaatcagcccagatttagtggcgatgatcggtgcttcagcagcattatctctatctggcgtgcctttcaacggtccaatcggtgcggctcgtgttggtttcattgataaccaatttgtgcttaacccaactacatcagaacaacgtttaagccgtttagatttagtagtggctggtacagacaaagcggtattaatggttgaatctgaagcagatattttaactgaagaacagatgttagcggcagtggtattcggtcacgagcaacaacaagttgtgattgaaaacatcaaagaatttgtgaaagaagcaggcaaaccacgttgggactgggttgctccagagccaaatacggatttaatcaataaagttaaagcattagcagaagctcgtctgggcgatgcttaccgtattactgaaaaacaagcacgttatgaacaaattgacgcaatcaaagctgatgctatcgctcaattaaccgcagaagatgaaaccatttcaagcggcaagattgtagatattattaccgcattagaaagccaaatcgtgcgtagccgtattatcgcaggcgaaccgcgtattgacggtcgtacagtggataccgtgcgtgcattagatatttgcactggcgttttaccacgtactcacggttcagcattgtttacccgtggtgaaacacaggcgttagcagttgcgacattagggacagagcgtgatgcacaaattattgacgaattaacaggcgaaaaatcagatcgcttcttattccactacaacttccctccatattcagtaggtgaaacaggtcgtatcggttcgccgaaacgtcgtgaaatcggtcacggtcgtttagcgaaacgtggcgtgttagcagtaatgccaacggcagaagagttcccatatgttgtgcgtgtggtttctgaaattaccgagtcaaacggttcttcatcaatggcttctgtatgtggtgcttctcttgcgttaatggacgcaggtgtaccaatcaaagcggctgttgctggtatcgcaatgggcttagtgaaagaagaagagaaatttgtggtactttcagacattttaggtgatgaagaccacttaggtgatatggactttaaagtagcaggtactcgtgaaggtgtaactgcattacaaatggacatcaaaattgaagggatcacccctgaaattatgcgtatcgcattaaatcaagcaaaaggtgcgcgtatgtacattttaggcgtaatggaacaagcgatccctgcaccacgttcagaaatttctgacttcgcacctcgtattcatacaatgaagatcgatccgaagaaaatcaaagatgtgatcggtaaaggtggtgcgacaattcgtgcattaaccgaagaaaccggcacatcaatcgacattgatgatgacggaacagtgaaaattgcggcaacagacaacaacgccgcgaaacgtgttatggaacgtatcgaagagatcgttgcagaagtcgaagtgaatgcaatctacaaaggtaaagtaactcgtgtggttgatttcggtgcattcgtgtctatccttggcggtaaagaaggtttagtgcatatttctcaaatcacggaagctcgtgtagaacgtgttgcggattacttatctgttggtcaagaagttcaggtgaaagtggtagaaatcgatcgtcaaggtcgtatccgcttaactatgaaagatctgaatggtgatgcaactgcaacagaaattgttgaagaaattcaagaattagcagaataatcacatctatctcttcctcgaacaggggaagggatcttcattttaagaatgataaatacctaaggttttattaatgccacaacgttttaagttgtttaatcttcgtttttgctggttagttttggtaatgatttttttgacaggctgtgtgaacagagtgtcagatatgattgccccgacaaaattacctctctcggaactcaatcctcagttgcgttttgaacaggaagtaatgcttgttcgtttaacgcaagtgttgcaagaagcgaaattaagccaagctgaacgtgccgaattacattttgaaagaggcgttatttacgacagtttaggactttggtcgttggctcgttatgattttacgcaagcggttgaatatgcccctaaaatggcagctgcctataattatttaggtttatatttgttgcttgaagatgattatgacagctctatagatgcttttaatgccgtgttagaactcgatccaaattatgactatacccgtttaaatcgtggtttagcattttattatagcggtcgttattctgaggcagaacgtgatttattgcgtttctataaagcagataggtccgatccttaccgtgtattatggttatatttcaatgagttagaattaaacccaagtgatgcaaaagcaaatttgttaaaacgtgccaagcatttgtcaaaagacttttgggggacacatttagtgtcttacttgctaggggattttactcttgaacaacttcgtttaaaaatgattgctcaagctgaaccgaatacggtagcttatgcagaaattttaaccgaaacatatttttatcttgcaaaacaaacactcaaaatgaatcagcttgaagaggctaaaagccttttccgtctagctagtgcaaatcaagtatataactttgttgagtatcgttttgcgttgtttgaattagctcaattacatcaaagagcgaaacaaacagatcccgttgttgttgggaaaaattaggacgatttaagcggtaggtttcgcaaaattttttgcaaatcaaaccgcttacactgtatgacaagttatataaagcattggtttactttctatttatttttcttacctaaaagctcaacaatgtagtttttatctcctgtgtaatacttccccctttgaaaaagggggattgagggggatttttagatttaatttttcatttgcgtgaattaaatcccccctaactcccctttttcaaaggggggaacaggttctttatttttggaattttatgactgaaacaactttaactttcgccgatttaggcttaccacaatctatccttaattctgtaaatgaaatgggttttgtaaccccatcaccgatccagcaagcctgtatcccacaccttttaaatggtcgtgatgtgttaggtatggcacaaacaggaagtggtaaaacagcggcattctctttacctttattagcgcaaatcgatccagaacagcgtcacccacaaatgttggtgatggcaccaacccgtgaattagcaatccaagtggcagatgcttgtgagcagttcagcaagaatatgaaaggtattcacacggtcacgatttatggtggtcagcgttatgatattcaaatccgtgctttaaaaaatggtgcgcaagttgtggtaggaacgccagggcgtattcttgaccatattcgccgtggtaccttagatctttctatgctaaaagcgattgtattagatgaagcagacgaaatgttgcgtatgggctttatcgaagatgtcgaaacggttatggcggaactgcctgaagatcaccaaacggcacttttctctgccacaatgccagagccaattcgccgtattaccaaacgttttatgaaagatccgcaagaggttaaaattcaggcaacccaacgttctgcaccagatattgcacaaagttactggttagtgaacggcttccgtaaaaatgatgcgttattgcgtttcttagaagtagaagagtttgatgctgcgattatctttactcgtaccaaaactggcaccattgatattgcagaactctgtgagcgtaacggctaccgtgctgctgcattaaacggcgatatgacccaacaagcacgtgaacaagcgttggaaaaacttaaatcaggtcgtttagatgtgattgtagcgacagatgttgccgcgcgtggtatcgacattgagcgtatcagtttggtagtaaactacgacattccacttgacgcagagtcttatgttcaccgtatcggtcgtacaggtcgtgcagggcgttcaggtcgtgcgttattatttgtagaaccgcgtgagcgtcgtttattgaaaaacattgaacatttaatcaaaaagccgattgatgaagtgccagtaccaaatcacgaaattttaatggaaaaacgtcgtgagaaatttaaagcacgcatttcattacaattagaacatcacgatttagagctttatcgtgaattattagaagatctattcacggcagaccaagatcacgaagaattagctgcagcaatgatgatgttgttgcaagaaaaacaaaaacttattcttccgccagatcctgaaattcgcccttctcgtgctgagcgtggaaaaggacgtgaaaatccacgttctgcagaacgtcgtggtggcggtcgtgaacatcgtgataataacggcgttgcgatggatctttatcgtatcgaacttggtcgtgaagatggtgttgaagtgcgtcacattgttggagcgattgccaacgaaggcgatattaacagccgttatatcggacatatcaagttacacgataaatactcaaccattgaattaccacagggtatgccgaaacatttagtgcaacatttcgcacagaaagcacgagtgttaagcaaaccaatgcaaatgtctttcttaggtcctgtgggcagtgcaactaatgctaacccttatgaagataagagcggacgtggtaaaggtcgtggcagaaatggtcgccgtgaagaacgtggctttaaagatcgcaaagaaggcggatttaaagaaaaacgttttaacgagcgtggtcgtcgataatctgatgcgtagggacacactgcgtgtgtccgctacttgtacctaaattgtgatttatggacacacgcagtgtgtccctaccattttaattaaattatgtttatccaacccacccaatcccattgcgatttaaccttaaccgaacaggatttttactttatgcaatacgccttatcccttgctgataaagccgaagcagaaggggaaattcccgttggggcagtgttggtcgataaaacaggcaatattatcggagaggggtggaaccgtgcaattattctctctgatccaaccgctcacgcagaaattcaggcaatccgaatggcaggacagcaattacaaaactatcgcctattagatacaaccctttatgtgaccctagagccttgtacaatgtgtgctggagcgattttacatagccgtattgggcggttggtatttggagcctcggattacaaaacaggggcgctaggctctcgctttcatctttttgaagactataaaatgaaccattttctgcaaattcgaggtggcgtgatggctaatgagtgtagccaaaaaatcagtgctttttttagaaagagaagggaagagcagaaaaatcagcatgttaactacaactcatcaaaatagctctgtccccacgtcttttcagctaattgcaacaaattcgcaaaatcttgataagaaggaaacgcttggtcagcgatattatgttgctcactgatcaacttttgacgaagttcttcataccattgcaacaaccccaagggtagcggcgatttcgcccgtcgcccaagccaaaataacccttgaaatgggatactcaatgcaaacaacgccgttaaggtcgcattggctagaatggattgttcaggatcgtggaaaaagtattgccaaactaacgcaaaacaagcaaaagcaggcataaaatgtgacgaaaatttaactaagcggattaaacgataatcgggcataaacagtccgagtttcttctgatttgggaaggtattgaggtaacgctgtcctgcttgcaaggtgtgatacataatttgcctttatcgttaaataattcaagttacattctactcatctctacaaaatctacaatagcgaattatcacaacagttgctatactttccatatagttacgcagaatgatgtagcaaatgctataccatactgtattatgttgaattttcaccacattaatttaaggaagtcaaatgccgattaaatttccaagtttgttacaagatagttggaattttatccgtaatcaagggagctttacgcttacgggtaccgcattattaattttattacaattatccaccatttttctctttcctagagtagaaatacaggcaggaaatacatcaaatcaagagatgttaactttacttacatcacaacttgccccaaccattatttctgctttgattagtgtatttatcaatatcttattgattttaaacattaaatctatcaatagtggcacttatcaacatttcagccaaaatatcggggcaactctcaaagcctttttcccggtgattttactgacgatttttatggtaatgccactttcaatcggtatctcatttggtggcaccgtcgggcaacaaggcaatcttgctataatgatcttactgcttatggcaacaggtatctatttgtttatcaaacttagccttgtcgtctatgtctatttacttgaagccccacaaggcattatgcaaaccttacgttttacttggggattaagtcgaggcagaatggtgccgcttttcctattttgtatcttaagttatttctttcctagcttgttaggttcattaatcggtagaattggcggagatgtcgggattattctttcacaagtggtcggagcctttatcagcttatttgttgttgtatttggtttccgtttctatcaagtgtatcgccaataggattgacaatgaaacagttacttgaatttattccactgatcctcttttttgtcgtctataaaacctatggcgtacaagaagcagcattagtgctagttgccgctaccgtggttcaatttatcgctttacagttgctttataaaaaaatcgaaaaaaatcaatggattatgggaatagcggtcgttttcttcggcttacttaccgcttactttaacgacctggcattccttaaatggaaagtcaccattgtcaatgccatttttgcggtagcgttactcgttagccaatacgtattcaaaaagcctcttatccaaatgttacttggcaaagaactcaaactgccacaaaacgtatgggaaaagctcaatttaggttgggcaggctttttcatcttctgtatgatcatcaacatcatcatcagtgagttcttctctgacgatgtttgggcaaatttcaaggtgttcggtttaacaggattaagcctcattgccgttatcggcacaggcttatatctctacccccacctaaaacaactagaacaaaaagaggaaaataatggaaacacaaactaaacgccagcctgaaggcacattaattttacgcaccctcgcaatgccatcagacaccaacgccaacggcgatatttttggtggttggataatgtcacaaatggatatgggcggtgcgattttagcaaaagagctagttaaaggcagagtagtgactgtttcagtagataaaatgtcgttcttactgcctgtatcagtcggtgatgtggtttgctgttacggcaaatgcaccaaagtcggacgcacctcacttcaaatcaaagtcgaagtatggatcaaaaaagtgtatgaaggaatgagagaacgccactgtgtcaccgaagcactctttacctttgttgctgtagatagcaacggcaaacctcgtgttatcccacgagaaaacaacccagatcttgaccaagccttagctttaattgaaccttaatggaggacattatgtactatgtaatttttgctcaagacataccaaacacccttgaaaaacgtttagccgtgcgtggaaaacacctcgaacgtctaaaacaacttcaagccgaagatcgccttttaaccgcaggtccaaacccagcgattgatgatgaaaacccaggtgaagcaggttttacaggttcaactgttattgcaaaattcaattcacttgaagaagcaaaacagtgggcaagccaagatccttatgtggaagcaggggtttatggcgaagtgattgtgaagccgtttaaaaaggtgttttagtttaattaatatagattcaattcagataagaaaccaagtaatgttattatttgggtgcttatctaattgagagatagtcgataaacagttgctacggcacatcaaaatgatgcaggtttccgttgagagtaaaattagcctgccatcatctggctacaaaactcaacttattcatttgcccctatcccctgataccaaggactaaagcggtttcttgcggtggaaatgttgtaattatctgaataaaaatcgacttggatcattcccacttgagcagtattaagccacttcacttgatactgctcaagccgttgaataacttgactatttggcattttccacgggttccaacgcccagccgaaataatcgcccaagtgggttggatgtgagctaacaaagtttggctggtactggttttactgccgtggtgtcctacttgaagaaaatcgatcttaccgatctggcttgcatattgtcgttcttccgcaatcccactatccccagtaagaagcaatctatattgccctatcgacactcgtaatacacaagagtgttcatttttagctcgctcgctcagttgtaaaggataaatcgcttcaaggtgcattgtgctgaactgccactgattgcctgctatacaaggctcggcgacttggttactataatgatttttacccgaaaggatcaaccgtgcatttgggtaggcttgtagtaatggcaaaacgcccccagcgtgatcgttatcatcgtggctaacaaaaatagcttcgactactatcccttcacggcgtaaatagggcagtatttccaattccgccattgtgccaccttgccacgcaacgcctgtatcatagagaatagctttctgtttaccttggtgttgataaatcaatcccattgccaacccttgccccacatcgaaattcacccattttacaagcggtggtttaagtgtatcttttacaaaatgaaatccgatccacaatgctaaaggcaatgccactgttgctaacccataatagagagaaaaacgttgctgaaaaacaccatataatcctattaaaatcaataaattaaggcatattaatccccattgttgagcgacacttaaatagagccaatgatgggaaaatggctcaatccaatcaatcccccactctgcaagttgatggcaaagccaccaagtttgaaataggttatctgttaataaactaaataaaatcaatgggataagaataaaactataaagtggaacaatgatcaaattggctaataaagcgaaaggtgatgtgccatcaaaaaaactgagttgaataggcgagaacactagccaaatgcctaactgcagatgaaacaactctaacagcaatttcatcactcgattttgcatatttttgacaaaatcaaaccgcttgagtggaaaagcctgataccaaataattaggctagcaacagccaaaacagagagccaaaagctatcggaaagtaacgtcagcggatcaaagacgactaatagcaccacaccacgaagccataactgccaaggcgtataatgacgacgagcatattgcaccagcaaaaccaatgaaatcgccaccattgcccgtaccgttggaatttggaagcctgccaaaaaactatatcccaacgccacacaccaccctactccccttgcaaaatacaaggacaaccccaccgctttcagataacgaaatcgcaataataaccactgcccagctttcaccgcccaaaaggctaacagataaaccagaacaatatgcgagcctgaaatggcaatcaaatgagcagtggttgtttgctgaaagatctcccaatggctttgacttaaccaagcccgttcaccaaaagcaagagcaagcagtaacccttgcgttgcaaaaggggcggtctgttctcgcatacgatcaagccaaattgcacgcaagccttgttgttcgttcacttttactgcttttttgaccgtagctgttgctgagatatgttgagccacataccatttttgtcgatcaaaattgccatcatttaagcgagcggacaaaggcttcaatatcagttccgcgttataacttgcttccagtatcaatggctcatctgcttgccaattgacataaacatagtccccattagcacgctctacaacggcagtttgatattcttgctgttttaaaatttgcttcactaacacccgctcttgcaccttaacagcggtctgttcctgatgtttttttgcaagttgcataatctgggcgtaactcaccgctaacacaccacccaacagcaagatccccaatttcccacgccatactccccataatgcaagggcaagagaaaataccaccacatagccaagccacgaagcaggcagaacaatcaacggcaataaaccgaaaaagagcattaaacagacacgatcaatagacatcatcaacatacctaatcaaagagattacagtatgccaatgatgaaaagagagaaaagtagaaaaataatgtttttcgacagggatcacaaaaataaatattggtatatcaaattgtttgtagttatgatttttaacacgatatctttttaatttagattaaaaagttagataagaaatgcaaataacttgacaaatttttcaaagaattttcaaaattgagaagtagttcaaattttaactacaaggagtgtggtagtattagctcgaaagctgagatggctcagttattactaaacacaacaaggagtatattatgtataaacatattttagttgccgtagatctctctgaggaaagccttatattattgcgtaaaggtgcgagtcttgctgaaaaatgtaatgcaaaattatccgttatccacgttgatgtgaacttttcggatctctacacggggttgattgatattaatatgtcgtctgttcaagattctgtgtcagaagaaacgatcaaagcattagaggaactctctggtaaaattacttaccctgttactgaacgtttaaatggtagtggtgattttagtcaagtgctggaagaagcggtagagaagtaccaagtggacttattggtcactggccatcaccaggatttttggagcaaatttatgtcttctactcgtcaagtgatgaacagtataacggtagatatgctcgttgttcctttagcaagtgaataactcaagctattgattggtaaataaaacgtgaaaaaagaccgcttgtgtagctgagttgtcgcattcagttactctggcggtttattttttgacttaatgtcaataatttatgcagtaaaaaatacaagtattgaaaaaaatgtgtaaaataggtgggtcaattactaatatactttagtaaaaacatagatatacagttttttatatccatttgagtgactttaatgaaaacaacttcagagattagacaagcctttttggaatttttccaaagcaaagggcatacgattgtgccaagtagctcgcttgtacctgaaaatgatccaaccttgcttttcacgaatgcaggaatgaaccagtttaaagatgtgttcttaggattagacaagcgtagttataacagagcaaccagctctcaacgctgtgtgcgtgctggcggtaagcataatgaccttgagaatgtaggttataccgctcgtcaccataccttttttgagatgttaggtaactttagttttggtgattattttaaacccgatgcgattgcatttgcgtgggaatttttaacatcaccgcagtggttagcgttaccaaaagagaaattgtgggtgacagtctatgaaacagacgatgaagcctatgatatttggaatagagagattggtgtgcctgctgagcgtattgtgcgtattggtgataataaaggtgcgccttatgcgtcagataacttctggcaaatgggcgatacgggtccttgtggtccttgtactgagatcttctacgatcacggtgaccatatttggggaggcccaccaggctcagcagaagaagatggcgaccgtttcattgaagtatggaacgtggtctttatgcagtttaatcgtcaagcagatggtactttaaagaaattacctaagccgtcggtagatacgggtatgggtttagagcgtatcagtgcggtgttgcaacacgttaattcaaactacgaaatcgacattttccaagcgttaatcaaagagattgcttctttgttaaatgtgacagatttagacaataaatcgttacgcgtaattgcagatcatattcgttcttgtgcgtatttgatcgctgatggtgtgatgccgtcaaatgaaggtcgtggttatgtgttgcgtcgtattattcgtcgtgcggtgcgtcacggaaacattcttggtgcgaaatcagcgttcttctatcaattagtgccaacccttgcaaaagcaatggggcaggctggcgagattttgacgcagaaacaagcgcatattcagaaagcgttaaaagcagaagaagatcagtttgcgcgtacccttgagcgtggtttggcgttattagaagatgcgttagccaaagtggagaataaggttttatcaggtgaagtggcatttaaactttacgatacttatggtttcccactggatttaacggcagatgtttgccgtgaacgtagtattaccattgatgaagctggctttgagcgtgaaatgcaagctcaacgtgcaagagcacaggcaagcagtaattttggtacagattacaattatgtgattaaagttgatggctcaacggagttcaaaggctatgaggtcacagaatgtgaagcgactgtcgttgcgttgtttagcaatggtaaagcggttgaagctattcaatcgggggaaaatgcagtcgttgtcttggatcgtaccgctttctatggagagtcgggcggtcaggttggtgatagcggtgtgattgcttcagatatttgcaactttgaagtcaatgatacgcaaaaatatggtcaagtctttgggcatattggtcaattagcttcaggcactttatcagttggtgataaggtgaaagcagaagtgaatacgacacgtcgtcacgctattaccttaaaccatagtgcgacccacttattacattcggctcttcgtcaagtgttaggtgatcacgttgcacaaaaaggttctcttgtgtcagaaaattcacttcgttttgacttttctcaaggtgaagcgatttcaaaagctgacttagaagagattgagcgtattattaatacgaaaattcgtgaaaacattgtagttacaactgaagtaatggatcttgaatcagcgaagcaaaaaggtgcgatggcacttttcggtgagaaatatggagatagagttcgcgttgtagatataacagcagcgttttctgtagaactttgtggtggtactcacgttaaacaaacaggtgagattggcttattcaaagtggtatctgaaggtgcggttgccgcaggtgttcgccgtattgaagcggtgacaggcgaaaatgcaatcggcttattacatcagcaacaacaaattcttaaccaaagtgctgagttattaaaagcagatacggcaagccttgttgagaaaatccagcagctacaagagaaaagcaagaaagtagaaaaagagctacaacagctcaaagataaacttgcagctcaagctggtggagaattagcaaaacaagctcaacaaatcaacggggttaatgtggttgttcaacgtttagaaaacgttgatgcaaaagcattaagaacgatggtcgatgacttgaaaaatcaactaggttcagcggtgattgtctttgcaacacaaactgatgaaaaagttaatttgatcgtaggtgtaacaaaagatcttacagacaaagtaaatgcaggcgaacttgttgggttaatggctcaagaagttggcggtaaaggcggtggtagagctgatatggcaatggcaggcggtagccaaccagaaaatataacccaagccctcaatgttgcgacgaattggattcaagcaaaactctaattataaggggcaagttagaatgactttggcttgccctgattaaatctaaaaggagagatagttatgcttattctaacccgtaagattggcgaaagtttattgatcggtgatgatgtagaaattactgtcctaagtattcgtggtagtcaagttaaattaggggtgaaagcacctaaggaaatttcggttcaccgtgaagaaatttatcaaagaatcaaagtgttagcagatgaaaatccctcggaataaggtagattgatatttactgaggtttttatctaacgcaatgtgaatttgagtctggaaccaaatgtcacaaacagataaattgaaacgcagtgttcaattttttgaaaaaatttgtgcaaaacagaccgcttacttaaggtaggcggtttactttatctaaatatattaaggatttttctatgaaagtgattattcctgtcgcaggtcttggtactcgtatgcttcctgcaaccaaagcaatcccaaaagaaatgctaaccattgcagacaaaccgttgattcaatatattgtaaacgagtgtgtggctgcaggagtaagagaaattgtgcttgtcactcattcatctaaaaacgctatcgaaaaccactttgatacatcgtttgaactcgaaacaatgttagaaaaacgagtgaaacgtcagctattagatgaagtgcgttcgattgtacctaaagatgtgaccttgatgcacgttcgtcaggggcaagcgaaaggattagggcacgcggtattatgtggtcgagctgtggtaggaaatgagccttttgcagtggtattgcctgatgtgttattggcagattttactgcagatcaaaaaacagaaaacttagcagcaatgattcaacgtttcaaagaaacaggcaaaagccaaattatggttgcacctgtggcgaaagaaaatgtgagtaactatggtattgtagattgccaaggtgcagaattacaacctgcaggtacagcgaagattgctaatatcattgaaaaaccaagtattgaagaagctccgtctaattttgccgttgtgggacgttatgtcttctctgcagaaatttgggatttacttgccaaaacaccggttggtgtgggtgatgaaattcaattaaccgatgcgattgatatgttgattgaacaacaagaggtggatgcctttcatatgacaggtaaaaccttcgactgtggtgacaaattaggctatatggaagcctttgtagaatacagtttgaaccacgataaattcggcggtaaatttaaagattatctgaaaaaattatcgaagtcgctgtaattaaatttatataaaatgtagggacacactgcgtgtgtccgttcaaaatttttattaataatggttggtggacacacgcagtgtgtccctacgctaacaaggagcaaatgtgatcgtcaaaaaaatagcacaagcggtaggttttgggcttttttgtgctggcttgattctttatgttgccccttgcttaaacaaaagcactcaaacagagattatcagctttcacgatgcggtaagaattgcgtcgcctgcggtagtcaatgtttataatcaggcctttgattctacccattctgatacaggggagttacaagtaaacaatttgggatcgggcgtgattatgacctcaacgggttatattttaacgaataaacacgttatccaaaatgcagatcaaattttagtggcactgcaatcggggacgatttcgagtgctacattggtaggatctgacaccttaactgatcttgctgttctcaaaattcaagcagaaaacttgcctacaattcctcaaaattcaaaacgcgtggctaaaatcggtgatgtggttttagcaattggcaatccgttaaatttagggcagagtattacgcaaggcattattagtgcaacggggcgcaatgcattatctgaaatgggtcggcaaaactttattcaaactgacgtttctattaataagggtaattcaggcggagctttggtaaatacggctggtgagttgattggcattaacactttaagtttaggaaaaaacagtgatgaattggcagaaggattgaattttgcgattccgatttccttagcaaataaggtgatggaaaaaattattcgtgacgggcgtgttattcgaggctattttggtgttaatagctcgttgtactatacggctaaacagctaggagtcggtgaaaaagggatcttaattactacagtagctgaaggtggacctgcgaataaagcagggattttagctggtgatttgattttacgtttaaatgatacagaagcccaaactccagctcaaatgatggaattgattgcagaaatgaaaccaaatagtaaggtaaaggtattaatttctcgtcaaggcatacagaaagaagttgaagtggttattggtgaatttccagagctataaaggataaatatgggtattgtaattacagttgatgggccaagtggtgcaggaaaaggaaccttgtgtcacgcccttgcagagaaattaggctttgattttttagattcaggagcaatttaccgtattttagcattggctgcagtaaaacaggggattgcctttgagaatgaaacggctcttgcgcagcttgggcgaaatcttaatgtgaaatttgtgcctgagaataatgaaattcaggtcattttggacggtgaaaacgttggcgatcaaattcgtacggcacaagcgggtcaaaatgcgtcaaaaattgcggtttatcctcaagtgcgtgaggctttgttacaacgtcagagagattttagaagtcctaaaggattaattgccgatgggcgagatatgggaacggttgtctttccagaagctgaaattaagttctttttagatgcaagtgcagaagaacgtacaagaagacgtgtaaaacagttgcaagaaaagggatttaatgctaactttgacgagattttagccgagataaaagagcgtgattttcgggacagaaatcgccctgttgcacctcttgttccagctaaagatgcgatgattttagattcaacgcatttatccattgaggaagttattcaacaagcgttggattatattgctcaaaaattgtaattttgtttgcttaacaaaggattgttaagttgttatccctaaccccatttagatggatgctaaatggacgttttattttatttaagaagattaattatgactgaatcttttgctcaactatttgaagaatcactaaaaggtcaagaaacccgtttaggttctattgttaaaggtactgtagttgcaattcaaaaaggctatgtacttgtagatgctggtttaaaatcagaatcggcgatccctgctgaagagtttttcaacgcacaaggtgaattagaagttcaagttggtgatgttgttgatgttgctcttgatgcagtagaagacggtttcggtgagaccaaactttctcgtgaaaaagcgaaacgtaacgagtcttgggctgcgttagagaaagccttcgaagaacaagcaaccgttgttggttttgtaaacggtaaagtaaaaggtggcttcactgttgagttaaacggtgttcgtgcattcttaccaggttcattagttgatacccgtccagttcgtgattctttaaatcttgaaggtcaaactttagaacttaaagtaatcaaattagaccaaaaacgtaacaatgttgtggtatctcgtcgtgcagtaatcgaaacaacaagctctgctgatcgtgaagaagtattagcgaacttagttgaaggttctgaagtgaaaggtactgtgaagaacttaactgactacggtgcattcgtagatttaggcggtgttgatggcttattacacatcacagatatggcgtggaaacgtgttaaacacccaagtgaagttgttgcagtaggtcaagaagttactgttaaagtacttaaattcgacaaagagaaaacgcgtgtatcattaggcttaaaacaattaggtcaagatccgtgggaagctattgcacaaaaccacccagtaaacagcaaattatctggcaaagtaactaacttaacagactacggctgtttcgttgagattttagatggcgttgaaggtttagttcacgtatcagaaatggactggacaaacaaaaacattcacccatctaaagtggtaaacgtaggtgatgtggttgaagtaatggtacttgaagttgatgaagaacgtcgtcgtatctcattaggtttaaaacaatgcaaacctaacccgtgggaacacttcgctgaaactcacaacaaaaacgataaagtaaaaggtaaaatcaaatcaatcactgatttcggtatctttatcggtttagaaggtggcattgacggtttagttcacttatctgacatttcttggaatatggctggcgaagaagctgttcgtaactacaaaaaaggtgacgaagtagaagctgttgtattacaagttgatgcagtgaaagagcgtatctctttaggtatcaaacaattagaatctgatccattcacaaacttcgttgaaggcactaaaaaaggtgcaatcgtgaaaggtaaagcggttgaagttgatactaaaggcgttaaaattgaattagcagacggtgtagaaggttatgttcgtgcagctgaagcaacccgtgatcgtgtagaagacatcacaacagttatctctgtaggtgacgaaatcgaagcgaaatacacaggtgttgatcgtaaagctcgcattgtaaacctttctattcgtgcgaaagacgaagctgaagaatcagcagcacttgcacaagtgaataagcaagaagaagctattccaagtgcaatggctgaagcattcaaagcagcaaaaggcgagtaatttactctcttcgtaagcggatatgtgaaagcatatccgcttcacctatcgcataaggagaaaatatgactaaatcggaattaatagcaaatctcgtagctcaatatccctctctatcagttaaatctgttgatgaaagtgtaaaagaaattttagaacagattatggggtcgttagaacaaggtgaacgcattgaagtaagaggctttggcagtttttctctacattatcgtcagcctcgtgttggacgtaatccaaaaacaggcgaaagcgttaagttagatgctaagtatgttccgcacttcaaagcaggtaaagaactgaaagaacgtgttgatttagcttaattctctgaaagcgacactatgtggggtgtcgtttttttataaactaatgtaataatggagatacgcagatgaaatatattttgggcatcattattgtgcttgctatcattcttgttgccgtgactattggggcaaataacgatcagcttattacattcaactacatcatcgcaaaaagcgaattacgtttatctagccttgttgccattttgtttggatttggtttaattttaggttggttaatcacgggatttttctatttaaaagtgaaattacaaaatattgccttaaatcgccgtgtaaaacgccaagctcaacaaattagcgaacttactttaccaaaggctgaataatgcttgaattgttgttccttttgttgcctattgcagccttgtatggctggtatatggggcaacgtagtgcaaaaaaggatcaagatgcaattaataacaaattttcccgtgactatgtcacgggtttgaactttcttttatctaatcagcaggaaaaggcggttgatcttttcctttctatgctacaaaagcaggagtctgagaaccagatttcaacagaatcacaatttgaagccgaaattactctaggcaatttattccgatcaagaggggaggttgatagagctttgcggattcatcaagggattgaaaacagtcttcactattcctttgaacaaaaattactagcaaaacaacaacttgccaaagattttatggctgcaggtttttatgatcgggcagaaaattactatattaccttgcttgatgaacctgagtttgcagtcaattcattaagtcagcttgctgtgatttatcacaaaacacgagaatggaaaaaagcgattaatgtcgctgaaaaaaggcttagaatagagcctgaaatggataagatccctttatctcactattattgtgaatatgcacaagcggtcagatcggacgatgaaaaagcatttttaacagcattacaaaaagccctttcttacgttcctcactgtgcaagagcctcaatactcttgggggattttttctttgaaaaacaagaaatgcgaacggcattacgctattttgaagcggtattagaacaagaaccgaactacatcagcgaagttttacataaaattaagcaatgttatattgcattaaatgaacaaaataattttgagctgttcttaatcaaagccaaccaaattaaacacaacagcagtgttgatttggcgttagctgaatttattgaacaaaaagatggcgtagaagccgcacaatcacggctttatcaacaagttagacaattcccaagtttaatgactttccatcgttttatttactatcaagtaaatgaagcggaggagggcagaggcaaagagagtttagttctattacataaaatggtcggtgatcgaattaaacagggatttcaatatcgctgtattcattgtggttatcaaagttaccgcttgtcttggcactgcccatcttgtcgaacttgggaaagcattaaaccgatgcaaagtattacagaagtgatttaacataggagaatttaaatggacaacaaaattatcgtcgcccttgactatgaaacagaagccgaagccctcaatttcgttgatcaagtcgatccgtccctttgtcgcttaaaagtgggcaaagagatgtttaccacattgggtacacactttgtgaaacagttacaagaccgcaaatttgatgtctttttagatttaaaatatcacgacattcctaacaccgttgcaagagccgtgcattcggcggcagatttgggggtgtggatggtggatttacacgcctgcggcggtttacgaatgatggaaaccgcaaaacaaattttggagccttatggcaaagatgcaccattattgattggtgtgactgtgctaaccagtatggaagatttagatttattgcaaatcgggattaatgcgtcaccgatggaacaagttattcgtcttgcccatttgtgccaacgtgcagggttagatggtgttgtttgctctccacaagaagttgaggtattaagaactcactgtggcaaagattttaaactcatcacgccaggtattcgtcctgaagggagtgattttggcgatcagcgtcgtgtgatgaccccaaaacaagcgattgaaataggatcagactatttggtgatcggccgtcctattacccaagcggccgatcctcttgcagtattaaaatcaattaatcaatctatcgcctaataagcggttcatttagaaggaaattttacaaatgactttagtgtattccacagaagtaggtcgaattacaccagaaaaaccgaaggctgaacgcccgaaaggtgatggcattgtgcgtattcaacgccagacaagcggtcgtaaagggaagggcgtttgcgtaattacaggtgttgatttagatgatcgtggtttagtggcactagcttctgaacttaaacgcaaaacaggctgtggtggttcagttaaagatggtgtgattgaaatccaaggagataatcgagatcagcttaagcaaatgttggagcagaagggatataaagttaaatgacaatgctgaattcagaaatattacgatataatcgtcagattatattgaaaagcattgattttgatgggcaagaaaagttaaaagcaagccgagccttaattgttggattgggtggattaggttgtacagcgagccagtatttagcaagcagtggtattggatatttaaccttagttgattttgatacggtttcactttctaatttacaacgacaggtactacattctgatgcaactatcggcatgccaaaagtagaatcggctaaaaagcgtttacatgaactgaatccccatattcaaatcgaaaccattaatgcgtatttagaagaagatgaatgggctaaattgattccccaatttgatgtagttttggattgtacagacaatgtgacaatccgtaatacactcaataaaatttgttttaatgtaaagaaaccgcttgtatcaggctcagctattcgttttgaagggcaagtgagtgtttttctttaccaaaaacaagatccctgctatcactgcttaagtcagttgtttggagaaaacactcttagttgcgttgaagctggggttattgctcctattgtcggtattattggcagcttgcaagcattagaaacaattaaagttttacttaatattggtcaaatattgtctggacggcttttagtaattgatggtttaaatttttctatacgagaaatgaagctgcttaaacagtcaaattgttctatatgtagtaaagaataaggttcaagtccagcaggaggagccaaacgatttcctcctttagttttttgcttttggtcttgttttatttgtctccttttataaaacagtaattcatacctcctagaattagatcaaaagagttgccccgtacaggggctttttttatctagcaaaaatggtgaattaattttgctaataattctcttgtgggttcaatgaattttgcatctaaatattcgttaggttggtgagcctgttcaatgttcccagggcctaaaattagtgttgggcagagttgttgaataaaaggtgcttcagtgcagtaattaactgctttacattcttctcctaataatttttcaaccacctttacgatctgggcggaatgttcgcattcatagccaggaatacccgcatgtaaggctttaacttgaatgcgatccccccaagtctcaataagaggcgcaagatattgtcgcactaaatcctctgcatcttggatggctaaattaggtaatggtcgaacttctagttgtagctcacagcaagcacaaatacgatttagggcatcaccaccatgaatatttccgaagttgagggtaggataagaaacacagaataactcattatggtatttttgttttaagctatttttgagttgaagtaagttacccaccacctcatacataatttcaatagcattaattccattggcaggattactggaatggccagatttaccaataacctgaactgtttgagcaagatggcctttatgtgctcggataggtttaagagaagtaggttctccaatgatcgcacaatctgggcgaatatgtgcatgttgtgaaaaggttcttgcaccaagcatcgttgtttcttcatccgcagtagctaaaatccgtaatggctttttaagttttgctaaatcaatttgattgagaacatcaaccacgaaagcaaaaaagcccttcatatctgcagtacctaatccgtagaatttcccttctttttctgtaagctgaaaaggattgaaattccagagcccctcatcataaggcacagtatctgtgtgcccagccagtaataagccaccatctccttcgccataagttgcaagtaagttatatttttgatgagagccgttaatggcgatgatttccgttttaaatcctaaatcactaaaccaataagccaataactcaatcaatgctttattggatatgtcatatttttcattcaggctacttatggtaggaatttgaattaattggcgataacgctcaataaaagagagatgtgttgtcatttattgatcctttcttgagaagagtatagaaacacagcttgttagtattttaaggaaagtaagtataatcatatcaatatttaactcatctttttcaaaaaaacgaaaaattcctgttattttatctttagttttgtgttactcatttgttttttttttttttacaatagcgtgcggggacatttgtgcatcctgaaaatgtaaataaaggtttatgatgttttattaggaaaaacagcttgtagggtgggtcttgacccaccatgtagccgtaacatattgattttattggtgggttaaaacccaccctacaatattcaatccatctaatatatggtttgtcaaggagttaacttcccccgcttgcgggggaagtgcccgagcgaaagcgagggcgatgggggcatttgtgcatcctgaaaatgtaaataaaggtttatgattttttattaggaaaaaacaatagagaaggttattatgaataaaatatttagagttatttggagtcatgctcaacaggcttgggtggttgtgtctgagttagtaaagtcttataccaaaacatccgcttacacggataaaagagctcaagtatgcacctcagattattttttagataaacagcaagataaatttaaattaagtcttttaagtctagtattactgggtatattttttagtccagtagcaggttcaactactgatttatcatattttcaacatggtgctacttacgggactaaacataaatctgacgccggtactattggtattggtagacagagtacggctgggcctggttctattgccatcggtcagcatacaaaagctgatggtaggactgttgttgcgataggttattcagcagtaacgacagatatgggctcccctgttgcgataggcggccacactaaagcaaatggggagagcgcaattgccataggggttcattcaagttcgggaggaaaggaatctattgtcttaggccataaagccaatacgacaactggtcaaacagttgtaataggtgcacatgctagtgcaaaagggcaacaatctgttgctatcggggcagataccaaagcggatgggtatggctccatatcaatcggtggagatgatttaaatacaacgaaatatggcaagggtagccattccagcacaactgcgaaaggtaaagcctctgttgctattgggggtatgtctttggctgggggcgaaggatctattgttttaggtcctgtagcatctgcaactcatactgaaggcattgctatcggtgcgagaagtaagtctaccaatgagtacggtattgcggttggtggtggtgcaactgctggaaaaaacgccgttgctgttggtagggagtcgaaaggtactggggcaaattccatagcgataggtaattctgcgaaaacaacaggggcagactctgttgttgtgggtgccaatatcaatgtgacagatggacaattagtggcaattggataccaagcaagtgctaaaagtcgttctactgccttgggttataaagcctctgccggtggtaggagctctgttgctgtgggtgaagaggcaaagacaacaccagacagatcaaccgcacttggtaataataccgttgtctccgtgggtggcggtgtggcattgggttatggatctaatgcaaatacagctggcggtgtagaggggttaaaacaaaatcattctgtcacaacggaaccaagcactgacgctaacggctttaaatccacagaaaaggttgatggtaataagattggtgcagtttctgtcggtttaggctcaggtaataaactcatcaaacgccaaatcaccaacgttgcggcaggtacacaagataccgatgcggtaaacgtggcacagcttaaatcgctcaccatgctaataggaggcgatgacagcagtagtggcaaggtaggcatttgggatggcaaacttgaagttaaaggcacaaatggcgaaatcaagaccaatgcgtctggctcaaccatcacaatatcactagacgataagattaaaaaacaattagctgatgccaaagcaggaagtttgacattcaaaggcgaaaaaacaggtacaggtacaataacaaatgatgtttcgggtcaaaaatggaatgccaaccaagataagaccgttaccattacaagtaaagaaacataccaaaatggtggtgttcgatacaaaggcgataacattgaaatttatcgtaaaaatcttaacaatggaaacacagaattccatgtgttgatgaaagatacaccaacattcagcagcgttcaatatggcaataatggacctaagattaccagcactggcggtaatctaaaagtaacaggtgcaaacggcacttccccagttaagatcaccaatttagcacaaggtacacaaaatggcgatgcggtgaactacatgcaattttcaaatgctggttggaaacttgcaattgctcagggaacgggggggcaagcaactccacctacggcacatcttatcaaaataggcgataccgcaacctttaccgctggaaataatattaaattagaacaaaagaacggaaagattacgatttctacgattggtaagttaattaaaaagactgaaagcctagcaaatggtgatttgaaaattacttatacggatggcagcagtgatactattgctaaggggaaagacggtaaaaatggtgagaaaggtgagaaaggtgatggaggggaacaaggctcagcagggcctagaggcgaagcaggtccagcaggatcaccaggatcacaaggtgcaactggtcctgtaggtccaaaaggagatgcaggagtaaaaggcgataggggtgaccgtggtgaagcaggagcagtgggccctcaagatcctgcgggtccagcaggggctaagggtgacaaaagtgatacgggccctgcgggtccagtagggcctgggggtgaaccaggtcctaaaggtgaacaagggattccaggggtagcaggtcctaagggcgatagaggcgaagctggcccaatgggaccacaaggaccgcagggaacagcgggtgctcaggaacctaagggggataaaggcgatccaggacaagcgggtccagcaggaccacaaggccctgcgagtccaacgggatcacaaggacctgcgggtccaacgggatcacaagggcctgcgggtccaacgggatcacaaggacctgcgggtccaacgggtccagcaggaccacaaggccctacgggtccaacgggacctgctggtccaaaaggagaaaatgtgggccgtggtttaggtttgaaagatgatgctgaatcaaataaaacggcacttacccctacagatgcacaaaaagctattgctggtgataacaaagacggtaaaggcggcttattggctcaaacgggtaatgcgttaaataatgtagcgacagtgaaagatttacaagccattgcacaagcgggcttagacttgacgggtaacaacgccgataccactgtacatcgtccattgggtacgaagttaaccgttgagggtgaaggcaaatggaatggtaaggactcagcggctaataacctttatgtggaagcgcaagtggcagataacaaacttgttgtgaaaatgaacagggatttaacgaacttaaattctgtgactttaggcactgcgacaatgactggtgataagaatacaatcaaccttactggtgcaggagagaaagtcgaggaagagtttgttaaatgggacccagtgactaaacaacctattcttgatgagaatggcaatctccagaaatataaagagaaagttgatcctcgtgtgaaactgagtggtattgctgatggtgatatttcaccaaatagtactgatgcagtgaatggtcgccaagtttatgttttaacctatggtatgaagttcttccacaccaatgatggtcataatgcagaggagcaaattaaccataagtcgaatacagtggattcaagagcttcaggttcatactctactgcagttggttacaaagctcacgcgaaaggggagagttctgttgctttaggtaacggggctacagctggagagcaaggcgtggctattggtcacggtgctgtggcgtcaggtaaacaatctatttcgattggtaccggcaatgtggtgagtggtaataactcaggtgctattggtgaccctaatacaattaaagcagatcgctcttatgcattaggtaataataaccaagtgaatgcaggtcaatctgatgtgtttgttgtcggtaacaacgtgaaaaacacaaccagcaactcggtattcttgggaacaaactcaggctatgtggcagcaggtgcaaccactgcgggagcgggtgctttagaaagccaagtaataggtggtgtgtataacgcttatgccggcggtaaagcaactgaagttgtaggcgtggtgagcgtgggtaatgtagacagtaatggcaaaatggaaactcgccgtattcaaaacgttgcacctggtttaatctctgagcaaagtaccgatgcgattaatggtagccagttgtatagcttaatatctcagcacaaggtgcatatgggcgatattcacaataagatcaaccgtaataataaagctctgcgtgcgggtattgcaggttctaacgccgcagcaggtttaccacaggtttatctccctggtaaatcaatggttgcggcatcagcggggactttcaaaggtcaatctgcattggctgtgggttactcaagagcatcagataacggcaagctgatccttaaattacaaggtaatgcaaatactagtggtgaaatgggcggctctgtgggggtaggttatcagtggtagatatgataggagcttataacaaattttgttataagctcctattttgatatcacgattacttcacttcacgaatcataatttctgatgggattacactaccttgccaatacagctcagtcgaaacttttaaggctaaatcgaggtaggcttggctgatttcgtggttaggatctgctaccaccgttggcgtacctttatctaaatcttcacgtaaacgaatatgtaatggcatttgtcctaacacttgcgtttggtatttttctgccactttatttgcaccacctgtgccgaaaatggtttcgtggtgtccgcaatttgcacaaatatgaacgctcatattttcaatgatacctaacactggcaccgatactctttggaacattgcgatccctttgatcgcatcaagcaaggcaatatcttgtggcgtagttacaaccactgcccctgtcactggaatttgttgtgaaagggtaagttggatatcgcctgtacctgggggcatatcaatgaccaaatagtctaaatcaggccaccacgtttcttggagtaactgacttaatgcactgcttgccattggtccacgccaaatagttgcgttatcaggatccattaaatagccgatagaattagagtataagccgtgtgcttcaatcggggtaatatgtttattgtctggcgatacagggcgttggtttgctgcgcctaacatatgtggaattgaagggccataaatatccgcatctaaaatacccacccttgccccttgtgctttaagtgccaaagcaagattgactgatgtagtggatttacccacaccacctttacccgaagtgaccgcaataatgtttttcacaccatttaccgcagggtgactattggcacgttttaaggtggcaatttggtaatttaaaacccatttcacaccgcttgcaccactgacttctttcagttttgcttccgttgttgcctttaattgttcaaatccgctgttccacgcaaaaggtagcgtaaattcaagacgtaaaatcccaccgcctaattcggctttttttaacgcatttaatgcgattaaatctttttgcaaggttgaatgttgaaaaccttgtaaaacgcttttaatgccagctaattgctgttcggtaagttggttcatttacttatccttatgatattgtcgagttaaatctttgctataaatagtttcacttgcattttgttcatcaaagccttgaattgttggagcaatgctcattcggcgttgatattgaaaaagcggtaagattgcgacatcttcttccaattgctgtgctattgtagcaattattctttgccttttagctgtatctaaaggctgttcttgtaattgtaacaacagttcatctactttagcgttgctataactacttttattatcagggctttggctatgaaattgcgttaaaaagagtacaggatcagggtaatccgcacaccagcctgaacgaatgagttggaaatctttgtgctctcgttttgcaagtaattcttcccagctaaccgcttgtaattgtactctaaatagttcagattgccctaatgctcttactattctttcagcaatttgtgaatgttgcccttgtctatcataactcaaggttaattttagcggattgccggaatggatcccttgttcatttaataactgctctacattggtatgagaaagcgaatgtcccatttcactaaatagttgtttcggtatcattaaatgtgaaggtatgccattgcctttgctgatttctatcggggaaatcattgctcgcactgcttgacgtattggcttctgagtaaataacggatcattgaagttaaattcataaaagtaattacacaagcgagcaaaacgtttttcgtgttgatgatagttttccaacggattttcaataatatcgaaacggcttggattttgtactgaggtaattaaatgatattgcactacttggaaaggcgtatttttatcccttgctttcagttgcaacagatttttttcaagatgctcaacgcgataactaccgttactaacgagatccgttgaatttggtttctgacctagataggttggcaacaatgcagaatgagccagcattttaggcagttgataattcgctttttccagctgaacttgtaaagtgtaagggtttaacgccttaactcccaaagcatcagggggtaattcaccagccaagacagctcggctattcacaatccccatatagactaaataatgtgctagtggtgaggcatttttagggtcactcaaccgttgccagcttgcaacaaaatctgcggaagtcaccgcctgatcattcgaccatttcgcattttcatctaaaataaacagccagtttttaccatcttcactaaaccactcttttgccacagcattttggatttgccctttaggatcaaacgccatcaagcctaaaaatagatctcgaacaaccccagcctcagcagatattctgacaaaatgagggtctaattgtagctcggttgcgtaaattgcacggcttaaaacattggttggttctgcattaggcaaaggtctaacggaaccgttattctcttctggatcgcaggcaacaaaccccacgatacaagcggtcacaaaaagcccttttttgataaattgcataatgcgttgaataaatgccattttaatgaattgccgttaatccaggaaatagattgcttaatccagcaacaataatttcaatacctaatgccattagaattaagcccataatacgggtgacaacattcgagccagttttaccaaggcgtttcaccaaaggggctgagaagcggaataaaatataacagatacctgcaaataagatgattgccacgctaaatccaaccagatctacccaagtatgataacgtgttccccaaacgatggtcgaacctatcgctccaggtccagccataatcggcattgctaaaggcacaaccccgatattttcatattcagacaggtcagcatttttttcttccttattctgcttatgttcgcccaatttaccgctaatcatcgtcatcgcaatactcacaatcaaaatccccccagcgacacggaaagaattcagggaaatactgaaagcatctaaaatcacttttccaaaaaatagactgacaagcaaaataaccccaacagaaacggaggtgatcaaattagtacgattgcgatcagcttcatactgatgagcagtcatactaaaaaagatcggtaaagttccgaatgggtttacgatagcgaataaaccgataaaaaactgaaggtaaatcgcaaaattaataatgatatccacgggctcctaaataaggactaaaaaattcggactattataatcaggaatgttggaaaaggcttgtaaaaatttaattttcttatcgaggataatcaatagacgaagttgtagaaatttgatgtgaatctatttcagtagttccataaggcatttaggaaagctatctatcataatattccatttttgaataaaaaatttcatttttgaattgacatagcaatctagacgtctaaaatagcctagattttaatttttgataaagtgtggattgataactatgattcagctgaaaaatgtcagcaagcagtttgaggtgaaagggaagaaaattactgcccttgataatgttagccttgaagtgccaaaaggtacaatttatggtgttatcggtgcttcgggggcgggtaaaagtacgctcattcgttgcgtaaatttattagaacgtccaactatcgggcaagtgattgttgatggtaaagatttaacgacgctttctgagaaagagttaaaccttgctcgtcgtaagatcagtatgatcttccaacattttaatttgctctcttctcgtactgtgtttgagaatgtggcgttatcgttagagttaaaccatacgccgaaagagcaaattcagcaaaaagtcagtgagttgctagagttagttggtttggcggataaacacgatgcttatccgagcaatctttcaggtggtcaaaaacagcgtgtagcaattgctcgtgcattggcaaatgatccgcaggtattgctgtgtgatgaagcaaccagtgcgttagatcctgcaacaacgcagtcgatcttacaattgctgaaagatattaataaacgtttaggcttgacgatcttgttgattacgcacgagatggaagtggttaaacgtatttgtgatcgtgtagcagtgattgagaaagggcatttggtggaaagcggttcggttagtgagattttttccaatccaaaaacagaattggcacaacgttttattcaatctactttccatattgaattaccgcaggaatatatggaacagctttctcaaacacaaacgccaaccagtaagccgatcattaaatttgaatttacagggcgttctgttgatgcaccattactttctcacgcatcgaagaaatttggaatcgactttagtattttgatgtcgcagattgattatgcgggtggtgtgaagtttggttttgtgattgctgaagtagaaggtaatcacgatgcgattgcagaggcaagattttatttgattgataataatgtcaaagttgaggtattaggttatgtggaatgattttatcaatgaactcacaccaaagatgtgggaattggtggcgttgtccacattagaaacgctctatatgggatttgcggcaacagctttggcggttgttgtggggatgccgattggcttcattgcttttttaacaggcaagggagaaattttagagcataaaggtttacatcaagtgcttgatgtgattatcaatattgggcgttcagttccctttattattctacttgtggtgttattgccttttacgcgtttactggttggtacaacactaggaacgacggcggcgattgtgccattaagtgtttctgctattccgttttttgcacgtttaacctcaaatgcactcttagaaattccaagtggtttgacggaagcggcaaaatcaatgggggcaacaaattggcaagtggtttctaaattctatttgcctgaatctttgccgattttaatcaatggcattacgctaacgttggtcgctttaattggctattcagcaatggctggtgctgttggtggtggtggcttggggaacttagctatcagttacggcgaacatcgtaatatggtctatgtaaaatggatcgcaactgttattatcgtagcgattgtgatgattagccaaaaaataggcgataatctcgcaaaacgttacgatcatcgttaatttgcaaacataacttttaagaggactttcctatgaactttaaaaaattattaggtttagccgtggtttctgctttagcattaactggctgtaaagaagagaaaaaagcagaagcaccagcggcaacacctgctccagcagcacaagcacaaaaaattaaagtgggtgtaatgtctggtcctgagcatactgttgctgaaaaagcagctcaaattgcaaaagaaaaatatggtttagaagttgaatttgtgttgttcaatgactatgcgttaccaaatacagcggtaagcaaaggtgatttagatgcaaatgctttccaacataaaccttatttagataaagattctgcatcaaaaggtttagataacttagtgatcgtgggtaatacttttgtatatccattagctggttactctaaaaaaatcaaaaatgtcgctgaattacaagatggtgcagtgattgctgtaccaaatgacccaagtaaccttgctcgtgcattaattttattagaaaaacaaggtttaattaagttaaaagataataccaacttattctctacttcattagacatcgttgaaaatccaaaaaacttaaaaattcaggaagttgatacttctgttgctgcaaaagcgttggatgatgtagatttagcggttgtaaataacacttatgcaggtcaagttggtttaaatgcaacagaacacggtgttttcgttgaaaataaagaatcaccttatgtgaacattatcgtggttcgtaaagataaccaagcaagcgaagcagtacaaaacttcatgaaagcataccaaactgaagaagtgttccaagaagctcaaaaacacttcaaagatggcgtggtaaaaggctggtaatttaactcaacaaaagagagtgatttagtactaggtactagtcactcttttttattattgagaggatataatatgaatttcaaacacttattaggattaacctttgtttctaccttggttttaacagggtgtaatgagaaaaaagaagtattaaaagttggtgtaatttcaggacctgagcatgaagtcatggaagtggcagctaaagttgccaaagagaagtataaccgtgatttagagttagtgattttcaccgattacgcaacaccaaacgaagccttaaataaaggcgatttagatgtcaatgcgttccaacacaagccgtatttagacaaacaaatcgtagataaaggctacaaattaataccagtaggtaatacattcgtttatccgattgcagcctattctaaaaaaattaagtcaattaatgaacttaaagaaggcgataaaattgcggtaccaaacgatccaacaaatttaggtcgagcactaattctacttgagaaacaagggttaattaagttaaaagacaatactaacttactttcaactcgtgtcgatattgtggaaaacccgaaaaatttagagattcaagaagttgaagcgccattgcttcctcgtacccttgatgatgtagcattttctatcattaatacaacttatgcgggtcaagttggtttgacgccaaccaaagatggcatctttgtagaagataaaaattcaccttatgtgaatttaatagtttctcgtgaagataacaaagataaggaaattgtcaaagattttattaaagcctatcaatctgaagaagtgttcaataaagcgaacgaagtgttcaaaggtgcgatggtaaaaggctggtaatatttgctataaaaatatagatattatttggcagcgaattgttgtgaaatgtgtttggcatatagacaaaagagttggttttaattatttttctaattattaccaactctttttattcatttttaaaaaagagcttaaagccttgtattataaaaggttttaagccctatctatgactattttttcttcgcatatttgagcgagtcaatcgcaacagcgaagatgataatgctacctttgatgatgtactgccagtatgggtttacaccaatataggttaagccgtagttgataacggtgaagattagtactcctgttaccacgccgattactgtacctacacctccagcgaaagatacaccacctactacgcaagcagcaatcgcatctaactcgtacataaagcctaagttgttagttgcactaccgatacgaccagcttctaacataccaccgaaggcgtagaaaacgcctgcgatcatatagataaccactaagttacgagcaacgtttacaccagatacttttgcagcttctgggttaccaccgatagcgaagatatttttaccaaagcgagttttgttccacataatccaaacaaggattgaggcaatcgccgcatagatagtgatgtaagacaatctaaagctaccgatttggaagaagccttgtgcaaaggttgagaaactttcgtcaaagcctgcgattggtgatgaacctacagcatcatagtagagtgagttgataccatagacgatgatcattgttcccattgtcgcgataaacggcgttacgttgagataggcgataactaaaccattgactaaaccgatgacagcaccgatagcacatacagttaaaataaccactggaattggaatttcgcctagatttgggaacactcggttcatattatccattgcttgtagcattgttgcagcaaccacagcggctaaaccaacttggcgacctgcggataagtcagtaccttgtgatacaagcaaaccagcaaccccaagtgcaatgattaaacgcactgaagattgggttaagatgttactaaagttgcgtaaacttaagaaacttggatcttgtgcgataatgatcactaataacacaagcaatacaaaataaatcgcattttgtttaagaaaatctaaagatttagtttgagtaagtgtggacataattcacttccttcttttataaatatttcgcagaaagctgtaaaatctcttcttgagatgttttagctgtttctacgatccctgcaactctaccattgctcatcactaaaattcggtctgtcacccctaataattcaggcatttctgatgagatcataataatgcctttatctttttgagccagttgcataatgagctgataaatctcatattttgcgccgatgtcgataccacgagtaggttcatcaagcataagaatttcaggttgcgttaatagccaacgtccaataactactttttgttggttaccacctgacaacgatccgatatttgttttatgagatggtgttttcacattcatggaatcgatcacccattgggtatcgctcttcattttagcactgctgagtaatccaaacgaacctaagtaggatttcatattagaaatcaatgagttaaattcaatgcttaagttcgcatagatccctgttgaacggcgttcttctgtcactagtgcaaagccgttgttaatggcttctaaagcggtgtgatttgccatttcttttccgtgcaatttcactgagccttcttttcgctcacgcacgccgaaaatggtttcgacaatatccgtacgttttgccccaactaagcctgcaatccctaagatttcccctttgcgtaattcaaagctgacatcttggatagacggttgatttttggcagtcaggtgttgtacttctaaaatcacttcttttggtgtattggtttttggtgggaagcgttgagttaattcacgtcctaccatcatagatacaatgccgtccattgtcgtttcttttactgggacagtattgatccatttaccatcacgcaagatcgtaatttcatcacaaattttgaaaatttcgtccattttgtgagaaatatagataatgccacagccacgatcttttagtttttcaataattttgaacagatgttccacttctttttctgaaagtgaagacgttggttcgtccataatcacaattttagcgttataagagaacgccttggcaatttcgatcatctgcatttgtgatacagagagatttgccactttttctttaggatcaatatcaatatcaagttcatcaaaaatcgctttggtgtctcgatacatttttgcgtgatccacaaacatacctttcaatgggtagcgaccaagccaaagattgtccattacgttacgctgacggacaagatttaattcttggtgaaccattgaaattccattctctaaggcttctttagaggttttaaaattaacaggtttgtctagaaatagaatatcgccttcatctttggcatagataccaaataaacatttcagcaacgttgatttacccgccccattttcacccattaaagcgtgaaccgaatgagaacgaacagtcaagtttgcgttatctaatgcttttacaccaggaaaggatttactgacattggtcatttggagaagcacttggctctctggatgttctgtgttttctgtcatatccaacctcacaaaataaggggaggtttccctcccccaaactacaaatcattattttaagaattcagaaaggttatctttatctacgccaacataaggaatacgtaatactttctcttttaattcccatttagtaccttcagttggtgctttctctgcggctaagtttttagcgagatgcacaactgctttaccttggtttacaccgtcatttaatacagtacctgcaatttcacctttttggattaattgaagtacttctggtaacgcatcaacaccgaagataggtaattttttaccgtgtgctttagctgcttctaatgcacccatcgccataccatcgttgtttgcaatcacaacttcaatgttgcttgcttttgagctagataaccaagcatctactttatcttttgcaagcgctgcgtcccacataccagtatctacgaagagttcttctgtttggatacctaatttatttaattgctcaacagaatatttagtacgagcttcagcatctgggtgacctggttcaccttttaacataacgtattggattttaccgtctttgtttaagtcatacgctgggtttgctttccagtgtttcgcaattaattcaccttgaattacgcctgactcttgtgggttagttccaacgtagaatgctttgtcgtagctaccgatagctgtatcacctggatctttgttaaagaataccacagggataccttctggttttgctttaccgataatggttggagctgctgatgggtcaactaagttgatcgcaagagctttaacgccttttgaaattaatacatcaacttggtcgttttgaattgattgagcattctgtgagtcgttcattaataaatcaacaccacccactactttcgcttctttttcaatttcttgacgcattaacgacataaagttgtcgtcatatttatagattgtcaccccaatgcgatccgctgcttgtgctgatgtagctactgcacctaaacctactgctaatgcgattgtactaagtaccgcttttttcataattagctcctatatggatttttgaatgagataaaattgtcactatcacagtaactcttggaattttactccaaaaaaggaaaaaagaatgtgatcacactcacaaaattgcaaacgttttcattacatttcaccaattgctgaaattgtttttaacttacacttaattttcctaacccattgtttttgcgatatttttttatctgcagattgtttttcaaacactgcttgtaaaaatgtaatcgagggttggttaatatacagacgttttaagcttgcataacaagcagaaagagttctttgatgaaaaacaaaaccttgcacattttttttatcaataaaattaaaaagatactgctcttttgctggcaaaattgaaatcgtattttgcaatgtatccgcaaaaggcaacagcggaaaatctcgttcaaactgttgctttgcttgttgagcaaatgttttaccttgttcagaaagcggataaatcatcattgcactgtggtaaccactgcttgcttcaggagttggtgtaacctgaactaaactaaaaccacaagattgccaaaaacgcaataattcaggggtaagcccaaaactgaccgaaacaaaatcgacaagcggtggcatttgcgaaataatctgcgaaaccaaccgcttgccatagccttgcttctgatattcaggctgtaccgcaatccgcgaaattcgcacagacttcaaacggcaagcatcaggtaaattgccttgaaaacagagatattgagcaaccaaattcccttgcggacggcgttcgccacgccaaatagcctgagtgagtttatcatctaatcccccttcattgaccgcccagcaacctgcgatcaacttttcctgctcttcaagataaaaatagcgttgatcaggtgcgtcaaacagacgacgcaaatccgttggcgttgttttgtaatgtgcttgggcgagtaggtgataaaagttaattaatttatccaaataacttcccccctttgaaaaaggggggctaggggggatttgatattctaataataacaattgattaacaaaagcctccaacggatcattctccccccatctcaacggttggcttaatgtccactgtttcgtagaacggcttaatgtcggcaaaaacttcaaacaaaaaccacgtccagtaccttcataattttgagttgtggtggtgagcaccactttatcaaaataggcacaaaactgttgcaacatcggcaaaggcaaactcgctgcttcatcaacaaacaaccattgatttggcgaaatatttttctgctcgatcatctgaattaaacgatcaggggcaaagaatttaaccttatcactttcaatccccttccaaaaatttggcaaggctgaatggctacgagcggtaatagataccgcatattgctgagagagcttttctgcgagcttgcccgataatgtcgatttgccacgaccacgaggggcgagaataagatgaatatcggcaggatcaagcggtaagttatcgaagatattttgctgatcttgggtaaaaacaatttccccccttccccctgcttcgcagggtacttcccccgtaaacgggggcagaatttcattgaccagcgttttaaaataacgaaagaaattcggcgtggcaatcggctgttgagcgttccaacgtaacgcatcaaaatcgacttgttgctctaaattatcccattctggacagaccaaatagagcgtgccaccttcttgaatagtgcctgccacaatcgccaatgcgtcaagatttaggcaaacaccgccttcagctcgcatatcataaaaagcatagggaaactcttgaccgagtaaggttttggcattggagaaggggaggaatgtcggcgaatcgggtaagaaaataccgccgacatcggcagtctcaaaagaagatgggagatgatcgataaccgttagatgacgcattattcttcaatcgttttttccgcaatatagggatcatcaaaccctagcgactgcataatttccgtttccagactttccatttcttcggcttcttcatcggttaaatggtcgtagccaagcaaatgtaatgtgccgtgaatggctagatgcgcccagtgagcttcgagcggtttttcttgttcaaccgcttctttttcgacgacctgacgacagataatcaaatcccctaacagcggtaactcaatcccttccggcacttcaaacggaaaagagagtacgttagtcggtttgtctttgccacggtaggttaaatttaactcgtggctttcggcttcatctacaatacgaatagtgatttccgtttcaggataatccgccgttttcgcttccatggctaacgctttatccacccagtgttgaaattgagctgccgtcggtaagcctgctgtattttcagaggcaatttggagatcgatatataaattcatttgcaaaaaattccttaaatctgaccgcttgttaccacttatccgccgcttcctgatcgctctcacgcccttcaatccaacggtcgcagtggtcggtggtttcacgtttccagaatggggctttggttttcagatagtccataataaattcattggcgtgataggcgttgccacgatgagcggaactgacgccgactaagacgatttcatcgcccgtataaagctgtccgatacggtgaataaccgcaacgcgttgcagttcccaacggctttttgcttcatcaacaatttctcgcaaggctttttcggtcattgcagggtagtgttccaagtataaacctgacacgctatcgcccaaattcatttcacgcactttgccgacaaaaagggtagttgcaccaacggaatgttgttcactcaaccatttatagatcgcattttgatcgaagggatcttgttgaacttgaataagtgtttgttccatttagcccccagttactggtggaaagaaagccacttcatcgccgtctttaatttcagcagacaaaggggaaatagtttgattaatggcgactaacaatttccctgcttgtaatgctaatgcccatttgtcgctacgttcggctaaatgttggcgaagctgttcagccgtggcaaaggttgcttcaacctctaagctatctacgcccactaattcacgggtttgggcgaaaaagagtactttaatcatttttaactaatcttattaataatttggggtctattggggcaaatatgatttgcccctacaaaatattatggtttggcaacgaaatcgcctgatttcccaccgcttttactgagcaatcgaacttgttcaatcaccatatctttttgtaccgccttgcacatatcataaatcgtcaaagcagcggcactggctgcggttaaggcttccatttctacgccggttttgcccgacagtttgcacagggattcaatccgtacttgatttttttcaggtaatgcttcaagttgcacttccactttagaaagcagaagagggtggcaaagagggattaattcccaagttctttttgccgcttgaatgccagcaatgcgagcagtggcaaaaacatcgcctttgtggtggttgcctgaaatgatcatctgtaacgtttcagggttcattgttacaaaggcttccgcacgagcttctcgcacggtatcttgcttggcggaaacatcaaccatattagcttcgccgttttggtttatatgggtaaaggtgttcattattttctctttgtaaaatattaatgatgtagcaactgtgtttcataatagatttttggacacacgcagtgtgtccctacagattaccctccaatcgatgccaaattatttctcacgccactatcgccaatatgcaaataatggtgttcgcgcttgccttgcagagcggattttaatctggcttcgagttgaaattgttgctcgtccgattgcaataaatcccgaatatcaattccttcttcgccgaacaaacaaaggtgcaatttgcctaatgccgacactctcaaacggttacagctggcacaaaaattcttttcataaggcataatcaaaccgatttccccttgataatcagggtgggcgagaactttagcagggccgtcagacatcgctttgggttgtaattgccaaccttcttgggtcaattgttctaaaatagattgccctgaaaggtgctgttgctggaaaaagtgatccatttcgctggtttccattaactcaataaaccgcatttgaatagggcgatctttaatccaacgcaggaaatcgtccaaacctttagcggtatattgcttcatcaacacggcattcactttgacttttttatagccaatttcaaaggcacgctcaataccgtttaacaccgttgcgagtttattttcccctgtaatcaaatgaaattgacgtggctcaaggctatcaacactcacgtttaaatgggtaattccagcttgttgccataactcaacatcacgttccattcgataaccgttggtagttaatgcaatttggcgaatacctgccgtttgtgaaaggcgatgagcgatttctaaaaaatccttgcgtaaagtcggctcgccaccagtaatacggattttctctgtacctaaattggcaaaggcttgagcaacacgttgaatttcatcgacagacagaaaggtttgtttatgcgacggcggacgatacccctcgggcaaacaatagttgcaacgaaagttacagacatcggtaatcgacaaccgtaaataagtgtattgacgctggaaacggtcgatcaaagcttgctcgaactcgttccctacatttctaattgggatttgcaatgtgacacctttctaaatatgagaggagagccgatttctcaactttccctgtgtaatcaatcaattacaggcacagtttccatatcgctagacttaggaaaacaggctcggggtcggataatgttgggaattgtagtaactgaatgacaattaagcaagaggttgttatgtgattgtttaattaagcaacgttattttatcggggcaaaccccttttgatacatatcaaggtttttatgatggtttctgttaggctaatcctatttttatttaatggaaaaagagtaatggataaacgcacacactggtcgtgcttggtcgatacacaagcggtggttttagagtgggaagatacatcagggggtttaaaagaattgcaaaaaatcccaaactgggataaagtgtaagttattcagagggatcgttatgcgaattatttcaacatcaaaattggtggattattacactaagcaccctgaaacagagcaaccattaaaggcttggatttcagaagtaaaaaaagcgaattggcaaaccgcaaatgaaattaaacaacaatatagaaatgcgagtattctaaaagatagacgagttgtttttaatattaaaggaaaccaccatagattagttgttgcaattgcctataaattaggagcggtttatattaaatttattggtactcacgaagaatatgacaagatagacgcaaatagccacgaacaagcataggagaaataaatgaatattaaaccacttagaactgaacaagattaccaagaagccctttctcttattgaacctttttttgataaagaagatgagctaacccaagatgaattagactattttgatgtaatggtgacattgattgaaaattatgaagcaaaacattatccgattgatccgcctaccccgattgaagcgataaaatttagaatggagcaggaggggcttaatatcaaagatttagatggtattatcggaaaacctaatcgtgtatcagaagtttttaataagaaaagaccattgacactaaatatgatccgcaatattcatcataagatgggaattagtgcggatatccttattcagacagtatagtattgttttatgtgggattttttcccattaacatttgatatgctgtcattcgagcggttatttgcaacaaagcaacatattacagatactcaactgcttgaagccattcaacgtgcaaagaatggtctaatagatgcccatttgggtggtaatatcattaaacaacgtattaccaacaaaggctaagtacgaaagtgcttagccttttgttttggcttaaaaaggaatgtgatatattgcacgaaaattttaaggagatacgatgaaaaacaaatttcttcttttttcagccctaagtggctttttctgtatcgcttttggggcttttgcggctcacggtttggagaaggttttagatcagaaagcgttggcgtggattgaaacaggcttgcaatatcagatgtttcatacgttagcattgatggcgttggggctgtttcaaattgcaaatttttcgcaaaatcctcccgcttgtagagccaaagcctttaacattattggcggtagttgggtgttagggattttgctgtttagtggcagtttatatgcgttagccttaggggcaagccgaatttttgtttggacaacgcctattggcggtacgctatttttagtgggctgggcggcgttggtttatattagtgtgagaagtcagaagtaatgaataaattagctttatactgccgtgcaggttttgaaaaggaagtggcaggtgaaatcaatgataaagcggctcaattgggaatttatgggtttgctaatctcaaagagaacagtggttatgtgatttttgagtgctatcaggcaggggaagcggatagattagccagagaattagcctttaatcagttgatttttgttcgtcaaatgattgtggtaggcgagttgttgcaggagatacgattgcttcgttattagagaaacaagggctgaaatttgctattcagacaaaacatttgtatcacgatagggaagagattaccatacatattaaattagtataggtctggagaagaaaatgaaattgattaaaaccgcctttgtttcaggtttagcactcttatccgccaccgcttttgcaacccaatgggaaaaaatccgcacgcctgtggtgggtaaggctcaatccattgggggatatagcaacggctgtattatcggtgctcaaccgctcgcattaaaaggcgaaggctaccaagttattcgttctgtcaaaaaccgttattacggacacccacaattattaagctacctaaaaaccttagccaaaaatgctaaagcgtcaggcattccaccgattttaattggggatatgggtatgcctgctggggggcgtttttcatctggacacgccagccatcaaacagggttagatgccgatatttggcttcgttttggcccaatggacgatgaaaccgctcgcaatccagcaggtttggcgaccattatggttgatcgtaaggctaatgtggtagatgaacgtctatggacggcaaaccatacaaaactactcaaacttgccgcttcagatccaagagttgatcgcatttttgtcaatccagcgattaaagtgaaactctgtaataccgcaggaacggatcgcaactggctacgcaaaattcgtccgtggtacgcccacgactcgcattttcacgttcgtttaacttgccctgcagatgcggcgaactgtgaaaatcaagctccagtgcctgctggcgatggctgtggtgaagaactttattcttggtttgagcctgcaccgccatcaacaacaccaaaagcaaaaactattccacaaccgccacaactttgtcaaatgctcttatcatcacaaggtctataagcaacttatgcgtttattcattgcagaaaagccaagtttagggcgtgcgattgctgatgtattgccgaaaccccatacccgtggggacggctttattcaatgtggcgaagacaatgtggttacttggtgtatcggtcacttgttagaacaagctgaacctgatgcttatgatgaacgtttcaaaatgtggcgaatggaacatttgccgattatccctgaacagtggaagctgatccccaaaaaagaaacgcttaagcagtttaaagtggtagagcgtttaattaaacaagcggatattttagtcaatgcaggcgaccctgatcgtgaaggacagctgttggtggacgaagtttttggctacttaaatttatcccctgagcgtaaatcccaaattcagcgctgtttgattagcgatctcaatccgaatgctgtcaaaaaagcgattgaaaaattgcaatttaatcgagatttcgtaccgcttgctacatcggctttagcgcgtgcaagggcagactggttatatgggatcaatatgaccagagcctataccctacaagggcgttgggcaggttataaaggcgtgctgtctgttggacgtgtacaaacgccagtgttgggcttgattgtccgacgtgatcttgagattgaaaattttatcccaaaagattattttgaagtgttggcaaatgtggttgttcctgaaacccaagaacgttttcaagcacaatggcaaccaagtaaagcctgcgaagattatcaagatgaagatggacgagtgctttctcgcccacttgctgagaatgtagtaaaacgtatcacggatcaagccgcttgcgttaccgaatatcaagataaaatggaaagtgaagcagcaccactcccttattcactctcagccttgcaaattgatgcggctcgccgttttggcttatctgcacaagatgtgcttgatgtttgccaacggctgtatgaaacccataaattgattacttaccctcgttccgacaaccgttatttgccgaatgaacattttgccgaccgcctaaaagtgatggcggcaattgcttatcatctgcctgagtatgctcaaaagcccgatgctgttgatccgaataagaaaaaccgttgctggaatgacagtaaggtagaagcccaccacgctattatcccaacggcacgtcaagggcaagttcacttaacccaaaatgaacagcggatttatcagcttattgctcgacaatatttaatgcagttttgccctgacgcagaatatcgtaaaggaaaaattgtgttaaatatcgcaggggggacttttgttgcgcaagccagaaaccttgttgttgcaggttggaagtccttgttaggcaaagaagataatgatgaaatcgttgaacctttgctacctgtggttaaaaaagatcagcagttatggtgtgaaagcggtgagatcatcagtaaaaaaacacagcctccacgccattttactgatgcgaccttgttgtcagcaatgacgggtattgctcgctttgtacaagataaacagctcaaaaaagtgttgagagaaaccgatggcttgggtacagaagccacccgagctggcattattgaattattattcaaacgtggctttttaatcaaaaaaggcagaaacattcatagtacagaagcaggacgaaccttaattagtgccttgccagatgttgcaacacagcctgatatgacagctcactgggaaatgcaactaacagacatcagcaaaaaacaagccagttatcaacaatttatggcagatttaaaccaacgattgccgagtttattacgttctccaaatcagcagattttgcaaaatttggcgaaaataacaccgcttaaaatgggttctaaatcacgttatgcccgtaaatctacgcaaaatgttgaaaaataaaccgaatacacagaaattgataaaatccacttgcaaggaaaagtaaagatagctattattcactccatcgaaagttaattccgcagcctgcggaattttattttgaacagattaaagagaacacaatgttaattaatgtactgactattgtttatctcgttgttgcaatcttcctcgttggctttattttaatgcaacagggtaaaggtgcagacgctggtgcttcatttggtgctggtgcagctggaacggtatttggttcagcaggttctgcaaactttttatcaagaacaacagcgattttagcgattatcttttttagcgtaagcctcgttatcggcaacttaaattcacaaactgcagcaccaaaaagccaatttgaagatttaagtaacgtagagcaaaaacaagaagttactccagctaaaatagaaaatagcgatattcctcaataaaaatagaatttacgctctggtggtggaattggtagacacgctatcttgagggggtagtgtccagaggatgtgcgagttcgagtctcgcccagagcaccaataatcaaaagcctagtttaaaagctaggcttttttgtttccaaaaattcattacttttcaattagttacagtaaagatacagtgatacacagtatgtttttgtatatagttaattgagcctattttattcttttttattctagtttatacttcgattacaccaaatttacaccacgaattacaccagaggttatgaaagtatatggctaccatcattaaaagaggggataaatggcgagtacagattaataaaaaaggtattcgtaaaaatgctactttttcaactaaggtagaggcgagtagatgggctataagtgttgaatctcaaattgaagctggagaatatagctctatccctaagatgacttttgcagaattaattgataaatatgttgcggaagtgactgtaaataaaggtggagcaagagaagaaagtttgagattaaatcgtattgctaaaacacctttagggcgtgttgagctagaagatttaaacaaagagcattttgagaaatggcaaaacaagagattaaccgaagtatctgttttaagtgttcttcgagaaagagttagtttatctgccgttgtttcacaagcaattaagtgggagtttctaaaaagtaatccattatcccttgttgataaaccaaaagagccaccgccacggacaaggcgttattctcaagatgagatagatagattgctatttgtatctggatttgattttgataagcagccagaaacaatgattagtcgagtgggagcgtctattctatttgctatcgaaacagctatgagggtcggtgagatttgtaatttgaaatgggaagatgttgattttaataaatcaacagcatttttaccaaaaactaaaaatggctttgcgagaacagttcctttatcttctactgcaattaagattttgcgtcatttggaaaaagtgaaatctgagtgtaatcaaactgtttttcaagttaagtcaagttctcacgatgcaatctttcgtaagatgaaagagttggccagcttggcagatcaagatttacatttccacgatacaagacgggaagccttatctcgattagctaaaaaagtagatgtgatgacattggctaaaatatcagggcatagggatattgaccctatcccaaattctgtgtaaacacccatttcaacttaatggtgatcgtctaggcgatcaccaaaatcaatcataaatcgattcatcgccagtttccagttctgaatcggcattgtccatttttttgatgcatctttaatcgcaagccaaatcactttgaaaactgaatcatccgtcgggaatacatttcgttttttaatcacgcgacgaatcacgctattaagcgattccacggcattcgtggtataaatcgctttacgaatgtcagccggataatcaaaaaatgtggcaatatttgcccagttatcttcccagcctttcgccacaagcgggtattttgcctgccatttttgcgaaagtgcggtcagattttcgcgagcctgtgcttccgtcgaggcctgataaacctgctttaaatctgcggtgacggctttgtaatctttccacgaaacgaatttcaagctgttacgcactaaatgcacaatgcaaagctgaatcttcgttttaggatagactgcattgatggcttctgggaagccttttaaaccgtctacacaggcaataaaaatgtcttttaagcctcgattttgaagctctgtcagcacatttgcccagaacttcgcaccttcattttcagcaatccaatcacggtcacgaggcgtctcaatttctatctcaccttcatcacaaatgacggtcttagatgtgtaaccgttacgtgcatttttaccttttctaggctgatgtttttcataaccaagatggtcggtcagttcaccatttaacgcagcctcgacggtgattttcttgagcatccgtgaaaattgattgaggtcttctggtgtttttagatttttggcaaattccgctgccaaggcgtgaagttgttttttcgttcataataaaatacctgtgtctgaatgtattatctcagaaacagttatttacacaaattgtgggagaggctctctcatcgtgggtgccgtggttatccatcattacaatcctttatgcctgaggcgactgttaaaattaccaagtatagtattgatgaactgtcagaggaacattatcttaagctagatgaagctgtgatgacattacacgatttgaacttagaagcctatcaggtgttaatggcggtgtttttacaagggcaggataagaagaatatttgtcttgaaatgcatatttcacctactacatttgataaccggttacgcactgcacgagattttatggaaggggcggtgtttggttcggggttgattagactgaagttttaggcgtattgctacgcctgatgttgccgataaatttcacaaagttttttaatggcttcggctttcttgccgccgatttcagcaagtattgccacaaattcgtccgcaacaggcgtttccatacgcacagaaaattgcttaaccttgccttcagcaagcatacgtttgttatattcgttcgcagttttagaacgaagtttacgagaatgttcagtcattgaatttgccatggtcacctacttgattttttaaaacgttggttgtatagtttaggaactgcctagcagtgggggcaaccaccgctaggactttatctgattagtaagctgatgagcttaacgcaatcagaattaagaagatgatgatttgataggttttcatcgtcttagttcctatttttagttgagcggtgaaagccgctcttcttatttccgccctattgcgaaaacaaatatattataatttacaaataataatttatcaagaattatttgtaagttttcagattttcatttaaggttatcaaatgtttaacttcagaaaacaaaagcaacaagttgagctaattgagcaattacaagcagaaattgaggaactaaaagcagaaaactaccgcttgagagatttgctttcaagagagtggcaagaaaaacgccgttttatgaagatgataaacggcaaaaagaaaattgccacagattaatcaacaacgattatctgtgaagtcgtgtgaattttaattgttcaaaaagtgattgacgtcgtgcgagaaaagtagtacatttcagctacgcttgcaactcgtacaagcgagagaaatcaaaatgattttatagccctgatcggaaacggtcggggctttttgtttgggggttaggatggaacaacgagatattctgttaaaaaacggtgaagtagttcaagaaaaatctcaatgtcactatgccgctggctggccatctcgacgtatatcagactgcggtcctcacttccaaaataggaaaatttatccatttgctggcaataatgacgtaccacaagattaaacatatctagtggtactgagtaaatttgataaaggttatcacaatggtagaactaaatgttgcgttaaaaaatgccgcagagctttatggtgaaaatcgaccatttgtcgatcctgaaagtggaactctaaccctagcaggttgcgaagctctaagtcgtcttggtattggattttccgaaagtagacttgaacctgatcttttagataagttgcgtaagaatctcgctgctctttagtaaaacctgttgtgagtttttctatgaaaaaaaggtgaagatccttttcgagttgaactaagaagttaaagttgtttgcaattttggcatctttaaatgtgaattcaatataagagaaatggctattatcatattttcctatccagtgagaacaacctagtgtgataaaggggctatcaggcttgttaagttcaataagtgtggttttaagttctggtagttgagcaatttctaggatttcatctattttttcaggatgattaactaaatcaattccacctgcatttggtgttggattttggcaatcttcagatccatttgatggtcgatatggaaatttggtataaccttcacgaaagtacataatttaatcctctgctagtttatttgttggggaacaatattctagcagtttttttaaccaagctcagtctttacggactgggcttttttattgcctgaaacgagggctaaggtatgaaaaatgctatgagagatgcaggaatgcagagctatgcatggaatgggcttacaggttggttagcctggttaggcgatcaacaaaatttaatgttcattagtttggctctagggattgttacagcgttagttaatatgtactcaaaatgccgagaagggaaataaaaaaacgccgaagaagaaagggctgaagaaaagcataaagcagagatgcaccacctcgaagaaatgcatcagatacgtaaacaacaactctcaaggggattaagtaatgagaaagctaagaaaactgggtaaagttggcggtggggtttgttttgtcagtgccattattgcggtgttgaatacagattttcacggtcaatttcgtacaagtaagcaagggcttgaaattatcggcgatgcagaaggttgtaaacgagagccttatttgtgtcctgcaaatgtgcttaccgttggcattggttcaacggaagcgtcaagcggtaagattgaaagaaaagtttacacagacaaagagattgcacagcgttggttggttgatattcagcacgcagaaaaatgtgtgaagcgttacgcaaacggttggaatattccgcaatcggtgtttgatgttgctacttcgctgacgtttaatgctgggtgtggcaccgtgagtaaatcgacgttctttcgtaaaatcaaatcaggcgattatgttggtgcctgtaatgagttgcctaagtgggtttattcaggtggcaagaagttacgagggttagaaatccgtcgtgagaaagagaaggcgttatgtttagctgggttaataaaatcttaatggcattgattttgggcttgtgtgcgtggctatggggtcagtcacggaggatagatagcttgacagccgagaaccaaacacaagcccaaactattgagcaacagcaaaaagcaaacaataagctgacaatgcaactgcaacaagagcgacaagcggtggaataccagcaaaatgttgcaaataaactgcgaaagcaggtggagcagagtaatgaacagattaaagctattttacagaaagagccgtgtagcgttactgctttgcctcgtcctgttgtcgatgagcttaagcggttgcacagcaaagacaaagattgagtatttatatcctccgcaagcctttttagtgcagtgtgagcggtcagagtttggtggcacaacctatggtgatgctatcgagtatctcgttaaggtgatgggagaacgtgacttgtgtgcgggtcaggttgatagcattagagagtggcaagcacgaactaagcaagggtttaaatagcggattaacgtttgtgccacggtagagagcggtcagatgatcgctcttttattttatgtaaattaaatactacataatttgcatatggttttggggttgttagataaatccccgagaaaatacgcaagtgatgtaatttatatataacaaaaccccgatcactgcaaatgatcggggtttttcattacccattaaagccgaatgagtaacgatttatggagattatgacagttttaaccgtaaccatcaaggagatacttatggaatatggtttatggcaaataagccttgcagtaacactacctattttagcgtttgtttcaccaaagctaattaatgccattgctaatttattgaatgttttgaaataaaaaggattaaccacgatgacgaagaaagacgaggttaaatccacgtctaaaggcgtgggtaaattcaaactaacagacaaacaacagcggtttgttgaagaatacttaattgatcttaacgcaacacaagcggcaattagagctgggtatagcgaagatactgcaaaagaaatggggtatgagaacctcacaaaacctcacattcagaaagcaattcaagaagctcaaaacaaacgagctgcgcgagtaaatgttactcaagatgatgttttaaagggattacttgaaattatctcaatgagtacaggcaagcagaaaatcacagaaacagaactaagtaaggttgatggctctattgttcctatggatgtagagaaagtttgttttgagcctcacgcagcaaataaagcgcttgagctattaggtaaacatcttggtatgtttaaggataaagtcgatgtaacaaactctgacggctcacttcgtcctacggttattgagttggtggcaccaaatgaaaatacagcttaatcttccccctaaactgataccggtgtttacacagcagaatgtgcgttatcgtggtgcttatggtggtcgtggttcggcaaaaacacgcacttttgccaagatgactgcggttgttgcatatcaacgggcaatgcaaggcgaaagcggtgtcattttgtgtggtcgtgagtttatgaactcgttggaagattcatcattagaagagattaagcaagccattcaaagtgaaccgtggttagcaaatttttttgatgttggtgagaaatatgtacgcacaaagtgcggtcgaatttcctatatttttacaggtttacggcacaatcttgacagtattaaatcaaaagcacggattttacttgcgtggattgacgaagcggaaagtgtgagtgaaatggcatggcggaaacttctgcctacggtgcgtgaaaacggttcggaaatttggttaacgtggaaccctgaaaagaaaggttcggcaacggatttacgctttaggcaacatcaagacgaaagtatggcgattgttgagatgaattatagcgataatccgtggtttcctgatgtattagagcaagaacgcttaagggataaagcccgtttagatgatgcgacttatcgttggatttgggagggggattatcttgaagaaagcgaggctcaagtctttagaggaaaataccaagagcttgagtttaagcctttacctgattttgaaggcccttatcacgggttggatttcggttttgctcacgacccaactgccgcagttaaatgctgggtgtttaaggatgaattgtatattgaatatgaggctggcaaagtcgggttagagcttgatgatacagcgacatttttgcagaaaggtattgccagcattgagcagtatgtaatacgagcagactcagcaagacctgagtctattagctatttaaagcgacacggcttgcctcgtattgatggcgtttcaaaatggaaagggagtgttgaagatgggattgctcatattaaatcctacaagaaaatctacattcacccacgttgtcagcaaaccttgaacgaatttcgcttgtatagctacaaaaccgaccgcttgtctggcgatgtgttgccaacattagttgatgcccataaccactatattgatgcgttgcggtatgcgcttaatcctcgtattcagcggaaaggggattttagccaaaatccacttaaactttactaaggataatttatgtctgatgtttctattgttatgcgtgaaatcagggcgttgaatgaaaaaggtgtaatgattgatgatttgcttggtggcactaaaacaatgcgacaagcagggaaaaaatacctttatcaattcagtcttgaggaagaagaggcttataaaaacagacttaaccgctcaacgctttatcctgctttatcggaaacgctctaccaaatgacaggtagagttttttttgagccgattacgacaaataacgttcacgataaattaaagcaagatattttgcctgatgtggatttagagggaaataatgtcgatgtattttcttctcgttggtttaatgcaggtttaacttatggcgtggcgtggtgcttagtggattacacccgtactgagaatattcgtaccattgctgatgagaaagccgctaatgctcgtccttattttattttgattaagcctaaaaatgttttgggatttaaaacggataaaatcaaagggaaacgacaaatcacgcagtttcgctatatggaagatgtgtcggtagatgatggcgagtttggttcgaagattgaaaaaataatttatgtgtacgaaatcggccgtatgcgtaagtataaagcggcagaggggcaatggacgctgattgatgatgtgcaacttcttgctcaaaatcgaccgcttgaagtggtgcctgttgtgccgtttattacgaaagaaagcaatgtgtttgcattaggtgagccgccgttgcttgaattggcttatctgaatattaagcactggcaatcacaatccgatcaggacaacattttaaataccgctcgtgtgccgttattagggattttctccgatactgaagttaataagctacaagttggtggcagtgcgttgcatttaccagccggttctcaaattgcttatatcgaacattcaggtaatgcgattaacgcagggcaagagagtttgaaagagttggaaagccaaatgcgtgttgccggggcgaaactcttagataaaaccgtgttagcaatgacagacagtcaagccaaagaagagcagggcaaagaaatcagtttattgcgactgtatgcgaataaatttgaagatgcgttagatttagcgttggaatacgttggattatggttaggtattgatgatgttggtaaggtagagattagcggtaatattgatgacgatctcgatccaaatgcctcgatggatatggtcattaaaatgcaacaagcaggcacactttcaaaacaaaccgtctttaatgaggcgaaacgtcgtgggctgattagtgataatgtggaatgggaagatgaacaggctcgcttaaatgaagaaggggtagattatggccttgagttcgcaggacaagccgaaacaaagcctgaatagtcgtattgcatacgccttgactgatcgcaaaattctgcattttcgttatgatgcacatcttagacagcaggtaatgaaacggctaagtaaaacacaacgtgagttgctcaatcgtttagcggccgcaggtgtggatgctttacctaaaaagcaattagacacactgcttaaggagcttaagcaagaagtggcaaaagtctatcaagaaatgaccgcttacacgcaagacgagttaagcggtttttttgcggccgaaacccaacatattcatcagctttataatgatgaagtcggctttgatttttttaatcaggtgcctgaatataagcaaaaagcgaataaaaccgcaacgattattgcaggttcacctttagaagactggtgggcaaaacaaggtaatgattttgcgtttaagtttgaagggattattcgtcaagggttgttagatggccaacaaacaagtcaaatgattagtgatgttaagcatttaatgaatacgtctcgcagacacgctgaaaccttagtgattactgcggtagcgaaagtggcagataatgctcatcaagccttaagagatgaaaaccttgatattttggcaggagaaaaacacctttctacactagacacacgaacatcaacggtatgtcaattaagagatgggttaatgtgggatttagataaaaagccgatagaccacgatgtaccttatcaacgaccgcctttgcacccacgttgtcgcagtattttacagcttgtaaccaagagctggaaagagcttgggattgatggtgtagatgaaatgccatcaagcacgagagcaagtcaagacggccctgtatcagagcaaattaactacgaaaattggttaaaaagcaaatcgcctgagcaacaagatcaggtattgggcaaaggtaaggcggatttatggcgtagaggcgtgattacttttgcggatatgttgaatcagagtggaagaccgttgacgttaaagcaattaagcgtaaaattggagaatggtcttttagatacagagcagtcattgaaccaaacaacaattgaattgcttgatgacttaaaggcttacaatatcgaatatagaccagtccaaatgctttcaagtcagttatctagtgatgatattattgctaagttagctggtggtgatgaaacaaaaggatcttgtgcgtctttagctttatcttatattggtaatagaattgggcttgatgttacggattatcgcggcggtaaaagttgtgattttttcagctataagcgtaatgtgaaaatgttattttctgcaaaaggtgtgatagccaaagagtttgaggtattaagggaggctaaaggtgcagctgatattcttaactctgagctggtattaggcagggagtattatttaagtgcaggtagacacgcagctattgtgcgtcgtagcaatggcggcttagaatatcttgaattgcaatcaaaagataaaaatggttggatgccttttaataaatatggctctgtaattaagactttaaataaacgatttggctgtcggttaagtcctgaaaaatatagtttgaaaagaaaaatacaattagctgaagttgatagctttaaatcagcgaagcaagatctaaaagaagtgttagggtatttaaatacagctgaggataaacagaaaaaaggtgttttaggggaagaaaaatgatctcttggtataaaaaccataaaaaagataaagtttggtggaaagataacgatgaaaaaattggtgaactggttttttcatttgataaagtgattgaatttaacttttggcaggattatccgcataaactaacgcctgaacagaaagctatttttgatgcagagaatgagattcttgtgcgggatttgaaaggtcagtcataagtattcaggatttataactgcgtggtgtaattacatttcgggatatgttagatcagagtggtagaccgttgacgttaaaagatttatacttaatgcataatttagacgttggttatagtactatgaacagcattgaagaattgcgacaaaaggcagttgatgtagaacctgagattacagaaaaaatcacagaaattatttcgtctgttggtgcaaaaacagctggattagaatatcgtctgaagtctttagagtcgctgaaaagaaaagtggaaacagaaattcttgctggtatttctgagaaacaggcaatcaatagtgtaaaagatgttattcgttatactgcaattcttgatgttaataactttgtgttgcaatatgacgaaattaagtcagcacttgaaaaacaaggttacttgactgttgttgtgaaaaactcttggaaagatggggctgtttacaaaggcgttaatacttttgttaccactttgattaaaaaggataatgttgtttttgaattacaataccatactcagcaaagttttgatttaaaaaatggcgtattgcataatctttatgaacagtttagagatcctgcaacatctcaagatgagagaaaaaaattgtacgaagaaatgcaaatattaagctcacaattaaccgcacctaaagatattcataaggtaaaaggagtgaaataatgtatcaatattatttagcccaaattggtgaaaatcaacaaaagcttattcgtggcataccagatgatttactttctttttctacttatgaaccagaaaaagaagattgggatcaaaagtttggtactttttgggctgataaaatcttagtaagtgattttgatgcatttaaagaaatcaccgaaaaagaagctattcgttttattaaggttcactaatgctttctcataaagctgaattactagctaaacagttgcatgcaaatcaagttgataaagctggaaaagcctatgttaatcatctgcaatctgttgttgatgggcttgttcagccaacggatgatgaattagcagtagcttggttacatgatagtgtagaagatacagctatctcgcttgctcaaattaaagctgaatttggttcagttgtagcaaatgctattggggcgataacgaaacgaaaaggcgaatcatacgagacttatttaaaacgagtaaaagcaaatgatattgctcgaaaggtcaagatagctgatttaactcataatatggatctaagtcgtctagcaaaagtcactgaaaaagatattgtaagacagcagaaatatcagcaagctaaactatttctactaacctagcctaagcgctaggtttttttatacctaatttcaactaaaccgcttatacagcaatgtgtaagcggttttttattgcctgtaagataggaaagtacacccgaaagcggtttgtttctctcgcttaccgtttcttacaggctcttttagcgagagtaagagagaatatatatgaagaaggaaatcaatttactaaaagttccatttttttggtacagaattgttgttagtagaacacgatgagcaaccatatgttgtaatgaaaactatcacagaaagtattggtctttcgtggcaaggtcagcacgaaaaattagttgagcattttgggaaaggtatcaaggaaatcttgatacctacaaatggcggtttgcaactaatgatttgtatgaatttacgcaagtttccagcttggttatattctttgcaacctaaaaaagtttctgatcctatcaagagagctaaaatcatctcattcaaagaggaatgtgattacatttcgggatatgttgaatcagagtggaagaccgttgactttggcaaaattaaatgcaaaatttaatactcaagatggagtaataaagcaaatgcgttcaaattggtcagacgatttccccgatacagttatagatagaaaattaggtgaggcaacatctcaccctctttatgaattagctaagaagggggatattgatgcggcttatcatttagcaaaagatcttgtttcagatgaagcaattgagaaattgcgtaaaatcatcgctggtcggaatgttattattgttccagttcacgctgaagaagctgttggtagaaatatgattcctgtagcaactgctacagtgctagcgaagaaattgaatgtaaaagtcgatctttccattgttcaagcaactaaggtttctagaacagcaggtgatggttggcatagattgatttattcccctgcatttgatggagaatatcctaaaggtcaactggctattattctcgatgatactcaaacgcaaggcggtacattagccagccttaaagggtatattgagcaacaaaatggtacagggcaagatcgcatctttctcaaatttatgatctaatacaccttaattatccatatcaaatcaggttgtaaaatgagcgtttttcgtttttttgaaaatttatccgacccacgagcctataatcaaaaacaccactttttagacatcgtttttctcgtcgtcagtgccgtgatttcgggggcaaacagctggactgaaatcaaactttttggcgaattacatttggattggttgcgaaaatatcgtccttttgagtgtggcattcctgtcgatgatactatcgcccgtgtaataaaacgcattgagccacaagcatttaatgaggtttttcttaattttatcaatgagatacgcacacaacaaggacgtgaagtgattgcgattgatggcaagacacttcgtcatagtttcaatccggaaacccaaagtgctttgcacagtgtgacggtgtggagccagtctcgtggtttgattttatcgcagaaaaaatcctcgggtaagcaaaatgagcagcaggcggtgatggaaattatcgatagtttttgcttaaaaaatgccgttataacggtggatgcgatgaatacacagaagaaaattgcggagaaaatcatcgaaaagaaaggggattatgtgatgccgttgaagaaaaatcaccgtcaatttcagtcggaagtggaggcgtattttcacaaaatcagccgagattgccccgaaatgcttgagacgtatgaggaggtaaatgcggaacgtagtcgaattgatgagcgttactaccgtaagctgaaagtgagtgattggctgagcaaagcggaggaatggaaggggataaaatcggtgttggaggtgtgtcgcaagcggtcagataatggcaaagaatcacaagaaaaagtcttttatatcagtagtttggatgttgatattcaaatattggcgaagtgcgtgcgagggcattgggaagtggaaaacaaagcccattgggtgctagatgtggtctataaagaagacgaatgtgctgtgaccgatgaatggggtgcggaaaatctggcaattttgcgtcgattagcgttgaacttggctcgattgcacccgaaaaagcagagtatgaaagggaaattgaccgctgctggttggtcagatgaatttcgagatgagctgttgctcggcgtgtagattgaaaaatggacaacatatgcggttgccctgaattctgtgtaaacacccatttcaacttaacggtgatcgtctaagcgatcaccaaaatcaatcataaatcgattcatcgccagtttccagttctgaatcggcattgtccatttttttggtgcatctttaatcgcaagccaaatcactttgaaaacggaatcatccgtcgggaatacatttcgttttttaatcacgcgacgaatcacgctattaagcgattccacggcattcgtggtataaatcgctttacgaatgtcagccggataatcaaaaaatgtggcaatatttgcccagttatcttcccagcctttcgccacaagcgggtattttgcctgccatttttgcgaaagtgcggtcagattttcgcgagcctgtgcttccgtcgaggcctgataaacctgctttaaatctgcggtgacggctttgtaatctttccacgaaacgaatttcaaagctgttacgcactaaatgcacaatgcaaagctgaatcttcgttttaggatagactgcattgatggcttctgggaagccttttaaaccgtctacacaggcaataaaaatgtcttttaagcctcgattttgaagctctgtcagcacatttgcccagaacttcgcaccttcattttcagcaatccaatcacggtcacgaggcgtctcaatttctatctcaccttcatcacaaatgacggtcttagatgtgtaaccgttacgtgcatttttaccttttctaggctgatgtttttcataaccaagatggtcggtcagttcaccatttaacgcagcctcgacggtgattttcttgagcatccgtgaaaattgattgaggtcttctggtgtttttaggtttttggcaaattccgctgccaaggcgtgaagttgtttttcgttcataataaaatacctgtgtctgaatgtattatctcagaaacaggtatttacacaaattgtgggagaggctcgccaatgcggctgctcagccattccctgcaaatattgcagcgatggcaacagtagcatctgaaactgcaagcattatttccactattcaatctgtttcattaagcggtatggctcactctggtattgatagcataccaaaagaaggaacgtggttgcttgatcgtggtgagcgagttgttgatagtcgtactaaccaagatttaaaagcctttttagcaaatcaaggaaaccgaaatcaagcatcgggtaaatcatctgtaaatgttcaaatcatcaacaatggtaatgcggtagatgccaaagtttctcaagaagaaacgccagatggaactcacatcacagtggaattgttaaaaacaatgagaggaatcgcaagagaagaaagtcagaatgcgatcaccaataatttcgctcgtgcgggtggtcaatttagacgataggagtatgtaatgccaaaatccctaccccaaaaaatggcaaacgaactgccaaaactggaacaaaatgccttgattgaactgtgggaaattgatttaaggcatatcagcagtaatagcgaccaaacacgaaaaggggagttgttacgctttcacaatggcttaaatcaaggtcagcagaatgtttggtggcaaggtaacgagtaccaagcctatccaattaatgcggacggttttgagattagcggtcaagggccgagtaaccgaccgactttaacaatctcaaacctgtacggcattgtcaccgctttagccgcagatttcggacaagggattggggcgaaagtgacacgtcgtttagtttacgcccaattccttgatgctcgcaattttcctaacggacgaaactcacaagccgatccgacacaggaaagtgtcagtttattcattattgaacagctaaaaatcctcaatgatgaagtggcgacctttgagctggctttacccgcagaaacagataatgcacgtattccgttgctgatgattacgtctgatacttgcatttggccatatcgttctgcggagtgtggctacacaggcggaccggttgccgatgaaaaagataatccgacaaccgatccgaaaaaagatgcttgctctcactgtttgcgtggttgcaagctgagattcggggctaacgccattttaccgtttggtggctttccaagtacgacgcagtatggggcttaagcaaatagcggttctatgtgaaatgtagcacgctgttctaattgccacaaatcaaaatctgcttgcatacctaaccataattttggtgtggtattaggcaatagctgacttaaacggagtgccatttcaggggtaatcgctgatttttcattgataatacgagatagacagacacgagtgacaccaagttgtttagcaatttgagtaatgctagtatcggcattatctaggtattcttttagcaacaagcctggatgtggtgggttaaacattctcattcttcagctccttaatgataatcttgataatccacaatttctgcgtgaccgttttcaaatttaaaggttaaacgccagtttttattgactttgacactccaatgcccaacaagattaccttgtaatgggtgtaaatcccaactagggaagttcattgcagaaacagtttcagcgttctctagtgtcgcaagttgaagacgcaatttagaagcgtgattagcttgaatacctgctgttgaacctgtttcaaaaaatagctttaagcctttatgtttaaacgagagaatcattgtggttatcctttttgtatacagtaagtatacacttaaatcttaacttgtaaataggttgtatacaataatgcaaaatatctcttttacagaacaaattttatatcacgccaaacgctcagaaccgcacgaaagttgcggttttgtcgtttctaagggcggtgagttgcgttatttcccttgtgaaaatgttgctgtcgatccgattaatcactttgaaatctcgcctgatgattggattcgggcggaaagtgtgggtgagattgtagctgtcgttcattcgcaccctgattctgaaaacgaaaagggcttgccgtatttatcgacggctgaccgtgaatgccaagtgcggttaaatttgccgttttggttggtgtgtagtggcaagttgcaaaaattccgcccaatctagagatattagatttaaatagtttacaccaggcattacaaattgatataaaccgttatatttcatttttggatcaaaagcctaacatattagaaaaaatagatgctgataattcagaggaagaaataattgagcgaccaatttatctaagttttgtaagtccacaaagtcaatctataacaacagggtattttgcagaggctttttcctacacccagggtataacgcctagcaaggctgttgaattacttcacagtaccattattgatgaatttagaaaaaatgaacaactaaaacatcataaaactctcgaaaaattatcgatttctttagatcgattttatgaaacctataaaaataaagtgatcaaacttgaggatataaaagctgttattattcaggctattcctactcagttacaccatcaagcaacccgtattgcgaataaaattatcaacaaattaaatggagaaagtcacttgatttgtcccaatgattgccttggctacgctaatagcatatctcattttaacagatcctcataatctgacgacttgccaataaaaaactatgatatagggaataaggctctgttgtgtacaattattcttttaaatcaagtaaattgtgatttacctctcattttttaggtttataccttgtcatttggtcgagaaagttttactctatggagtatattttcttttatgctattttttatggagtaatcttttcatttaatgtgcggtgaaacattaggaggctatatgttattaggtgatctttctcgtgatgattatattctttcacttccgcctgtctttgcaagactatgtactaaacttaaaacccttgatttagttaatctgccattaggttggcaagatttggaagagggagtaagaatgaatgtgatggaatttgaaacctcttccccagaaggaaaaaaagcggagctccatcgtaaatttattgatattcaattgttgatctcaggtgaagaggcgattgaatatagtttagcctatcctaacttagcactttatgatgaatatcgtgatgaggacgattatcagcttacaccaaccttagaacataaaaatgttgtaattttaaaacctaatatgtttgctattttcttaccttatgagccacacacaccaggcaattttgtgaccgaaagtaagccattgaaaaaattagtggtgaaagtgccagtggagatgataggaggctagaatgtcagcccgaggtaaaattctagatacgattggtgcgttacaaaatagtttaactaaaacagagaaaaaaattgcgacggtgattttatctcagcccgatctattgaaccaatgttctttatctaaagtggcaaatcaattagatgtcggcgaagcaacctttattcgtttttgtcgaacattgggatttaaaggttatacagactttaaactcgatcttgccattgaattggctactcagcaaaaagagagtagtacgttgttagatacgtacgttgcggaaactgatacacctaaagaaattgcaattaagttgcagaatacgctgaataatgtgattgcagaaaccgtcaatctactcgattatgcagagctagaaaaagtggtggaagaattgcgtaaagcagatcgtattttcttatttggtgtaggttcatcaggtctaacagcagaagacgctcagcacaaattaatgcgaattgggctacacgcggctgctgtgacaaataaccattttatgtatatgcaagcagccttgctgaaaaaaggagacattgttattggcattagccattctggttattcagaagaaacgacaaaagccctaaaaatatcaagagacaatggggcaaaaacggttgctattacccataatttacgttcgcctattacgaaagaagcggattatgtgttaatcaatggtaaccgtcaggggcatatgcagggggattcaattggtacaaaaatgacccaactttttgtactggatttaatttatgccttgttagtgaaagctgaaccagaaaaagcgattcaacaaaaacagaaaacgttgagtgttattttagatcaacggcttaagtagtttacaagcggtcagtttgatagtttttttgtgaaacagaccgctatcatttatctatactttactttaataaggaaacccatatgaaaaatttaaaaggtattttcagtgcattattagtttcttttaatgcagatggcacaatcaacgaaaaaggtttacgccaaattatccgttacaatatcgacaaaatggaagtcgatggcttgtatgtaggtggttcaacaggtgaaaactttatgctatcaacggaagagaaaaaagagatctttcgtatcgcaaaagatgaagcgaaagatgacattgcattaatcgctcaagtcggtagcgtaaacttaaaagaagcggtagaacttggtaaatatgcaacagaattaggctatgacagcttatctgcagtaacaccattctactacaaattcagcttcccagaaatcaaaaacctctacgaaaccattattcgtgaaacaggtaacaaaatgattgtttactctatcccattcttaacaggggtaaacatcggcgtttcacaatttgcagaactgttccaaaatgaaaaaatcattggtgtaaaattcaccgcaggcgatttctacctgttagaacgtttacgcaaagcgttcccgaaccacttaatctatgcaggttttgatgagatgatgttacctgcaaccgtattaggtgtagatggtgcaatcggtagtaccttcaacgtcaacggtatccgtgctcgtcaaatttttgaattagcccaacaaggcaaaatcaaagaagcgcttgaaattcaaaatgtgactaacgatttaatcgaaggcattttgggtaatggtttatatcaaaccatcaaaggcttattgaaagaagaaggcgtacaagcaggttactgccgtgagccaatgacgaaagaattgaatgcacaacaaaaagcggttgtgaaagaattaaaagcaaaatatctttcataagtaaccctcctataaatattgatagtttttgtagaagatcagaattgatcttctacaaatgtttcatttactttttagcccttccgcacaagcaaatgccgacgaccacgcccattggaagttataaccaccaagccagcctgtcacatcaagcacttcaccgataaaatataaaccctgaacgtttttcgcttccattgttttggacgaaatataatcggtatcaaccccacccattgtgacttcagctgtgcggtagccttcagtaccattaggtaaaaactgccagtgatgaataaagtgatctaaaaaggcaagatcagctttgttcagttcagcgataatctgatctttgatcatctgttgctcaatccacagttcgactagttttttcggtaaatagcgggataatacagtttttaactgcaatttcggcgaagattgacgcagttcgttcaaaatatcaaggatagaggcggacggaagtaaatcaatttccaccgtttcacccaaatcccagtagtttgaaatttgtagaatagcaggcccagataatccacgatgggtaaacaacatctgattgctaaaggttttattacggttgcttacgctaacgggtaaagcgataccggataaggtggcaaaaatcttatcgttttctttccaagtaaacggcacaaggcttgcacgaacagggataacgggaataccaaactgctcggcaattttataacctaatgggcttgcccctaagccagccattgacaaaccgcctgtagcaataatcagattttccgtctgatagctttcgcaagcggtctgaatgtggaaaaaatttgcagatttttcgatggaactaaccgcttgtcgaagccgaatatctacgttgcctttctcacattcggcttgtaacagatcgacaatctgttgcgagctttcatcacagaacagttgccccaactctttttcgtgataacagatgccatagcttgccaccagcgaaataaaatcccagttggtatagcgagccagtgctgacttgacgaaatgtcgattttggcaaatataatggttgggggtgacatctagattggtaaaattacaaaagccaccgcccgacattaaaatcttccgcccgatttttttgccgttatctagcaccagtaccgattttcccccttgcccgagctgtgccgcacaaaataaacctgctgctccagccccaatgatgattgcatcaaattgtttcatatcgccctttttattcaaaaaatcctttataaacataatcttatgctttttcgttaatccgctatgaagcgataatttctgtttcagttctttaaataacccttccaacctatttgttgttttttctatatttaaatgagtatattcttcaaaagtgagcttaaagccttgtactataaggctttagcccactttttaccaacacttttgtctactatgccaaatatcctatctaaatcaccgctttcattagatttccgcctattatttctaacttttattgataaaagttgaaaaattcttgttattttatctttagttttgtgtgacccatttgtttttttttttttttacaatggagtgggggcaggtgtttttgagattcccccacttgtgggggaagtagcttgtagggtgggtcttgacccaccatgtagccgtaacatattgattttattggtgggttaaaacccaccctacaatattcaatccatctaatatatggtttgtcaaggatctaacttcccccacttatgggggaagtagcttgtagggtgggtcttgacccaccatgtagccgtaacatattgattttattggtgggttaaaacccgccctacaatattcaatccatctaatatatggtttgtcaaggagttaacttcccccgcaagcgggggaagtgcccgagcgaaagcgagggcgatgggggcatttgtgcatcctgaaaatgtaaataaaggtttatgattttttattaggaaaagcagtagagaaggttattttattatgaataaaatatttagagttatttggagtcatgttcaacaggcttgggtggttgtatctgagttagtaaagtctcacaccaaaacatccacttacacggataaaagagctcaagtatgcacctcagattattttttagataaacagcaagataaatttaaattaagttttttaagtctagtattactaagtatattttttagtccagtaggtttagctgcatattttgaagatggttctggacccggaaggaaggaaaaggctgacgagggtactattggtattggtaaagatagtaacgttgggcctggttctattgccatcggtcggtacgcaaaagctgaaggtaggactagtattgcgataggttatcaagctgaagcagtccttttcgaacccaatgccgtagtcgttggggcaactgcacaagcattcggttattctgcggcttatggttatggagcacgagcacgagcaataggcgctgttgcagtcggtgaaaatgctattgcaaatcaaaatagaggcactgcattgggtaacaattcatctgttaacgttttaggtggtgttgcattgggttattactctaaagcagatacggaagggggtattgaaggagcaaaacaaactttttctgtgacagaggaagcaagcactgttgagaatggatttaaatccacagaaagtgctaataataatcggattggtgcggtttctgttggtagcaatacttttagaaaggatggtagtagcataatcaaacgccaaatcgtcaacgttgcggcaggtaaagaattaaccgatgcagtaaacgtggcacagcttcaatcgctcaccatgcaaataggaggcgataacggcagtagtggcaaggtaggcatttggagtggtacgctcaacgtaaaaggagaaaatggtattacttcccaggctcagggcagtacgattacggttagattagaggacgaactcaaaaataaaattgataggattgccgctatgggtaagttaattcaaagtgcggaaaaagaagcagatggcaatctaaaaattacctatacagatggtacgcatagcattatcgagaaaggtgaaaaaggagatcgtggtgaaactggccctgcgggtccaacggggccacgaggccctgcgggtgagcgaggccctgcaggtgaaactggtccagcgggagagcgaggccagcagggtcctaggggggaacaaggtgcacctggtccaacgggtcctaggggtgagcgaggtattcaaggacctgcgggtgagcgaggagaaataggccctgcaggtgcagctggtcctagggggccagagggtccgaaaggtgatacaggtgagagaggtgcaactggccctgcgggtccagtaggtccaattggaccacaaggtgaaactggtcctaagggggataaaggcgaacaaggtctaagaggtgaacaaggccctgcgggtgagcgaggagaaataggccctgcgggtccagtaggtccagcgggagagccaggcaagcaggggcctaggggggataaaggcgaaactggccctgcgggtccagcaggaccacgaggtgcacctggtcctgcgggtccagcaggggctaagggtgaccgaggagaaacaggcccagcgggtccagcaggaccacgaggaccgcagggtgaccgaggagaaactggccctgagggtcctaaaggagatgcaggtcctagaggtgaaacaggccctgcgggtccagtgggtccagcaggtgctcaaggtccagcaggtccagcaggtgcaactggcccagcgggtccagcaggtgcaactggcccagcgggtccagcaggtcctgcgggtccagtaggtcctagaggcgaaacaggtcctaggggtgagaaaggtgatacgggtcaaacggggccagcaggggctgctggtccagcaggaccacaaggtgcaacaggaccacaaggcccagcgggagagcgaggcgagcagggtcctaggggagataaaggtgaaactggccctgcgggtccagtaggtccagctggaccacaaggaccgcaaggaataccgggtgctcagggacctaagggggataaaggcgatccaggacaagcgggtcctaaaggagaaaaaggagatacaggtcctagaggtgaaactggtcctgcgggtccagcaggggctaagggtgaacagggtcctagaggcgaacaagggcttccaggggtagcaggtcctaagggcgatagaggcgaagctggccctgcgggtccagtaggtccagctggaccacaaggaccgcagggaacagcgggtgctcagggacagaagggggataaaggcgatccaggacctgcgggtcctaaaggagaaaaaggagatacaggtcctagaggcgaagctggtcctgcaggtccaaaaggagaggcaggagcagtgggccctcaaggtcctgcgggtgcaactggtcctaagggggataaaggcgatccaggacaagcgggtcctaaaggagaaaaaggagatacaggtcctagaggtgaaactggccctgcgggtccagcgggacctaagggtgacaaaggtgatacgggtccagcaggatcacaaggacctacgggtccaactggaaattcggaattaaaaggcattacgtcgattgccaatggtaacgacgccaccaaggcgaatggggctaagattaccttgtctgcaggttctacagataaaacagttaatgttaatgatgcgaaaattaccaatgtggcggctggtacagcagataccgatgcggtgaatgtgaaacagttgaaatctgcgaaaactgaagtggaatctaccgatcacagtgtggtgattaaagagcgtcagggcgataatcagcaaatcgtgtatgatttggcggttgctaaaacgaaactcactgcctctaaggataaacgcaccattagtgcagcagataaaggcaaccattttgcgacaggagatgaagtcgcagtagcaattaataccgcaacagcagccgtaagaactgaagttgaagcgggtaaaaatgtgaaagtgacttcaaaaacgggggcaaatggtcagaatatttacaatgtgagcgtgtctggagatttaagcgacattacttcaattagtaatggcgatacgaaagtatctttaggtaaagataagcaaggaaatccagttgtaaatatgaatggtgccagaattaccaacgttggagatggtagtgctgagggcgatattgtgaatgttcgtcagctcaacaaagtggtttcttctgtgaatacaggatttaatcaattatcaagagatattgttaatgcaagagcgggtattgcttctgctggggcgatggctaatttgccacaaatttatttaccaggtaaaagtgctatttctgtttctaatgcacaatatcgcgggcaatctgcctatgctataggttattccagaacttctgataatggcaaatggcttattcgagcgtctgttagcagtaatactcagcgggatactatgattggaggaggggtaagttttgtgtggtaatctagcacctataaattagaatttcatgctcaatgccattgttattttaacaatggcattaatatctattggatttaatttatttgtggaagaaaaggttttatgacaggatgaacaaaagtacctctgaatattatttttctttccatgcttttggatattgttcttaaggcaaaaaggacagttttttgttcacattttaaaaagtgggcttaaagccttgtactataaggctttagcccacttttttaccaacacttttgtctactatgccagaaacagggtatcatcacctatcaagtacttgaattattaatgccgatctcaaccgcatttattgcttatctgctcctaggtgaaaccatttcatcaatgcaacttgtgtttgcagggattgtgattgttggggcgagtatggcattggggttattacattaaaggaaaagagagagtaaattatattattctctcctgaaaaactacgagcatagcagacaaaaataattaaagtataaaggcttgtctactatgcatttaaaattaaagtacttttacaatcgcttcacacaatgcgtcgatattatcttcggtaatacctgccacattgatacggcctgaacgcactgcataaatcgcaaattcatcgcgtaaacgatccacttgttcaggggttaagccactaaacgagaacataccgttttgtgcaatgataaaatcgaagttttgagttgcacctttctctttcaacaatgccacaaattttgcacgcatctctttgatacggttacgcatttcagccagttcttcaatccagttagcttttaattgtggatcagctaacactgtcgcaacggcacttgccccgtgtgaagatgggttagagtagagtacacgaataatcgattttacttggctgaacgcattatttgccacttctgcactatctgcaactaaggtaaatgccccaacacgctcattgtataaaccaaagtttttagaataagagcttgccactaacacttcacggtgatttttcacgaaggtgcgtaagccaaaggcatcttcttctaagccgtttgcaaagccttgataagcaaagtcaaataatggtaaccagcctttttccgcagacatattggctagggtttgccactgttctggagttgggtcaatccctgttgggttgtgacagcaaccgtggaaaagcacgacatcgcctttacctgcttggcttaaatctgcaataagattatcccaatctaatgctttagtttctttattgtagtaacgatattctttaatattgatacccactgcgttgaaaattgcattgtggtttggccaagttggggttgaaatccatacgttttgcgtattggtttggcgtttaacaaattctgccgcaatgcgtaacgcaccagtaccgccaaggctttgtgccgttttagcacgtccagaggtaattacttccgcacctgccccgaataataactcttgggtttgtgcattgaaatcagcaataccgtcaatcgttaagtaatttttggtattctctttagccagtaaacgcgtttctgcttcttttaccgctttaacgataggcgtttgccccttcgcatctttataaaccccaatccctaagttgattttctcagggcgagtttctgctttaaatgcttcgcctaaacctaaaattggatcggctggtgctgcttgaatgtggttaaacattgacatagttttccttttaatatgtgtttgcaaataggtggatttatacgaggatttataccttttggcaaggggcaagcggtgatttttagtaaattatttgcgaatagaataaaaatgtaaatattccaagctacgatattctttttacagtttgaacaagcagaaataaattagcacacaatcatcacttgaatgtgagataaattgctctataatgttgcacaaagtaacactgagagaggtagttatgcaagcgacattaagacaacaaggtggagccgctgtcttgactgtaccaatggcaatattgcaacaaatggggtggcaaattggtcataaagtcaatttggagacaaggggagaaagtgtcatactcacccctattaagcgtcaagcacgaggtcgtaagacagttgcagaattgttagcaggtattgatagtcaagaaattgcggagttgaacacaacagtggcagaatttacccaatctcaacccactgggaaagaagtatggtaatgcgtgttccgaaaaaaggagagatttggtatgttgatccagatccaacgaaaggtcacgagcttcgctttccccattatttcattgtggtatcagacgaattattgaatcaagcattaggcacagcaatttgttgcccaatatctacgggtggcaatgcggctcgttcgcagaatgtaaccgttgtgcttgatggtagtagtacagaatcaggtaaggtaacaggtgttattttatgtcaccaagtaagagccttagatttaaaagaacgccaagctaagtatgcgactaaagcagaggattatttaattgacgaagtcattatgaaattagttgacttaattgatccacaataaaacatctagggctattttacatatgtatttttatataattttatgttttaatacgctcaattttctcaacacaattaaggtgtaacaatgagctggattgaaaaaattttaggaaaaacgtcctcatcatcaagtggtaaatcaaaaattccagaaggcgtttggacaaaatgtacaagctgtgaacaggttctttatagtgaagaacttaaacgcaatatgcaagtttgcccaaaatgcgatcatcatatgcgtattgatgcgcgtacacgtttattatcccttttagaccaagatactgctgaagaattagcggcagagcttgaaccacaagatgtgttgaagtttaaagatctgaaaaaatataaagatcgtttaagtgcggctcaaaagcaaacgggtgaaaaagactctttcatcgtaatgtatggcaagttgtatgatatgcctgtggttgttgcttcctttaactttgagtttatgggcggttcaatgggatctgtcgctggagcaaaatttgttcgtgcggcagaaaaagcattaagcgagaatattccgtttatctgtttctctgcgtcaggcggggctcgtatgcaggaagcattattttcattaatgcaaatggcaaaaaccagtgcggtgttggcaaaaatgaaagaaaaaggcgtgccgtttatctctgttttaacagacccaaccttaggtggcgtatcggcaagtttggcaatgttaggcgatattaatattgcagagcctaaagccttgatcggttttgcaggtccgcgtgtgattgaacaaactgtgcgtgagaaattgcctgaaggcttccaacgtagtgagttcttaatggaaaaaggggcgattgatatgatcgtacaccgcaaagagatgcgtgatacccttgctcgtttacttgcgaaaattactcatcagccgacgccatttaaaacgggcgaacttgttgcagaagaagtgtaatgaacgcattaatttcaccaaaagccacggattcattggaaacgtggctttcctatttagaaaaaagccatttcaaaccgattgatatgggcttggaacgtatccgaaaagtcgcggaagaattggatttactcaagccagccccttatgtgattaccgttgcaggtacaaacggcaaaggttcaacctgcaaattgctagaaatggcgttattaaaagcaggtttaaaggtcggggtctattcatcaccacacttaatccactataacgaacgtgtgcgtattcaaggacaagcggtcggaaatgctgatttaattacaacttttgactatattgaacagcacaaatcagcctctttaacctattttgagttcggtactttagcagcgttagatctgttccgtaaggcaaagattgatgtagcgattttggaagtaggattaggtgggcgtttagatgccacaaacattgtcgatcctgattttgcggtaatcacttcgattgatattgaccacgttgagtttttaggcgataaccgtgaagcgataggtcgtgaaaaagcagggattttccgtccaaatattcctgtggttattggcgagcctgattgcccccaaagtatcttagactatgcaaaagagttgcaatgtcacgtttttagacgagatatagattggacattttcagcagaatctgaccgcttgcaatggcaatcgaaaaccaaatctttaactgttccactgcctaaaattccacagacaaactgtgccacagctttggcggttttaacccagttaccttttgaactcagtgatgaaattcttgttcaagcggttgcagaggcacagatgacagcgcgttttcaattattaggcgaacaagattttgcaactttttcacaaaatagaccgcttgcacaggtgattattgacgttggacataacccccacgcagcacgttatttagcggatcgtcttgcagaatgggttcaacctaaccgcaaaatatatgcagtattcagtgccttagtggataaagatttatcgggtatcgttgagcctttggaagagttgattgacgaatggtattgtgctgggctacaaggttatcgtgggcagagtggtgcagaggtaaaaaataaattacttactgccttaccaaacgccaaagccgttgcctatgaaaatgttattgaagcaagccaagttctttttgaaacagcgagcgaacaagacattattcttgtgtttggttcatttcatactgttgcagattttgtgatgtggattgaacagtaggatatgaaaaacggtaagtttggcgacttaccgttctgttcatttactttttactagaatgttcagccattttacgtctaatttctcgacgttctttagaaagttcagcattacggatagcataatcatcaactcggttttcatagtcatctctcatgttacctatgattacacgtatgtcttggatagacatattgtcagtaatgtactgatttagattatcaagtaataaaatacgcttttgattatcacggattttgcgatcattatctgctgtttcacgtaataatttattttttaaacgataaagatgcacataatctagcatatcttgaaatgattgttttttgctattttccatctatagttcctctattttgataaaagattcctgttatgctagacgttttatactctatcgtcaaaaggtttatataaaaattttcaagaagttgctctaaatcaatcctaagtaaaggatacagggcaaccgcatatgttgtccatttttcaacctacacaccgagcaacagctcatctcgaaattcatctgaccaaccagcagcggtcaatttccctttcatactctgctttttcgggtgcaatcgagccaagttcaacgctaatcgacgcaaaattgccagattttccgcaccccattcatcggtcacagcacattcgtcttctttatagaccacatctagcacccaatgggctttgttttccacttcccaatgccctcgcacgcacttcgccaatatttgaacatcaacatccaaactactgatataaaagactttttcttgtgattctttgccattatctgaccgcttgcgacacacctccaaccaccgattttatccccttccattcctccgctttgctcagccaatcactcactttcagcttacggtagtaacgctcatcaattcgactacgttccgcatttacctcctcatacgtctcaagcatttcggggcaatctcggcggattttgtgaaaatacgcctccacttccgactgaaattgacggtgatttttcttcaacggcatcacataatcccctttcttttcgatgattttctccgcaattttcttctgtgtattcatcgcatccaccgttataacggcattttttaagcaaaaactatcgataatttccatcaccgcctgctgctcattttgcttacccgaggattttttctgcgataaaatcaaaccacgagactggctccacaccgtcacactgtgcaaagcactttgggtttccggattgaaactatgacgaagtgtcttgccatcaatcgcaatcacttcacgtccttgttgtgtgcgtatctcattgataaaattaagaaaaacctcattaaatgcttgtggctcaatgcgttttattacacgggcgatagtatcatcgacaggaataccacactcaaaaggacgatattttcgcaaccaatccaaatgtaattcgccaaaaagtttgatttcagtccagctgtttgcccccgacatcacggcactgacgacgagaaaaacgatgtctaaaaagtggtgtttttgattataggctcgtgggtcggataaattttcaaaaaaacgaaaaacgctcattttacaacctgatttgatatggataattaaggtgtattagatcataaatttgagaaagatgcgatcttgccctggtaaaggatattggataagaaaaatagcactgttatttaacagataatctatgctaaaatcggaagatcgaatattgagaaaatttaaatattgggagaaataaatgatgagtgcaaataaacgttctgttccgacgcttttttctactaaaacagatatttatagtcatcaagtgcgtatcgttttagctgaaaaaggcgttgcttatgaaattgaaaatattttaccaggcacaatttcggaagatttaattgaagtcaatcctagaggtactgtgccagtgttggttgatcgtgatctcatattatcaaatgcacgaatcattatggaatatcttgatgaacgatttcctcacccgccattaatgcctgtttatcctatactgagagctcaatgtcgtttaaatatacatcgtattcaaaatgattggttctctttaattgattttattgaacgtgatccaactacagctgaagctcaaagagcattaaatcagctacgcgaagaagtattagcattaggtccagtattttcagattctgattattttttgagtgaagattttagtctagttgattgctatgtagcccctttattgtggagaatgaatactctaggtgtagaatttaatggggcaggctcaaaagcggttaaagcatatatgaatagagtttttaaacgagatagctttgtgcaatctattggaggtagtacacccaaaaatttaatggatgataaagactgatatgaaacctttaagaccttatttataccaagcctattataattggattttagataatgaaaataccccatatttattaataaattcggagtacgtagatacagatgttccccaagaatttgtgcgtgatggtaaaattatcttaaatatttctccccgctctataggacaatatgttgttactgatgaagcaattagtttcaatgcaagatttcagggaattgctcgtggagtttatattccattcggtgctgtcgaggctatttatgcacaggaaaatggtgacggtgtaatgtttcaagaagaagctttctatcaagaagacacatatttagatagagtaaatagagcgcagtcactcaaaaaagttactaagaaaaaatcatctcatttaaagttggttaaatgagttatctgagggggaagtagtgcattcccccttctgtctagtttaaaaaacaaacgtttattatattatttccttatttcgattaaaattttcttgcaatagtatattaatttttatatccttctccgcactactttaatagtacattaatacatcaagttaaattaaggaaattcatatgaaattgagaaaaacaattcttttttctgcacttgctgctttcgcatttaatgcatctgcacaagataaaatccataatgttgcaattactgcaattgtagagcatcctgcattagatactattcgacagggtgttattgaagaactcgctagagaaggctttgttgatggaaaaaatattagtattaatttccaatctgctcaaggtagtacatcaactgcagctcaaattgcacgtaaatttgtaggcgataaaacagatattattattcctatttcgacaccaagtgctcaacctgttgttgcagcaacacgttcaattcctattgtattttcaggtgtaacagatcctgtagctgccaagttgattaaatcttgggaaccaagtaaaacaaatgtaacgggcatttcagatcataaaccaattgaaccacaattggcactaatccaaaaactagtaccaaatattaaagctctcggatatgtttacagtgcaggagaggtaaattcagctgttgtgttagaagaattaaggaatgcaataagaggttctaatattgagattatgcctgtagctgtgcagcgtagtgcagatattggcacagctgctcgtagtttaagtggaaaggtgcaagctatttatattacagaagataatgctgtagtatctgcctatgaagcattacacaaagcagcacttgaagcaaaaattcctgttattgctgcggataaagacactgtaaaaagaggagctctagctgcttacgcagtgaatcaatatgatattggtgcagaaacaggtaaagttgcagcaaaaatcctcagaggcgaaaaagcaggtaatatcgcaacccagtctgtaagtaaaatggaattatccattaatcaaaaaacagcaagacaactgggactttcaataccagaatcattgcttcaagaggcaaaagaattattctaacatatcctaaagaataatatattgggctgtataactgacgtatttaaacggactgagtccagtagtaactggattcagtccttgaactagcagtttattttttactgagtcgcctgaattgccgttaatgcaatggtataaacaatatcatcaaccaaagcaccacgagataagtcattcacaggtttacgcataccttgtagcattggaccgatagacacgagatccgcagagcgttgaaccgctttataagttgtgttacctgtgttcaagtctgggaagacgaatacggtcgctttacctgcaacaggggagttaggcgctttagagcgagccacatcttccataattgccgcatcgtattgtaatggaccgtcaataataaggtctgggcgtttttctttcgcaatacgagttgcttcagctactttttctacgtctgcaccagcaccagaagttcctgttgagtaagaaatcattgcaacacgaggatcgataccgaatgattttgccgattcagccgattggatagctatttcggctaattgttcaggtgttggatctgggtttaccgcacagtcaccgtaaacaagtacttgatctggtaataacataaagaacacagatgaaataatagagttacctggtgctgttttgataatttgcattggtggacggattgtatttgcagtcgtgtgaactgcacctgaaactaagccatctacttcgtttgcttctaacatcattgtaccgagtacaacagtatctaacagctgttcacgagcaacaacctcagtcatacctttgtttttacgcaattcgactaaacgagctacatagttttcacgcacttcagctgggtcaataatggtaatgcctttgcctaaagtaaccccttgagcttcagcaacacgttgaacatccgcaggtggcgctaaaagtacacattctgcaatgccacgttccgcacagagtgcagccgctttaacggtacgaggctcatcaccttctggtaacacaatgcgttttttcgcttcacgcgcaagttcggttaattgataacggaatgcagcaggggagaggcgacgagcgcgaactgcaccttttgaaataccatcaataaagcctgcatcgaattgttctgagacatattgtttaatcgcatcaatacgttctttatcatctactggtacttcaaggctgaagctttgtaggcttaatgcagtttgccaagtgttgccttcaatacggaaaattggtaagccagtctcaaaggcttgttggcaaagtttggtaatttgagtatcaattttgtagccacccgttaagagtaatgcaccgatttccacgccgttcattgctgctaaagaagctgcaacgatgacatcaggacgatctgcagaagcgactaataaactgcccgctttaaagtgatcaaccatatgtggtaggcttcttgcacagaatgttacgctacgaatacggcgtttatgtacttcgccttcattaataattgccgcacctaagtgttttacaacatcaattgcacgggttgcaattaaatctgatttccacgcaatacaagctagtaatttgattggaccagctttgaacagattttccatttcaagaatgttattgctgctgtgttggaacgagtcgaagatttcggttaaatctgggcgtgtacgacctgactcatcaacaggggcattaaatttgttgataaccacaccgagtaggttagggttgtggcgaccaccaaataaagaaactgcagcatcaatacgctctttaagctgtgccggtttgtctgctgccggtgctgcaactaacacgatttcagcgtctaatgcttgtgcaatttcatagttaatgctatttgcgtaagagtttttacgcgttggaattaagccttccacaataacaatatcactgtttttggtgagtttttgatgacgctcaaccactttttcaagtaatacatcggtttggttttttgcaatcaatgtttccgcttcacttagcataaatggtgtgcctgtttcggtactttgtgaaaggcggataatagtggttgaacggtcaagggtatcttcaccactaataggttgtgcgataggttttaagaaaccaacttttgcccctttttgttcaagagaatggactaaaccaagacttacactggttaaaccaacgccggtactgattggaattaaaataattgttctggacattgtttttttccttgttacaagcgggtagagtagtcaaatattttgcaaaatctcaccgcttttgtgatgtaaaaagtaaaaaacctgccatctggcaggttttagatattataacgctaagcacgctgtatcttgtgcaataacaagttcttcgtttgttgggataacgaatgcacggaatgcagaatcagcagcagtaatttcgcctgatttaccaaaacgtgctgccgtatttttctcgctatcaactttaataccgaacagttttaagtaatttaaggttaattcacgcactaggcctgcgttttcaccgataccaccagtaaatacgattgcatctaagtgatcgtcacctaaaacagccatataagcaccgatgtatttcgctaaacggtagcagaaaccgtccattgcacgttttgcatctgcgtgagttgcgtagttatcttctgcataacggcagtcgcttgtcacttccgttaaacctaataagccagattttttcactaatgtttcttcaatttcttttacagacatacctaacgtattgtgcataaagaaaatgattgcagggtctaagtcacctgaacgagtacccattactaaaccttctaatggagtgaaacccattgaagtatcaatacatttaccattacggattgcagcaactgaagcaccgttacctaagtgacaagtaatcacgttcacttttgacggttcaacacccacaactttagcgacttcacggctcacataatagtggcttgtaccgtggaaaccatagcgacgtacgccgtgttctttatataaagagtatggaagagcatagagataagcgtgttcaggcattgtttggtggaatgctgtatcaaataccgcaacgtttttctcttttaattcagggaatgctttgaatgcttcttcaataccgattaagtgagcagggttgtgaagtggtgcaaatgctgcagcttctttgatacctgcaaccacttcatctgtaataacgatagatgaagtatatttttcaccaccgtgaacgatacggtgaccgatagcaccaatgctgtcttttaattctgcacttaaaatgtttttcacgatatagttaagtgcttcactgtgagccgcacctgcacctaaatctgctgcacctttctcaccatttaatttccatttaatacgagcgtcaactaaattaaagttttcagctaaacctgataatttttcatcaccagaaacaggatcaaggatagcgaattttaaagatgagctaccacagttaagaataagaatattttttgacattgtcgaaacacctatgtgataagaaaaaattaacacgttttgggtaaacgtgactgcgtgcctatgatacgccttttacacttgaaaataaattgatctcagtaaaaaagggaagagaaaaaagaaagaaaagtcttaaatttatccgcttaaatttgttatttaacataatatacgttatgcgaaattacctagattgcaattagccattgtctaagtctatcgcattatacacgtcatcaacgattttgacgtgcagaagcaacataatgtctgacttctcaaaacgttttgatttaccaaaaaccatagaaaaaatagaatcttccgacttgttgtttttctcttcaaccaagccacctaatacgattaaagaaccatcagaaagataaaccgttgaatccactaaacgttttaacaaagtcggggtattatttacgcctgtttgtgttttagtgaaatctgatagttccgacttgattttcaattttacgccttcgctagtgattgtcggtttaacatcaaaaattacccctgcagaacggtaatttatgtcacgagtaactgaaccatctctttgtactgtttgaccgcctaaagttggtacatctgaacctaccgtaaaattaccgctttcactgtccattacgcgtaaaataggcgaactcaccacattaaaatttgtgtcggtgtcaatcagcccaaaaacggcattgacattatttgcctttaaactcaccacattatcttgcatttccccaaagttgaaatttactgataattttgtgctaagtaagttagccaaaatttgaagccctgaattactgttgtttgtttgcttcacttctacaaggcgaccgataacaatcacttgtttcggtttggtgtctaattgcggcaacacgtttttgactttttgaatagttgcattatctgcgtgaactaataacacatcgcctttagtatttattgaagccttgaaattatctttatcaacacctgaacttgaatcaaggaagctcattaaattttcagatagatattcaatgccacgatatttcggtttatatacaaaactatatcctttcggcttcggttcttttttaggttgtggcttcggtggctcaacatatttcaaataatccacgccatttttgctataaactttaatattcatattgtcaaaataacgattaaaaaattcagatttatttacgtcatcattgatgaaaaaactgattttttcattcatttccaaaataataggatctaccatatacggctttttcaatacttcttcgtagatgatagggattgcttttttaatctctgtttgttctagcttgaatacatctgcattgactaatgaagatacaaagaaaaccattgaaaacattatttttctgaccatttttgaatctcctcgcccttctcttttttgattgtttgacctgaataaaacgtgacacggtagccatcaatatagcccgtcagcaagttaccttcatttgtgaaattggataaatattcataacgaataaccttatcatcacttaatatcactaaattattatcttgctttttcaaataaccaataattcgccatttttgcgatagtcctttgtctttatctttagctttattcggtttctgttcagaataaaactccctattttcattattgctatgaacggtcacattattaacagattctttttgtttaactgtattttctgccgatttaatttcagtctttgatatattttcatctgcttgtttatcagtgttttctgtctttcctgaaaattgatgatataaataaaatccacctgcaataatagtgaataaagcaaaacccatcttgaaaataaagcccgtgcttttcagcaaattgacccttttgtcgattctttgctctacccctgccccatcatagcttttgtacaaactaaaaatttcatcatcatatttcgcctgaatcgtctgaatgtgtgtggttttaaacagtcgcacgcctgaataaacgtctattttgtaacgtttagataatcccagggcgatgagttttgtcattttaaaagtcgattccacacggtctttaataaagcgtggaatattcgcaacagattgatttattactactaaatcggatgtctgccctttttcattcacaaaatgccgatgctctgcaataaatgaccgatggttatcgtgaatctttcctttttcgtcaaaaatacgccatatttcatctatgcagattaaatcgccattctttgcaatcgttggctctgttgcccctttatatgggaaaaagttaggcttcaaacaatcatcatcagtcactttcagaattgagcctaaagaagcgtaatcaatctgatctttctctttccgcttactattcaatctatccgcgtaatcaataaaattagattggctcacgccttcgatatttgtcactacagaacgaccacttagaaatgcgggcaaaatgacactttttacaacttcataagtctttccgcttcctggtgtgcctacatacgcatttattgccattcaaaaatctccttactaacgcccttgcttcgcttcggttgttcaaattttttagccgtcacaagaagaattcgatttgtgagaaatttaaaatcagtcttcgtaaatgacttcttgtaacggccaaaaaatttccgatttatcccatcaatggaacacgtctaatgatgaatcttgttatgtatgcagaacaaaccatctttagacccaaatcaattttgaacggctgtagaaaataaccgacatcattcgggatagagcctaatgatgctgcaagactgcttataacatctgaaccagccacccaatttattaaaacaggggtaaattcaagaacgatataaaacaacgcggtaaacataaaaaatttaggaacagcctttctaaaaataaaactaagtaattcaccaatcataaaaactccctaagcactaaacagcactctaaacgtaaggaaagaccatacggcaatcatcatcgcagagataattccagctaattgttcaaacacttggcaatgtgcatctatgttgatggctgaatcaaaaacctgaatagaaataacggggcaagtgcctgaaataggattgatatgcagacctgataaaagttgatttcgccagtcaataagcggttttaaaatatcgcctacaactggaatttcgggtaaatcatctttttcatcttccgcagatgttgtagtaccttctgcaacagcggtatttgtttgagaatttgagcctgctacttcgcctgctttctctccagttgctcctgcacccgttgcggtatctgttgaagtatttgaacctgaaccactacctgctccagtgtgtgtgccagtatttgcagaaccacctgatacgctcccaccagtatgagtaccaatcacgggcggttttgtatcatctttgctaccttctgctgtacccgttcttttaggaatggaatatgatgttcccgttgatattggtttatcaaaataggatgtgaatgagctaacaggctttgaaatatcactaacagaaacacccgagccaccacctttagacgcataaccgcttgcttttgcccctgcaactacattactagaatcaagtgaaaaagatgaatcaagtaaagatttagcttgcggtgataggtccaatgatggataggtaatattcggttgattagacgaattttggaatttgcgaagcgtgtattttattgagcctctcccacaatttgtgtaaataactgtttctgagataatacattcagacacaggtattttattatgaacgaaaaacaacttcacgccttggcagcggaatttgccaaaaacctaaaaacaccagaagacctcaatcaattttcacggatgctcaagaaaatcaccgtcgaggctgcgttaaatggtgaactgaccgaccatcttggttatgaaaaacatcagcctagaaaaggtaaaaatgcacgtaacggttacacatctaagaccgtcatttgtgatgaaggtgagatagaaattgagacgcctcgtgaccgtgattggattgctgaaaatgaaggtgcgaagttctgggcaaatgtgctgacagagcttcaaaatcgaggcttaaaagacatttttattgcctgtgtagacggtttaaaaggcttcccagaagccatcaatgcagtctatcctaaaacgaagattcagctttgcattgtgcatttagtgcgtaacagctttgaaattcgtttcgtggaaagattacaaagccgtcaccgcagatttaaagcaggtttatcaggcctcgacggaagcacaggctcgcgaaaatctgaccgcactttcgcaaaaatggcaggcaaaatacccgcttgtggcgaaaggctgggaagataactgggcaaatattgccacattttttgattatccggctgacattcgtaaagcgatttataccacgaatgccgtggaatcgcttaatagcgtgattcgtcgcgtgattaaaaaacgaaatgtattcccgacggatgattccgttttcaaagtgatttggcttgcgattaaagatgcaccaaaaaaatggacaatgccgattcagaactggaaactggcgatgaatcgatttatgattgattttggtgatcgcttagacgatcaccgttaagttgaaatgggtgtttacacagaattcagggcaaccgcatatgttgtccatttttcaatctacacgccgagcaacagctcatctcgaaattcatctgaccaaccagcagcggtcaatttccctttcatactctgctttttcgggtgcaatcgagccaagttcaacgctaatcgacgcaaaattgccagattttccgcaccccattcatcggtcacagcacattcgtcttctttatagaccacatctagcacccaatgggctttgttttccacttcccaatgccctcgcacgcacttcgccaatatttgaatatcaacatccaaactactgatataaaagactttttcttgtgattctttgccattatctgaccgcttgcgacacacctccaacaccgattttatccccttccattcctccgctttgctcagccaatcactcactttcagcttacggtagtaacgctcatcaattcgactacgttccgcatttacctcctcatacgtctcaagcatttcggggcaatctcggctgattttgtgaaaatacgcctccacttccgactgaaattgacggtgatttttcttcaacggcatcacataatcccctttcttttcgatgattttctccgcaattttcttctgtgtattcatcgcatccaccgttataacggcattttttaagcaaaaactatcgataatttccatcaccgcctgctgctcattttgcttacccgaggattttttctgcgataaaatcaaaccacgagactggctccacaccgtcacactgtgcaaagcactttgggtttccggattgaaactatgacgaagtgtcttgccatcaatcgcaatcacttcacgtccttgttgtgtgcgtatctcattgataaaattaagaaaaacctcattaaatgcttgtggctcaatgcgttttattacacgggcgatagtatcatcgacaggaataccacactcaaaaggacgatattttcgcaaccaatccaaatgtaattcgccaaaaagtttgatttcagtccagctgtttgcccccgacatcacggcactgacgacgagaaaaacgatgtctaaaaagtggtgtttttgattataggctcgtgggtcggataaattttcaaaaaaacgaaaaacgctcattttacaacctgatttgatatggataattaaggtgtattagatcataaatttgagaaagatgcgatcttgccctgagtgggtgaaaaacatcatgctgatgaaatggtaaaattcattgattttagcaacgatggctatacccgaaccaaccgcagaaaagccagcaacaacttaaaagataccgacaacgcccgcgaacgctatgacgaagtggtcaatttggtgcgttttggcaagtctaaattgaggttgtttagcgaaaaagagtattttgaaaataccatagacccaaaaatcctgaaaaaacaagccccaagtaacgaacatttgggaaaatagaagcccatttaacgcaagaattgcaacaggttaaatgggcggaatatagttgcagtgaattgtttcaagttgtgagtggtagtaagataaaaaataaaagtgagctgcctgaaataggtaattatccagtgtattcttcggataataatggggtggtgggttatacagatatgccaacatatatctgtgatgaaagcagaaaattttatgtggtttttggagaccatacacgaacttttaatattgcgactaaaagtttttccatattagacaatgtaaaggttttaaaacctttacaaagagttagtttaagacaactattgaccctatcccaaattctgtgtaaacacccatttcaacttaatggtgatcgtctaggcgatcaccaaaatcaatcataaatcgattcatcgccagtttccagttctgaatcggcattgtccatttttttgatgcatctttaatcgcaagccaaatcactttgaaactgaatcatccgtcgggaatacatttcgttttttaatcacgcgacgaatcacgctattaagcgattccacggcattcgtggtataaatcgctttacgaatgtcagccggataatcaaaaaatgtggcaatatttgcccagttatcttcccagcctttcgccacaagcgggtattttgcctgccatttttgcgaaagtgcggtcagattttcgcgagcctgtgcttccgtcggggcctgataaacctgctttaaatctgcggtgacggctttgtaatctttccacgaaacgaatttcaagctgttacgcactaaatgcacaatgcaaagctgaatcttcgttttaggatagactgcattgatggtcttctgggaagccttttaaaaccgtctacacaggcaataaaaatgtcttttaaagcctcgtattttagaagctctgtcagcacatttgcccagtaacttcgcaccttcattttcagcaactccaatcacggtcacgaggcgtctcaatttctatctcaccttcatcacaaatgacggtcttagatgtgtaaccgttacgtgcatttttaccttttctaggctgatgtttttcataaccaagatggtcggtcagtttcaccatttaacgcagcctcgacggtgattttcttgagcatccgtgaaaattgattgaggtcttctggtgtttttaggtttttggcaaattccgctgccaaggcgtgaagttgtttttcgttcataataaaatacctgtgtctgaatgtattatctcagaaacaggtatttacacaaattgtgggagaggctccaactattatttattatctcttcttggaaaaaagaaattcccgatttgggctatgctcgacattggaaaatagcaaaagaagtgaaattatctcttcccataaaacccaatgccaattcggacaaactcgcccagattgactttgattttatggaaaatttcatctcgcagctcgaggcgtatttattggttacaggtttaaaagattatacgcttaccgctgctgaacaacaggctcttgccgattttgaaaatggtaaagtggtttggggagaatataatcttgagaaattatttggtaaatctacaagaggcaaacgcttaaaaagtgcggatagaatagcaggagatttgccttttgtaaccgcaggagaagccgaaacaggcgtatccgcatttatcggtaatcaagtagaaatttttaaagccaatacaacgacaattgatatgtttggttctgccaaatatcgcaattacgattatggcggagatgatcatattgctgtagttcatactgaaaatctaaacaaatatgcggcgatttttatgacttcggcaatacataaatcatcttatacagggaaatttagctatgcacgaaatttttatgccaaagatgcggacgagctaaatatccagcttccaacctctaatcaacaacccgattacagctttatggaaattcttatttctgccgtgcaaaagttggtaattaaagatgtggtgcgttatgccgatagcaaaatcgcagccaccaaacaagtgattgaccgcttgatttttggggcaaatgtgatttgtccctaagttggttttgcaaatttctttttaaatcctaccgctttttagctatttatcgcttttctttcggttgcaacttttacataacatttgtccattattcaagtcagttttaccgccttgtgaccaaggagtaatatgatcagcttccatttcctctatcttgaatttaccattgcaatgtgggcaaatgccatcttgccgttcaaacattgtgcgtttatctttatctgtaaaggctcttaagctcaaataacgttcttcgccagttaaaatataagcataaatgccagatttcttgctaacttcgtcatcttccattagtgttttgattttagcttcaagtgtcgttgggtttagatccctgtctttatgagtgttatagaatagtccccattcaagccctttcatttccttgcggtagtttggaaaggtggtttttacccagttgatgactgattgaaaataattccataattttgtggcgtgttcatcgtgttgatgtaatgccatatagttttcaatacttttgtggggattgctttctttatcattttcagtgggataaatccattccaaaacagtttccaaaaattcttgacgaataggcgagcctttcacatatttatcgccaagacttgacgcaacacagcctgattttgaaaagtatcgtttagcgtcagttagccagctacctgcatatactgcatttctcaattcttgatcagtaagtttttcgcccgcaatattaatagttttaaaccacgccaatttttcactatccgttccttcgcattggtaaacggttaattcataatctaaaaaagtatttttctggtcttgagtgagattgtgaaaatattgatattctacggaaaaatcacctttcacaaattggcaaatagaaatagtgcgttgctgaccgtctaatacttcaaacgtgccatcttcacgttttacccaatacattatgttgagcggaaaatgtttcattacagtatcaataacggcatttctttgaacttctttatagacaaattcacgctgatatttagggcgaatatccaatttgccattataacctgttacaccattttcagctgtatccgagtagttttcaaccaaatcacggattttgatatgagttagttcaattttcatctttattcctttgcaaaatttggaggaaatattaccgcttgtgtttaataacaattcttacataggtaggctttccatttattgttccatccttgtccttaattaaaccgtgttctttaaatggaattttattgctaattctaaaatcgttagcacttaaaatttcaaattggtcaggattatatttatccataaatgttataggtacccccattgcaccttgataatcaaaaggaatatctttaactttatttacttcaattgcgtcgtaattatcatattttggatattcttcctctgagtaagctttatagagcaataattcttcgtggcgtttggcatggtctaaattggtaaaccaacaaatattccccaaactccgccatttttgtccagtttcatcttgccaataacgagttgctttttcttcgtaataatcaggtaccctaaacgccatatcgccgcttttattaccaagccaaattttattttctttaattaacttaaatgtttctttataggtaatcgcattttgattgccgacaatgacaaactttttctcatactccattaactgagcaacatattcacgaaatagggaaaaaggcggatttgttaccacaatatccgactgctttagaatttcgatacattcagggctacgaaaatcaccattttgttgcaatggaatacgttgaatatcttgaaagtcaattttgccatctgtgtttaaatctaattcacgatcaatttctaatttatacgttggctcattggcatcaaaatgtgttgcaattaattttttaataccaagatgttcaaaattcagtgcgaaatagcggaaaaaattactttcttcaggatcgtcacagttgcagaaaataattttgtctttgaagtgttgtgtgtaatggcgtaactcgttttcgatatcgacaagtcgtgtataaaactcatcatttttttcacggttagcgcgatgaagatttttattcccagccattatgccaccgcctttttgacgatagcacttgacaagagttgagtaaaatttaaactattttgcttgcttgcttgcttgcttgcttgcttgcttgcttgcttgcttgcgtagtgttgaacattattaaacctcttttcttactcaaaaattagagctgtattatagccagtttgtagggatatttcagtaatgttatcgacgttattttgcaaaaaagtgcggtagggttttgcgaagttttttcagtttgcaaatttcttttcaaatcccaccgcttacatctccctacaccccttaaaccaccctatccagcctcgtcttcacttctttccactgtggcatcatttgccccattaggcggtaaaaacgttcgctgtggttgtgttcggcgaagtggcagagttcgtgcaaaatcacataatcaatgcactctttcggggctttgattaggtgggggttaaggcatagtgagccttgaacggagcaacttccccaacgagttttcattgtgcgtaaacggatgtgagggtttgttgtgacccaaaaggtttgcggtagcagccaatttaaacgttcggcaaaaatctgtttggctttttgtcgataccagttatccaaacattgttgaacttgtcgtgccgttttttctcgcacagacacctccaactgcccacgccataagcggacttggttgggtttatttggcgtttcatatacctttaacagatattgtcgccctaggtagcggtggctttcgccgctgatatattgccgttcaacaagcggtgggttttgttgaaaaaattgcaactggtcggcaatccactgactttgtttgctgatggcaaaaatcagctcatttctgaccgcttgtggcggcgcataagcaatgatgtcgcccgtgggttgcacagttaggcgtagccgtttatatttggcattcttgattaagcgaacggtaaaatgctggtcgccataaggaatgataacccgatcaaacttatccatttgaacgcccaactcgcacaatttgtactatccgttcgacaatctctttggcttgtaacataccgctgccgttggcttggcagattttaaatatcatcggcagtaactgtttacgaatgtctttttccacttgttcaaggttgatggaatgttcgcttaaacagcgtaaaaccgcctgatcgatctcaaatgccaaatcaacccaaaagtcttcgccttgcgatagagtttcaggtaaaactgttttaaatacgccgaaataggcttgtgccgcatagttgccgccaaagcggtcgggaatatcaggcaatttacgttccgccatttgttcttcaaattctttaaacagcagatactgttttatcgggtggtcgaacaaggcttcagcttcttcaatggcttgttgcaataattcggaaaaacgggctttggcataaggatcgttctcaaaatcaatctcaaggctacgagcaatacgagagcgaattttatcggcttcgttgcgtgttttagtgtcgttccacgtttgatattccattttgcccatttattgaccgcataaatgccgtctgcttcttttacacctaaggcaacaacgtgcttaccgattaattgctcaacttgatgggcatattcgcgataatccacttgctcgccagcgtcctgttgtgccaaacggcgtagttgggcaaaaaaggcggcggtgtttttatataaagtgcggtcggcatcagtaaagtttttatcttgataaaaggtttctgattgcaacgccacttgcaaacagcggttaaaggcagttaaggctcggtaaaaatcatcgcgtattttgctgtttttatcgaaaaacagaccgcttgttgggtcgagttgcatagttggaatgagctggcggcgaagttgttcaagatccattttattttcaacctcggcaaatatcgcccaaagcacttgatacaaactcggcaaacgtagatattcgctttgcattgagcaataaagcccagccaaatcctcaatggcataaccgccttgtgttcggttggctaaatcttggtatttggcaatcgttgtgtctggctcttttaaaatgccccgataatccaccaacagtccgcactctttttgtttatgcaagcggtttacccgtgcaattgcttgaataaggttatgttgttttaacggcttatcaatatacaacaccgcattgctcggctcatcaaagcccgtgagtaacttatccaccacaattagcaaacgcaacggactgtcaggatcggcaaaacggcttaacgcttgctgagtataactttcttcatcgccctgcacgttggctgcccaccaacgcaccacttcatcacttgcctgtttgtcaagctgcgtatttccttcacggctgtcaggcggactgatcaccaccgcactttcaaacagcccgatctcgtccaaataccgctgataacgaattgctgtcgctttgctttcgcacgccagctgaccttttaaaagccttgcggaattttattcgccaaatgttccgcaatatctaaagcgattaaatgaatacggtcatcagcttgataaatctgccctttacgcgagaatttgcgttttaaatccgttttttgctcttcgtttaacgacttggtgatccgctcaaaccagttatcaatcgcctgttcattcactgacaattcagggatccgctcttcataaagcagtggcgttaccgctttatcttccaccgcacgttgcatcgtataagcgtgaatgattttgccaaatttttgtgtggtttcatcgtcttttaacaacggcgtgccagtaaaagcaacaaaagccgcactaggcaaggctcgccgcattgccatatgattttcaccaccttcgccgacaacgcacgctcttgcccaagataggaaatcgaacgttggctcaacacctcccgcaacaccacattcactgccttccccccacgataagctaaggcttgtttaggagaaagatactgccagccaagattgtgtaaaagcaaaatggctggaagtttggaggtgtgtttttcgagagggtgggggattgtagaaatcatcttactagcctaaattttcttaaatagattttcgattgcagtcatatcacgatcttttgataaaatttctaaatcattttctttagctgttgcaaagtgaaacatatcaaattgatacttttcaataacctttttacttccatttttttgatttgctttatccaaacgaaataaatttcgagctaaatcagcaatatcatcattaatatcaatggtctgaaatgcttttaaagcactttttaacatatttaatttttcaatattatcccattctacaccacgtaaaacttcataacgaattaatggtgtcaaaaataataaagtttcaggatcttcaagttttaatgctaaatcttgtaatacttccgattttttagttggatttgcatttggatccgctaaataaattaaataatttgtatctaataaataacctttcattatttagcctccaaattggctagttcttgttgaactaattttaacaaggtttgtttcgcttcttgctgcccttcttcttgagccctgttaatttttaactgatttaaatttacatcaaaagcatcatttaacaaatcaataaaagaaactttacttgggtaatcaataagttcagcatacacaacgccgtcatcttcacaacgtttcaaacggtaggcttcaccgtgatttaattgactaattacaatagatgaatgagtagtaataaaaaagattgttttagggaataaatcttttaataaaggaataatatttgcttgccacttattatgtaaatggctttctatttcatcaattaagactatacctggaacattcgcaatctgtagctcattcgtgaaataactgtatcctgcaataattgattggataatttttaaaatagaagtaaaaccgctggaaagctctgatatttcacgtttttgattttctatttttagaaaaactcgattatcgcctgatatttcaagaaaatctttatcaattctatgatctattttatgtaataaagataataacgttttaatttcaatctctcgattatcttctttagactgataaggatttgatgataaagcacgctgaacaatccattcttcaatattagaatccatattcaaatttttcagattttgcggatttccattaaaacttgtcaataaatactctaaataccctttttgtcttttagatttattacctaatttagaaacatttcctctttcatactcatagactttctcatttatcgcgccacgatgttgcgcagataaataaacgactggataagaatgcatagccaaaataaatgcataactatgattacctaaagaaaaaccatcattctcattaaaactgaaagaaatatcatcgatagtcgcagatttaaaaggaattaatgaatgttgtatataaaaatctgttttcattgcttgtttgttcgtaaatagcaacatagcaaacagactttctaaaaattttgtttttccaatcccattttccccaataaaagtataaacccgttgattaggaaataattccacttcaatcgtgccgacacctttgacttgttcaaaatgaaatttctttaaatgcaatgtattattcatctgctatgtcctcttcaaaacaaacatttcttagacaattttattgctttacaaaatgcaatcattcttagttagattaatattgagcattatcttttattatagcacatctgctaacttttccctagttaagtaaacgatattaataaagcacctctcacaacaccacattcaccgccttctccccacgataagctaaggcttgcttaggagaaagatactgccagccaaggttgtgtaacaacagaatggctgagagtttggaggtgtgtttttcgaggattgagagtgcgtaagacatatttttctcttatttagttgaaaataatttatctagctgccagtttaacggattattttgaatatattcacagatttcaatataggatttttcattcctaataatatgttcataatagcttcgttgccgcaatcttttattaaaataagcccaattattttctttcacatttctaatataatgattagtagtcattgttttaaaccattgaattattgaaaatagagaaggagatttatcattttcactgttttctatattcaaaataaaatgaatgtgatttggcataataacataatctaaacagtaaacataactgaaatgtttttctatttctttgtaccaatattcaatcatttttcctgcgtcatttaaaattgttttattttcatatatatcgcctaacaaacataatttgttattaatacatacagtaataaaataaaatccgttttgtgaataatcatatttttgcaaatgaataatttttctttgtggtttattcatactattgatttataccgtaagggcggaccgatgtgtccgcccaattaacatttcgagatattcggacggacacgcaggtccgcccctacaataatctctgcatcaacgcctttttctgctgtcggctattttcaagcagtttttcagtggtttgaatagcgttatcccacgttgaaagggtttcggcgatttggatttgttcttcaatagacggcaacttaagtgataatgctttaattgtcggtaaatttaagcctgcttttgcaccagcatcattcagagagttaatagttttattcattgtggctgatgaaagtacataagcaataaatttagcgtgagctttattcggatctattctgatcaatgctgtatgctgattgatatatgcttccccaaagttttcaggaataaatccgatttttcctaattctgtggtaatcgatattagaatatcatttgcttgtaatgatgtacgttttccatcagcagaatttgattgaatattgacaaattttaagtcatctaacaatagagtaataccatttctattgagattagtcattcggataaattttgctcccgtatcagagtaatattgagcccaatttctcgaaccactcgttaccgttattgcaatatctcttaatcgagcctctcccacaatttgtgtaaatatctgtttctgagataatacattcagacacaggtattttattatgaacgaaaaacaacttcacgccttggcagcggaatttgccaaaaacctaaaaacatcagcctagaaaaggtaaaaatgcacgtaacggttacacatctaagaccgtcatttgtaatgaatgtgagatagaaattgagacgcctcgtgaccgtgacggcacctttgaaccgcaacttatcaagaaaaatcaaacccgcatcacaggaatggatgagcagattattgccttatattccaaagggttaagtaatcaggaaatcgttgaaatgttcaaagaactctatgatgcggatgtgtcaagcagcctgatttctcgcgttaccgacgccgtgaaagaacgcgtaatggaatggcaaaatcgcccacttgatgcggtttatccaattgtttacctagattgtatcgtagtgaaagtacgccaagatggacgaattatcaacaaatccgtgtttgttgccttgggtgtgaatcttgaaggacataaagagttattggggctttggattgctgaaaatgaaggtgcgaagttctgggcaaatgtgctgacagagcttcaaaatcgaggcttaaaagacatttttattgcctgtgtagacggtttaaaaggcttcccagaagccatcaatgcagtctatcctaaaacgaagattcagctttgcattgtgcatttagtgcgtaacagcttgaaattcgtttcgtggaaagattacaaagccgtcaccgcagatttaaagcaggtttatcaggccccgacggaagcacaagctcgcgaaaatctgaccgcactttcgcaaaaatggcaggcaaaatacccgcttgtggcgaaaggctgggaagataactgggcaaatattgccacattttttgattatccggctgatattcgtaaagcgatttataccacgaatgccgtggaatcgcttaatagcgtgattcgtcgcgtgattaaaaaacgaaatgtattcccgacggatgattcagttttcaaagtgatttggcttgcgattaaagatgcatcaaaaaaatggacaatgccgattcagaactggaaactggcgatgaatcgatttatgattgattttggtgatcgcctagacgatcaccgttaagttgaaatgggtgtttacacagaatttgggatagggtcaatactggacaaaggtataatatccagcaatatctttgctgctagcaggtaaattcagctctttaggtgtcaatgctctccacccttgaggcacaccaatatcaattcggttaggatagaaacctccaaacaattttcctgcagaattcaaaattttatcgccaggaaaaaacataaaggatctagagtttgtatagattgctagcttttgactagtcaacattaattccattgatttttgcgtgctataatttttataatcaaaaacacccacagtgacccccacacaatatagaaatattatttaaaataattacttaaaatacaaagagatgtatctaatcttacctaagatactacgactcatggtactccttcatttagtaaaaatatagcaactttacatcacaaaacatttctttatgtttttatttacttagatcaatttctgtcaataatttattaccaaattgctctctccacccacacaataactcaggtaacttttgcctatcctgcccatttctataccatttaaacaactgatttaattgacgcttactcgccaacaactcaatcgccaaattttcaggacaaacttccgcaagacgcttttgcaaacgtttgaaagtagttttgtagccagcctcatcaaccaaacgacgaataacaggcggatagttctctggcaaaatttgcttacccagctcgactaaccacaaaattttcttaccgtgaatacgcacttcatttgggtgcataaattccaacaagattgaagtatgtttcggttgtaatttagcaatttgtaacaaactctgctctttaataataaaatttaatgccaaatcacgtttttctgcttcttctatccgccacttagctaatatctgcaaaattgccagctcttgttggttaagttgccacgcattactgatttccttataggctttattcggatcttctacgatctgccgtttagctaacaaagttgcacactcttctacgacggcagtttgccacggtgtttttgctaaatcttccgccaatttgtgataaatcggcaacaaataccacacatctgcacaggcatattgaagttgtatctcactcaaaggacggctcaaccaatctgtgcgagaagcccctttatccaattcaacctcaagataatgcaacgcaagtttggcaaagccaattgaaatacctatccccacaaaccctgccatcacctgcgtatctaacattggttgcggtaactgtttgaaatagtgttgaaaaacttccaaatcttcactacaagcgtgaagtaccttaagcacattttcatttgttaacaacgcagtaaaaggggaaaaatccgtaatacttaacggatcaatcaaatacatctgcttaccatcaaaaagctgaattaaccccaacttcggataataagttcgagtacgaacaaactcagtatctaacgcaatcaccgattgttctgcaacctgcagacacatctgagccaaactaggattatcatcaacccactgatattctatatacttattcattttttctaatactttccacgagttagcataattttccatcatttattttaaaaaataaaataattttgtgacatcactctcataattgaaggaaacaatttgccagacacattataaaaatagcacaataaagtaacgacttagggagtaaaaagattgtaaggattatagctatgaaaatcacctcttcggattataaatatcaacatctcggcacggtttaccgcttagttgaacaatttgagctgatttctcgtactgacttagcgaaattatcaggatttgcccctgcatcaatgacagtgctgacgaaaatactcattgaccataaactgattttagaaagaacctcacaaaatttaccctcaaggggcagacctgccgtagggctgtcggtttccccgttccactggcgttatctctgcttaacccttgcaccacaaaaactctctatcgcactttgcgatttgagtggcaagctcatttaccaacaacattatagcctgacttccgacgaatatcttagcttagatcagcatatcctgaactgcatacaaactttctccctcaacacaccgcttaccaacgaagctttacttgccatttctatcagcgtagtggggaaaattgaccgcacaaaaacaattatcacgcaattagggcaacagcctctctcctgccctctggttgaaacgttacatagtcactttaatcaaccgattttactcaacgagcattttcaactctggcttctagcggaagcaaccttaggaagtttaattgccaatgacaacgttattttcttacagcttgatgatcaagtgaatttaagtgtattactcaaaggggcattacttcatcaagacgaacataaacgaatgaatgttgataaaatgataatgccaaaatttagtacacttagtgatgaaatcgctgaacaacggacagaaatcgaacgttatcaactcaccaatcaagtgactttccctgccctagccaacttgatcgaccgctattttgaccaccaacacacttgccttgaagataaaatcaactacttctgcgaacaagtagaagccgaaaaccctcaagcaatgcagattttatcgcatcttaccgacaaccttgcttatatgctgatgaacctaatcaacatattttctacggaaaaaattatgttgaactcatcgctattacgcattaaaaaaccactttttgaacaactgcaaaccaaactacagcaaaacttgcttcttaatgaactacgaattgatattgtcaccagccaatacgattgggacagccctctcattccttctattgcaattaaattaggcatttatgagggctgtttattaaaggggattgtggagatataggacacgacgcttcgtgtcctatattaagaacgccaaatggcgttcttaattaacaattaacgacactgtgccttaaatcgcaatagatgatctaacaccacaattgccatcattgcttctgcaatcggcacagcacggataccaacgcaagggtcgtgtcgccctttggtgactacttcgacgggttcattatgtacattcacactttttccaggtacggtaatacttgaagtaggttttagggcaatatgagcgatgattggctgacctgagctaattccacctaaaatgccacctgagtggtttgagcagaaaccttctggggtcatttcgtcacgatgttcactacccttctgttcaacgactgcaaaaccatcaccaatttcaacacctttgactgcattgatcgacattaaggcgtgagctagatctgcgtccaagcggtcaaatacgggttcacctaaaccaactgggacattttctgcaatcacggttaattttgccccaatagagttaccctcttttttcagctctcggattaattcgtcaaattgttccactgccacaggatctgggcagaaaaacgggttactattaacttgttgccaatcaatctgttcgatatttgcaacagtttgtgggtcgattttgactgagcctatttgtgataagtagcctcgaatttctacgccaaactgctcttttaaatattttttcgctattgcccctgccgctacacgcattgcggtttctctggcagaagatcgtccgccaccacggtaatcacgaataccgtatttttgttggtaggtataatcggcgtgtcctgggcggaatttgtccattatatcgccgtaatctttggaacgttgatcgccatttttgatgattaagccgatacttgtacctgtggttttgccttcaaatacgcccgataagatttggacttcatcatcttctcgacggggtgtggtatagcgagaagtgccaggtttacggcgatctaaatcgggttgtaaatcggcttcgctgagttccatattagggggaacgccatctacaatgcaacctaatgcaataccgtgtgattctccgaatgtggtgactttaaaaagttgtccaatgctgttgcctgccatttgttttccttatttttattgttgggtataaaatcaataggttttaaaatggtgggttaaaaccccaccctacaaatctgatattccaaaaattgtttggggcaaatatgatttgtccctacaaatcatttgatgtcgctatttataccattttttaaatgcacttccatttgattgaaggtcattttaatttggtgttggttaaagagttctgtgatccgctgatagaggaaattgcgtgttgcggcacggtcgtctaattctggtacaaatacggtaaattcgtgttcgatccagccatcaccaaaactttgtaaattaatacttggcgatggttccaccattactttgggcgcttcgcttgcagcttggtttagcaagcgacgaatcagtgataaatctgcttcggtgctgattttcaaaataaactgtaagcgtgtgacggtgttattaaaggtccagttaataaatctatctgtcacaaaggcttggtttggtagtaccacttctttgttatcatcatcaatcaaagttgttgaacgtaggcgaatacggctgatcacccctgtaaaattgccaaccgttactttatcaccaacgcgaattggacgttcaaataataaaatggtacccgatacgaaactaccgaaaatttcacgcaccccgaaaccaagacccacagataatgcggtgaaaatccactggattttgctccacgaaatgccaagagcggtaaaggcagaaatactaccgaaagtaaccatcagataggtcattaccgcagtgatcgtatgtggtgttcctttggatagtttaatccgtgagaagaaggtcacttctaaaatccctttcaagtttttcactaacacataggtgacggtaatataaagtattgaacgtaaaatattcaataaggtgacggactctaccacagtgcctttagaggtagtttcaacgttttcccataaaatcacgttattgaggtaataagcaatactgattaaatctgaccaaatcgcataaagtgatacaaacaaaatcacccaaccgattaaatcagctaaacggaaaatctgctcattaaccgttgaaatcttgatgatttcctctggtttctctttaacttcctctttggcaccctgctctaaacgttctaaattctgttctctgattttttcccgttttttctgtaaacgacggtacgccattcgacgtgaagaaatggttaaagaacgataggcaaagtagcgtccaaatacccaaactaatgcgaccaaataagtcgtaataatgtggtcgattaaataaactgccgtgtagtagtaacctaacacaatcagcacaatcaaggtaagcggtacgataaacagcacaaaacgcaaaagtttaaacaggctgacactgcgttttttaccatcttctgttttagcattttcatgctcttgaataccccgatctaacagagggcgtacaacaaaagtacacaaagctaaagcaactatcgtcacgacttgaccgatcacatcattagtaaacccgatcacctcaatttgagagaaaatcgaagaaactaagagcaataccacaatccacacagactgcttaataatgcgttggaaaatttcattacttgcctgtggcataccgaaatggcgataggctaacccatttgggcgtaatagcgataaaacggtagcaaaaaacaaccaatagccaaaagcctctgtcacccacgttgaagctaataacggatcaggcacgaacaggtaaagtgccacagttgcaagggtcaaaaacatcaaaccgcttggtagggctaatactatcgtccaaaacatcgcttctggcgtatgccaatggctatcattttttagggtattaatatggctaccaatggttgccaagcggtgttttatgtctgtttttttccaaataatcaagccataaagggataacaaaatcgcaataaaagtaagggttgaaggcaaattctgccccaaattttcaaagccaagatagtgcgttaatgttgaaatctcagcaattacttgttttggaaaggtttctaaccaagttaaatcaatcgggttattactttgaacccagaaactttgctgttgtagctgattttgcagggtgtcactaatcgtaataatctgcttctgtgtttgctcaatttcattagacaaattaagctgtatattgagcgttttaatcagatccaccaaaatcttttcacgctcttttaaaatgttcgttaaagtcttgcgttctgcgtcatcaaataaggttttatgggttgcttctaatttttcgataacgctatttaggttatagagttcatcacgtttttgagataaatcgaaaatctctacccgtaatttcgcaatatctttagaaagccctttaatcaagctgtcggttggcaaagattgtttttgctgattgataatgcgagataaaactaatgtcccctgcaacgcactgatctgcccttcaatgtttcgctgggtttgtatcaaactgtctagtacatttttggcacgcaggctatcccgtgacaacgtattggttttttgtgtctgttcaaccaaaaattgacttaaatcggtgtttaatgaaagctcatcgtgaataatcggattttcaactttattgttagcttttagttcttcagcctgttttgcttgagcctcaaactcttttaaacgcttggcatttaagacttcctgtaacgttgcctgctgtttctgtaacaattgctgttttaacgttaattcattacgtttcgcctcttccagcgaaatcaacagatcaatgttttgggctaaaaattgattatatttattgcttgcctctaggtattttaattcagcattgtatttatcaatcagcgatttactcgcttggttattgtgttttaaacgtgttaatttatccgcttgttgattattttcggtaatctgttttcgtgtttgttctgaggctgtacgataagttaccgcactagagtttgtttcattcaaggtcaattgaacattgtttaactcttgacgagtattgtctaaacgtttttctaactcttcattactgagtttactggaaatttcaacttcactgtttaactccttagttaatttgtcgatatttttcttataagtatctaaagttgcagttgcattagtaagttttttttctaaagcctctaattcactattttgatttttagttttctcaatgaatagcaaggcttcttcaatgtttttgactggttcagttgtttgctcagaaggattggtttttattgcttctaactgcgttttcaaatcttccgcagacacaaaatcttccaccgcagactgaaccatcgccgtgaaaaaagataaacataacgcaagccaaaatgattttttacacatttttttctctcaacttgttggcgatatacgcttttaaatgggttctagacatcttaatgccatttgattgccctatctcatcttccaaagggaaataagcaatcggctgtttgaatttttctaatcgttgcattgcaaaagatttcaacagattgaccgcttgtattgaaaaaggttcgctaaaagccactaacgccacaggacgttcgccaaattcttgatcggcaactggcacaacaaacacttgttttacaagcggatatttttgtagcaccttttccacttcttcgggctgaatattttccccgcccgaaataaacatattatctaatcgccctagcacttccaatttgccattattccaacgccctttatcttttgtcgcaaaccagccttgagcattgtgtaaggcaacaattttaccttgttgccaatagcctaacgcaaggctctgcccttttacccaaatttccccctctacgagggtagcttctcgatttgctaacggtttgccaacattatcactctcatttttaacagcacaaatggtcgatgccatttctgtcattccatagcctgcataagttgtgatctgatgctgttgagcttgttgaattaaatctgccggaattgccgagccacctaataaaatatgctgtgatactaacttttcaccaagccaagctaaataacgctgtaattgtgttggtactaaagaagcgtggctgacttgcgataacatttgccaaaattccgctttatcttccgtcagataaaggattgccccttgcgataaccaacgccaaacaatcccctgccccgaaacgtgaaaaagaggcaaacttaacaaccaagaacaatggcgatcaaattgaacaaaatcacagacactgattgcattggcaagatgttgagcaatagaatgcactaccgctttgggattgcctgatgaacctgacgtaagggtaaaagtggctggtttatcgaaagaaaataagccattgtcttgatttctagataactgaaaacccctatctagagaataaaaatcctgatcggtcagcaaaatagatacttggttttgttgcaatatctgttggcgttggatctcgctcattgcaggattaagcgttaagatctttctgccacttgccaacacagcacaataacagagcaaaccgattaaacggtgagaacctgaataagccaccaagctattcggcaatgctaactgctcaagcaatctcaccgcttgttcaatcaacagttgcaactgttgccacgaaatttgacggggtaagtaagaaaacaaggtagcatttcctctatcccaaacaatagcaatatcttgagcctgtttttctgcccaatatattgtggggaatgtcggaaatactacccttgacatagattaattgaattgagctttaatacgagcaactaactcttcaggtaattccattgcattcattaatgcacacaaaataatcccttttcgttccgtattattattcgtaatcacccaaaatggcgactctggaatttgcttcgctttaacactcgaacccgtcgcaagaatagtttgttcatcacgagcaaaataaattcgctcactgccctgcacattttccgtcgcatgagaaaagccctcaggatctgctttatacaaggcagacaacaagtgtaaaaagcgatttacgccttttttttcattgttaaaaaggctcgaagccaacacaaattcaacttgcttaatcaccttatcttgttgatggagttgtttcttttgcttaggcagctttgcaagatctttcaattcattgatcatattctcttgcacaagtacaaaaggttggggagatgctggtaaacggagtaaacgacgtaaaatatctgacgcactttccccaatagcctgagttctgcttgcaatatagtggtataattcatcatcaacttcgattgttttcatcttgtcccctaaataacttgattactgtaaaattctaggcattatacgcatttccgatctttttaacaggatctaaacacgataattgaataaattttaattaaattatggcggaaaaaatgtttcttcatcaccaatttcaaacagcaaccaacccagcgacttcatcaccacaaacaatggtctttattcacggtttatttggtgatatgaataacttaggcgtgattgccagagcctttgcggaacagtttaatctactccgcatcgacttacgcaatcacgggcaatctttccacagtgatgaaatgaactataccttaatggcagaagatctacgagatctactcgaccacttacaacttaacaatgttattctcgttggacattcaatgggaggaaaaacagcaatgatgttagccaacatcgcccctgagcttgttgcaaaactaatcatcattgacattgcccccgttgcttatcacctcaaccgccacgatgacatttttgcaggactttttgccgtcaaagccgcccaaccagctaaccgccaagaagccaaaacagcaattgcaaaaggtattcaagatgaaggcatacaacaatttatgctgaaatcattcgatccacaaagcccagaattctttaaatttaatctatcgggtttaaaacaaaactaccccaatctaatggattggcaaaatgtttttgtggataaacctactctctttatcaaaggggcgttatcggattacttacaagaaaaagacacccaaaccatcttagctcaattcccacaagcaaaatcctttattgttagcggtgcagaccattgggttcacgcagaaaaaccagaagctgtggtcagggcgatggttaagtttatataaaaatgctcctaatttactaaaaatcaaagggggtgactgctttctaatccagtctcccccttacttctcatcaaataataccaaagtgtttttcggacaattctaaatgagtagtcaactgagcaaaaatgatgtcattaccgccagtgaccctatcccaaattctgagaagcattttcttttccaccttgacttattgctgctacaaccgctccaacacctaaaatccctccaccgagataagctaaattagaaataacactactactctgagcagcaacatctgacaccaaagttgtattttcaactacttccgtagaggatacagaagattcattcttttttacttcatcaatatctgtagattctgaagtggtgacattttcttctactttttctgtatttgaatcaatataatcttctattgatttttgttttatatttttctttaattgtgttcgacgagctttggttgagaatatctcttctttatcaaaaatagcttgaacatctcgcatgtgcaacactttactaattaagtagacagttctctacaaataagagagaattgtcaagataagctcttttatttttcaatagtatttatattccaatgaccactgaaatcaattacgaaggcgttgaacaaatgccgattaagcgttttacggaagacgcttatctcaattactcaatgtatgtcattatggatcgtgctttgccttttattggcgacggtctaaaacctgtgcaacgtcgtattatttatgcgatgtctgagcttggcttaaatgctgcagcaaaatataaaaaatctgcacgtactgtcggtgatgtgctaggtaaatttcacccgcacggtgatagtgcctgttatgaagcaatggttttgatggcacagccgttctcttatcgctatccattaattgatggacaaggaaactggggagcgccagacgatcctaaatcctttgctgcaatgcgttataccgaatcaaaactctccaaaatggctgaaattctattgggggagttaggacagggtacggttgattatcaaccaaactttgatggttcattagaagagcctaaatatcttccagctcgtttacctcatattttgttaaatggcacaacaggtattgctgttggtatggcgacagatattccgcctcataatattaacgagttagcggcagcttcagtaaaattattggataatccaaccgctagtcttagcgatattttggacgtggttcaaggccctgattacccaacagaagctgaaattattacaccgcgctcagaaattgcaaagatttatgagcaaggtagaggctctattaaaatgcgagcggtatggaaacgagaagagaataatattgttatcaatgccttacctcaccaagcctcgccatctaaagtgattgaacagatcgccacgcaaatgcgaaataaaaaattgccgatggttgatgatattcgagatgagtctgatcacgaaaaccctatccgcattgtgctagaaccacgttctaaccgtattgattatgatggcttaatggatcatctgtttgctaccactgatcttgaaaaaagctaccgtatcaatatgaatatgatcgggcttgatggtaaacctgcggtgaaaaatttgctgaccattcttactgagtggttagcattccgtagaacaacggtcacacgtcgtttaaatttccgcttgtataaaatcatcagccgtttacatattttagagggcttgatgattgccttccttaatattgatgaagtgattgagattattcgcaatgaagataatcccaaagatgaattaattgcacgttttcaattaagcgatgagcaagccgaagctattctaaacttacggttacgccatttggcaaaactggaagaacacgagttaaaagcagaacagcagaaacttgaagaagaacgggaacatttgcaagggatcttaggttcagagcgtcgtttaaataacttgattaagaaagagattgaagccgatgccaaagcctttgccagccctcgccgctcaccacttgtggagcgtgctgaagcgaaagcgatttcagaaagcgatttaacgccaacagagcctgtgacggtaattctttccgaaaaaggctgggtacgttgtgctaaaggacacgatattgatgtgcagaacctaagttacaaagctggcgatagctaccttgcccacgcttatggtaagagcaatcagccagttgtctttattgacagcacagggcgtagctatgctcttgatcctcttagcctaccttctgctcgttcgcaaggtgaacctattacgggcaaaatcagtttacctgatggggcaacggtgcaatatgtactaatggcggaggaaagtcgtaaggtactaatggcttcggattcgggctacgggtttatttgccaatttgaagatctggtttctcgcaataaggcagggaaagcggttatttccttaacggaaaatgcaaaagtgctaccaccgcagttgttaaaagagggtgaagaaaatctgttagtggcaatgagcaatacagggcgagtgttagtcttcccagtttctgaattgcctgagttatctaaaggcaagggaaataagatcatcaacatttctgcacaagctgcgaaagaacgagcagagctactttctcgattacttataatcaacccaacaagttcgctggttttcgtttcaggtaaacgtaaaattacgctaaaaccaacagatattgaacattatcgtggcgaacgagcaagaaaaggcacgcaacttcgagggctaagtggtaatgttgaagttgaaattgtagattaatctcaaggggagttgcattccccttgatacattctatcgaacctctaccacctgacttaccacctttccctgtgctaaacgagtgactatcgtttcaccgattgaaatatcctgagtggatatcagtgctttgccctgttggttttgtgtcacagaataaccccttgccaaaatagaaagtgggcttaagccgtctaactgagtgcaaagagtttgaaattgcaggcgacgttggctgatattcttctcaatggcatagcttaaacgttgctctagcttgtgcaaatgttgtatttgggctgaaatacggtaaggaagcggatttcgttccattcgttgtagtgtatttttccaacgctgttgtttacgcaacaatagctgttccatctgctgtttcagctgtttttctaagtgcgaaagctgttggaggcgttgctgtaattgacgctgtgggtgttgcgcctgtaaacgaagttgcaagcggtcaaatcgagctaatttttcactccataagcgatcaaaggctaaattcactttatctgcgtgatgttgtaactgtcgtaacaactcttgctgatcacggctgaccaactctgccgcagccgacggcgttggcgcacgcaaatctgccacaaaatctgcaatagtcacatcggtttcgtgtccaacggcactgataactgggatctgagagtgataaatcgcccaagcgaccgcttcttcattaaagcaccataaatcttccaacgagccaccgccacggccgacaatcagcacatcacactcttgacggcggtttgccagctcgatcatcttcacaatatcagctgtcgcttctttgccttgcactaaggtcggataaatcaccacttcaagagttgggtcacggcgttgtaaaatatgcaaaatatcttgcaacgctgcaccacttgatgatgtcacaatgccaacacgtttgacgaacgtaggaataggctttttatgttcttgagcaaataaccctaacccagccaatttcattttaagctgttcaaattgctgttgtaacaagccatcgccagccggctgcattgtttcaatgatcacttgatagtcaccccgtggttcatacaggctaacattcgctcttaccaacacttgcattccattttgcggacggaaattcactcgcatatttttcatacgaaacattgcacaacgcacctgtgcttgttcgtctttcagggttaaataccaatgcccagaaacaggttgcgaaaagtttgaaatctcgccgataagccaaacactgccaaattcgacttcaagcatctgtttaacggagtaattgagctgactgatggttaggatatggtttttcataataaaatttaaaggattcaatatgttatcctcaaataaattatccccttgtcaatattgtaactaaaacaaataatgacaagaggataacacaacaaatctatttgttaattttatggataaacaggtagacgtttacaaatatccaaaactttcactttagtcacttcaattaccgcagcttcgttatccttaccgatgttatctaatacatcgcacatccaacctgcaagttcccgtacttcagcctctttaaaaccacgacgagttacagatggagtaccaacacgaataccagaagtaatgaatggtttttgtggatcgttcggtactgcatttttattaacagtaatatttgctttacctaaagctatatctgccgctttacccgttaaaccgtggctcactaaatcaacaaggaataagtggttttctgtaccatttgaaacaacgttatagccacgttgtttaaatacttccaccatggcttttgcatttttcaccacttgttgctgataaaccttatactcaggctctaatgcttctttaaagcaaactgcttttgcagcaataatgtgaactaatgggccaccttgttcacgagggaataccgcattttgtagttttttatagatttcttcatctttcgcattggaaagaattaaaccaccacgaggacctgcaagagttttatgtgttgtcgttgttacaacgtgtgcgtgagggagtgggcttggataaacacctgctgcaattaaacctgcaacgtgagccatatcgacgaataaataagcgccgacttcatctgcaatttcacgcattttcgcccaatcaacaatttgagaataagcagagaagccacctacaatcatttttggtttaacttcgtgagcctgtttacgtagtgcatcatagtcaataaccccttcagcagtgataccgtattgttctgcgtgatacacttttcctgagaaactaactgaagcaccgtgagttaagtgtccaccatgtgcaaggctcatacctaaaatagtatcacctggcatcaataatgcaccataaactgccgcatttgcctgagagcctgaatgcggttgtacgttggcataatctgcaccgaataactctttcgcacgttcaatcgctaactgctctacaatatctgcatattcacagccgccataataacgtttaccaggataaccttctgcgtatttgttggtaaattgtgaaccctgagcttccatcacacgaggacttgcatagttttcagaagcaataagttcaatatgctcttcttgacgacgattttcgccttgaatagcttgccataattctggatcataatctgcgatattcatatcacgtcttaacattggtttctcctataagtaatcgtttgcgtaattgatctatccatattctacgcagtttttttgactttagatagcagttttttctgatgattgtaataaaaatatcaagaagcaaactaaaactaagactgaatgccttgaaattttctgacaagctcaccccagaaaatcaaggaatttctacccttttacacgaaaccatgcatgcgttagcattaaaacacccttttgttagagggtaaatggtgttattcgtttacacagccataaattcttcccccgcaagcgggggaaggtgcccgaagggcggatggggggagagatgcaagtaaatcccgcacctactctaccctgccaatgtcgccaccatcaccgctttaatcgtatgcatacgattttctgcttcgtcaaaaacaatagaggcttcggattcaaatacttcatccgttacttctaagccgttcattccatatttttctgcaatttctttacctacaagggtttggtcatcgtggaaagcgggtagacaatgtaagaattttacatttggattacccgttaatttcatcaattcagcattcacttgataaggcttcattaaattgatacgagattcccaagcggattctggttcgcccattgatacccaaacgtccgtatagacgaaatcaacatctttaaccccttctgcaacatcttccgtacaggtgatttttgctcctgttttcgtagccatttctgcgacttcatctaataatgtttgttcaggaaagaactgtttaggagcaactaaacgtaaatctacccccattaatgcagccccctcaacaaaggaatttcccatattgttacgcgcatcacctaagtaagcgagcttaatttgattaagtggcttatttgaatgttcgatcatcgtaaggaaatcggcaagaatttgagttgggtgaaattcatcggttaaaccgttccaaacaggtacacctgaataatctgctaatgtttgaactaatacttgtccataaccacgatattgaataccgtcatacattctacccagtacacgagcggtatctttcattgactctttatgtccaatctgcgatccgctaggtccaatataactcacattcgccccctgatcgaaagcagccacttcaaaggcacaacgtgtgcgagttgagcttttttcaaagatcaatgcgatatttttgccttgcattgttgggacttctcgacctgcttttttgtctgcttttaattttgcggataaatctagcaggtattgaatttcatttggggtgaaatccattagacgtaaaaaatggcgatttttaagattgatggtgtttgctgacataatgcttttcctgatttgaaataaataaggattttattataaagcctttcaataagagaacaatgggaatttatgggagtgatgtatcctattgctttacatcccatctctttttctgtatagtttagcgatacaatcaggagggcagatgattatttcatttaagcataaaggattgaaattattttttgaaacaggatcaactgcaggtattcaggcaaatcacgctagtaaacttgcttttcaattagccactctaaaccaagcaaaaagtgctttagatatgaatgcacctagctggaatttacatcaattacaaggtaatctagctgggcattggtctatcaaggtaagtggaaattggcgtttaacttttaaagttcaaaatggtcacgctgaagtcgtggactatcaagattatcattaaggagctatcaatgaaaatgtacaatccagctcacccagggcttattttaagagaatatattgaaggatataatgtcacagaagtggctaaacgtttaggcgtcactcgtgtcacgctttctcgtattttaaatggtaaagctgcaatttcacctgaaatggctcttagattgagccaattattaaaaactagcccagaattatggcttggtttacaatcccaatacgatctttggcagcttgaacaacgcccaagttttaatattcagccgttatttgcatagcacttgttgtatgttgcaacgttctgctcaaaatttaccgcttgttgcttataggagaacataatgtctaaacaccttactgaacaacgttttattgattttccgattcacgacagtgtcttggctgctcttgatagcaaaggctttgaattttgtacacccattcaagcgaaaacgttaccttatacgctgatcagacaagatattgcagggcaagcccaaacaggaacagggaaaacccttgcattcctcgttgcgacctttcatcatctattaaatcacgatattccaaccaaacataatcaacctcgtgctttaattcttgcaccaacccgtgaacttgcggtacaaattgcctctgatgcatcaattttaacgcagtatgcggatctgcgtttagctcttgcctatggtggtgacggctacgacaaacagctaaaagagattgagcgtggagttgatattttaatcggcacaacaggacgggtgattgattatgtcaaacaaggcattattgatctcgataaaattcaagtcgtggtgttagatgaagcggatcgaatgttcgatctcggttttatcaaagatattcgctatttaatgcgaaaatgtccgaaacccgaagagcgtttcacaatgttgttctctgcaacgctctctcatcgtgtgcgtgaactggcatttgaagatatgcacaatgcagaatatgtggaaattgagccactacaacgcacagggcatcggattaaagaggaactgttctacccttctaatgaagataaaatggcattacttctaacattaatggaagaagagtggcctgatcgttgcattgtgtttgccaatactaaacataaatgcgaagaaatttggagctacctcagtgcagacggacatcgagttggcttgctaacaggcgatataccacagaaaaaacgcttggcattattggatagctttacgcaaggggaattagatattttggtggcaacagatgtagctgctcgaggtttacatattcctgatgtgacacacgtctttaactatgatttaccagacgaccgtgaggattatgttcaccgtataggaagaacaggacgagcaggggaaagtggagtttcgatcagctttgcttgtgaacgttatgccgtaaatctaccagccattgaagaatatatcggacacgctatccctgttagtcaatacgatagtgaagtgcttttagcgttgccaaagccacaaaaagccaaaacaagaacactacaaggcaggaaatataaataaggagaaaaaatgaattacaccattgcacacagtaaatcaggcaatctcatttctttgaccgctaaaatggcaaaccgccacggtttaattgcaggagcaacaggaacagggaaaactgttacattgcgaaaacttgctgaaacttttagcaatgatggcgttcccgtattcctagttgatgtcaaaggtgacttatctggcttagtgcaagcgggaagttatcaaggaaaaattgcagaacgtatcgatcaatttggactgggtggtgaagcatatttaaacggatttccagtttctttctgggacgtattcggcgaagtggttgaaggagaaggggttggattgatttttatgtagcaattacacaaacatttcatcgtaggggcaaatcacatttgccccaaaatctccttcaaaaactccctcaaactcaagcactgcactccctcaaaggtattaccctcaaattcatccatcgtcaccacatatttggggtagttgtcttgaattttgagcaggttgccaaattctcgttcgagcgttttttcttcgttaatcgtgagtgtggcttgcacataaatgcgttcgccatttttctctgctacgaagtcaatttcttggctatttaaaccaccgattttgacatcgtaacctgcgatttgaagatgattaaaaatgcagttttcgagcaatttgccacggtcttgcactcgatagccaatcagggcgtttcgcaaacctaaatcttcaaaatagtatttttcgccaatctcaaaaatccgtttaccttcaatatcatagcgtggcactttgtggatcaaaaaggcattggcaaggtattccgcataattttgcacctgtgtgcttgacgtggcaattttctgcgattttaaaaaatcagagatttttttggcggaaaacagattgccgatattgcttgctaaaaattgcgtaagttgctctaaaaattgcacatttcgtaacgcatagcggttcacaatatcccgaatcgcaatggtggaataaatattgcgtaaatactcaaatacgatattgtcttgcaagggcaagtctttcaaataaggcagaccgccgtatttcaaaaacagtgacattgatttatcgctatcgtccagtttcataaattcaagaaattcaaaataggaaagggagtggacactaatttcaatggcccgcccactcaggctgcccgcaatatcacgtgaaagcaaatgagcattactgcccgtgcaatacaaatccaattcatcatctaataaaagcgaacgcaatgcttgttcaaaatctgtaatttcttgaatttcatcaataaaaatgtaatttttttgaccgctctttttctgctcctgcacaaaatcatttaggctttcagcggttgtaatgtggctaaatgccaagtcttctttgttgatataaataatgtgggcattttcatccgccgtttgaatttcttgcataatctgaaacagcaaataacttttccccacacggcgctgcccagtgaacacttttattagacgttttcccataaacggacgcaccgtttcaaggtatttttggcgataaactaaatctttcttcacactaccccctttcatttataattaatactttactcttaaataaataaagtttcaattataattgaaactaatttcaaatacgtgcagaattccaattacaaaataacctagttaaatcatcttaatgctttcagggtgattaaagcagtcctagctataacaaaaaacccagcaaactgctgggctttcatctctaatataagattagaatggaatatcatcatcaaaattatccattggtggttctgcttgagccgcaggtttttgggctggttgcggtctggttgcgttgcccccattgaagttgttattttgagcatagttgtcgctgtagccgccttgattgtagttggtttgcgctggtgcttggttccaaccgctaccttgatttccgccaaaatcaccgccactgctacggctgtctaacatttgtagtacatcgccttgaatttctgtggtgtaacgatcttgaccgttttgatcttgccatttgcgtgttttgagcttgccttctacataaacttttgaacctttgcgtaagtattgtcctgctacttctgcttgacgacggaagaaaacgatacggtgccattcggtgacctcacggcgttcgcctgtcattttatcgttccaactttcactggttgctacgcttaatgttgcaaccgcatcgccgtttggcattgtacgcatatctgggtcattaccgagattgccgacaataattactttatttacacctgccatatcaaatcctcttaaataaattgtgttggttaaatgtagttttgcgtagggacacactgcgtgtgtccgaaactatatgtttgtatttatcggggacacacgcagtgtgtccctacctcattagttcaaaaataatagttatgtatttttgtacataatattgtaaaacattaaaagttattttgcctgaaaataaaaaaaaatcatctattaaaactgatattttgtacagttaatcaatttatgcgataatgatcgaaaatttgaaaatttttgctttacatttgtttagaaggcagttatgcaacatattgatattcgtggggcgagaacccacaatttaaaaaacgtgaatttggttcttccgagagataagtttattgtgattacggggttgtcaggatcgggcaaatcgtctttggcttttgataccctttatgctgaagggcaacgtcgttatgtggaaagtttatccgcttatgctcgccagttcttgtctttgatggaaaagcctgatgtcgatcatattgaaggactttcccctgcgatttcaattgagcagaaatctacctcgcacaatcctcgttctacggtgggaacggtgacggaaatccacgattatttgcgtttgttgtttgctcgtgtgggagagcctcgctgtcctgatcacgatgtgccgttagcggctcagacgatttcgcaaatggtggatagagtgctggaagaacctgaaggtaagcgtttgatgttgctttcccctgtagtgaaagatcgtaaaggtgaacacgcaaaattattagaaaatctgaccgctaatggttatatccgtgccagaattgatggggaaatttgtgatctgtccgatccgcccaaattagagttgcagaaaaaacatacgattgaagtggtgattgatcgttttaaagtgcgtagcgatattgcgacccgtttagctgagtcctttgaaacggcattggaactctcaggttcaacagcgattattgccgatatggacgatccaaatgcagaagagttagtgttttcgtcgagttttgcttgctctcactgtggctattcgctgacggaattagagccacgtcttttctcgtttaataatcctgctggggcttgcccaacttgtgatggtttgggagttcagcaatattttgatgaacgtaaagtggtgcaaaatcctgatatgtccttagcaagcggtgcgattaagggctgggatcgccgtagtttctactatttcggtttgttgaaatcagtggcgaaacattatgattttgatattgaaatgccgtttaatcagttaccgaagaaaattcaaaatatcattttaaatggttcaaaagatgaaattgaatttgtctatgtgaatgatcggggtgatagcgttaagcgagttcacacttttgaaggggtgctgaataatatggctcgtcggtataaggaaaccgagtcaaatgcagtgcgtgaagagctggctaaatatattaataatcgtacttgtaccgattgtgaaggctctcgtttacgtcgtgaagcccgttatgtctttttagagaaaaccaacttgcctatggtgtcggaaaaaagtatcggcgaagccttagaattttttgaaggcttacatctatctgggcagaaagcacaaattgcggaaaaaattctcaaagagatccgtgagcgtttgtctttccttgtcaatgttgggttgaactacctttcgctctctcgttcggcagaaaccttatcaggtggtgaagcccaacgtattcgccttgccagccaaattggtgctggattagtgggagtgatgtatgtgcttgatgagccgtctattggcttgcaccagagagataacgaacgtttgttgaacactcttattcatcttcggaatttgggtaataccgtgattgtggttgaacacgatgaagatgcgattatggcggcggatcatattgtcgatattggaccaggggcaggggtacacggtgggcagattattgctcagggtacggctcaagaaattatgcaaaatgaagcatcaattacgggcaaattcttatcgggtaaggaaaaaatcgagatcccgaaacagcgtaccccacgagatgaaagcaaacagctggtgttaaaaggggcgagcggtaataacttgaaagaagtcgatttagccattcctgtcggtctgtttacttgtattacgggggtatcgggttcgggcaaatccaccttaattaacgataccttattcccgattgctcaaaatgcgttaaaccgtgcagaaaacagcgatgtcgccccttataagagcattgacggattggcttatttcgacaaagtgatcgacatcaatcaaagcccgattggacgtacgccacgttcaaaccctgcgacttatacaggtttatttaccccgattcgtgaactctttgctggtacacaagaagcaagagcaaggggctatactgtcggacgtttcagctttaacgtgcgtggcggacgttgtgaagcctgccaaggtgacggggtgatcaaagttgaaatgcacttcttacctgatgtatatgtgccgtgcgaccactgtaaaggcaaacgctataaccgtgaaacccttgaaattcgctataaaggcaaaaccattcatcaagtgttagatatgactgtggaagaagctcgtgagttttttgatgccgtgccgatgattgcacgtaagctacaaactttaatagacgtaggcttatcctatatccgtttagggcaatcttctaccaccctgtcaggtggcgaagctcagcgggtgaaactggcagcggaattatccaaacgtgacacgggcaaaaccctctatattcttgatgaaccaacgacaggattacacttcgccgacattaaacaattattgaccgtattgcaccgcttgcgtgatcaaggaaataccattgtggtgatcgagcataacttagatgtgatcaaaacggcagactggattgtcgatctaggtcctgaaggcggtagcggcggcggacagattatcgccgaaggtacgcctgaagaggtggcaaaagataagaaatcccatacggcaagatttttaaaagagattttgaagaaaggttaagttgtagttgcaagcggtcacttcgttataatattttgcaaaaaaccaaacgaatccgaccgcttgtttgaaaggagaaaatgatggaataccaatttacacataccatgcacggcgttattgccaaatgttcaatggatcacgaggcatttgctcgttggttaaataccgagattgtgccaaatccaaaagagttaaccgctatttttgctgaaattgagcattgtcgccaaaccaaagatcaaaactacgaatggatttttgaaggtaaagaatatagcctttatatcaacattgaagaagtgatggtgaaagcaaataatctggatatgacatttgaagaaatcgaagatgtcgaaaacggctttagtttctatgatgaagaaagtatcgctttttgtggattagaagattttgaaatgtttttgaatgcctatcaaaaatttattcaaacctaccactaaacccacttttgaaaaatttggcacgccacaaaccgctttggaattacagcaacatcaatgtttgctctatgaaagccaaactttatggcaatttaatgaaaacggtcatcaaattaaattaaaaccccaaagccaagtttatagcaacaatggctatgcgttggtgcaaatggcaagagcaggtcagcttatgcaagagcagaaaatacacctctaacagacttaaccagcaccatcctattaaaaatcacacaaagaatcaaaggctgccatcaatacacttgaaggcagcctttattattaatatttactcagatatttaatatcttaccactgtaatgcaatacctgcaccagcattgtatttgccttgcgaagttgcacctgcagaaactttaagaatcacacgaccattatcagacattcttgagaatccaacagcaactgcattttgtccctcgaaagtaccaataccagcacccaatgtgcttttacctggtaaagtcacttgtggaatattgctcatagccgttgttgcagcaatacccgcacgaagttgacgcccttctctctctaacttcgcacccaatctatgtgcaacattatacaactggctaccattaatcgcatcggttgaagtagaagaaatttcccctgttgcaacattttggatacggcgctcatcacctgcagcacctacggaaaccacaccgtttgcggttgcaccagcgaagccatcataaatcatgttacccaccgttacacttgatactgtaccagtcgatcctgctgtagtcgttgaacctctagaaccatcttgtttccagtttttgagagagcctgtttgactaccatcaccagctgtagccgtcgtattgttacctaaataaacggaattctcaaccgtcccttcaggagttgcagacatccaagttaatgcaccattactatcacgcttattattcacattattaccaagaacaaaggtattgcttgatgtaattacattatcattaccgaatgcatagcttccatcaatgcctttatagattggattacctgcactgtcagtaccaatttgaacaccacgaatgatattcgggtcaccaaacgcacctgatttattcgcaattacttggttaccagtaccgatagcaattgagtttttacccgatgcggttgcacctttacctatagctaatgcattatcacccgccgcaacagctttataacctatagctgttgcataagtacctgaagcacttgagtcaatatcgttagatgcttggttaataggctctgctacaccatcatttgtatggaagaacttgataccttgttcgttcatattatgaatcgcagtaatcacagagtttgtaacaaactcagtttgacctttcacgttgtaagtggtaagtgtgtactctttagcttgtacaatctcgttaccatcagcatccaattcaggattgccattcttatcgcgtttaacttcagtaatgactgaaccatctttgtccttagcataggttactgtagaaccatcttttttctgttcaacttggttaccattggttaaagcgtaaacttggcgaccattcactgcatcagtactattcggtgaaatatcaccatcagcaataccactcaatttcacacgaggatcaactttctctttatatttctggagattgccatccttatcataaataggttgtttggtcactggatcccatttaacaaactcttcctcgactttctctcctgcaccagtaaggttgattgtattcttatcaccagtcattgtcgcagtgcctaaagtcacagaatttaagttcgttaaatccttagcacctgtaggaccttgtggacccactggaccttgctcacccttagcaccttgtggacctactggaccaactggacccgcaggacctactggacctggtgcaccttgtggtcctgtttctcctcgatcaccctgttcacctttgtcacctctaggaccttgtggacccgcaggaccgcgctcacctgtttctcctcgctcacccttagcacctgcaggacctggttcacccttttcacctctaggacctgctggacctgctgcacccgcaggacctgttggacccgcaggacctgctggacccgcatcccctttcggaccttgctcacccttagcacctgcaggacctggttcacccttttcacctctagaacctggttcacccttttcacctctaggacctgctggacccgcaggacctgctggacccgcaggaccagcatcccctttcagaccttgctcacctgcaggacccgcagggccccgaggacctgttggacccattgcacctgctggacctgtttgtcctgttgcacccgcaggaccaactggaccctctttcccttgtggtccttgtggacccattggacctggtgctcctggttctcctcgttcacctctaggacctgtttcaccagcagggccccgaggaccaactggacccactgggcccgcaggacctgttgcacccgcaggacctgctggacccgcaggaccagtttcaccttttagtccctgatcaccctgttcacctttgtcacctttaagacccttttcacctctaggacctgcttcacctctttgtccttgttcaccccgaggacctgctggacctactggacccggaggacccatcggaccttgcggacccatatcacctttatcacctgctggaccccgctctccccttggacctgttggacccgcgggacccattgcacctgctggacctgcttcacctttcggaccagcttcacctctatcgcccttaggaccagctactcctggagcccctgctggacccgcaggacctactggacccggaggacccatcggacctcttggtccttgatcaccctgttcacctttgtcacctttaagaccattttcacctctaggacccatcggacctgttgcacccgcaggaccgcgctctcccgcaggacctcgatcacccttagcaccttgtggacctgctggacctgctggacctgctgcacccgcaggacccactgggcccgcaggacctggatcacccttagcaccttgtggacccattggacctggatcaccttgtggtcctcgttctcctcgttctcctcgttctcctctagggcccgcaggacctggtgcaccatctctaccgttggtaataatatcgtatgaactatcagtgtaagtaattttcacaccgccactcactaaggtttccgttttttcaattaacttaccaaccgtagaaatcgtaatatttccgcccgtttgttctaatttaatattatttccggcggtaaaggttgcagtctgacccattttgataagatattctgtaggagtagcttgaccctttccctgagcaatcgccagtttccagcctgcatcatttacagcattgactacagcttgaacagttgcaaatccttgcgtcgtccctactgacaatctgccattatttgtagtgccaaacatacctgatttagcggcattatcaattttttgtttagtttcctcggttaatttaaccgtaatcgtatcgccgctcgcctcggaagtaagaccatctgcgcctgttactttgagcgtaccatcccataaaccaacttttggtatatctccttcttttttagtattaccatcaatcttcatggtcaaggatttaagctgcgccacgtttactgcatcagttaattctttacctgctgcaacgttggtgatttggcgtttgattctgtcattacccacagaaactgcaccgataagaaagttattagaacctttaggatgacgctcaggactgtcatcaacactttgtgttgatttaaaaccattctcaacagtactgtctcctgttgttacagaataggattgtttcgttccatctacacccccagctatttctgctctcgaaccataacctaacgccacgccaccaccaacgataacaagtgaattgctacccaatgcagtggctctattaatattttgatttgtaacagcttcttcaccgactgcaacagagtgtgttcctagtgctcttgctcgatgaccataagccgcagaataaaagtctgctattgttcttgctccaacggctgtggaattgttagctaatgctcgagcgtcaaaacctatcgcaacagcagtcgtactttcagcttttgattgagcaccaatagtaatagaaccagggccaaccttactatctctaccaataccaatagaatcgccgttatatcctcgaaaccctccactagaaccattttgaaaccattctgcagctgaacctactggactaaaaaatatacctagtaatactagacttaaaagacttaatttaaatttatcttgctgtttatctaaaaaataatgtgaggtgcatagttgagctcttttatccgtgtaagtggatgttttggtatgagattttactaattcagatacaacaacccaagcctgttgagcgtgactccaaataactctaaatattttattcataataactttccataataactttctctaacgctttttctaataaagcatcataaacttttatttacattttcagggtgtacagatgcccccactccattgtaaaaaaaaaaaaaaacaacatttacataaaataaagaataaaataacaagaatttttcaacttttattgtcaattattaaaaaagttagaaataataggcgggaaatctgatgaaagcggtgatttagatgggatattttacaccgcatcgtctcttgaacaggctgctatttaatcattatcacatagcctacttaacattgtcgtctaatcccaaaatatacgggctatttaaatgcactatcggtaaagttgaattattccactcccgcaataactgtactttcattaaatctaaagtatctaaaccagccaaagtgtttggagtatattgagtcgcaaagcgagccagttgcgtaagcccaagactagattcaatacttgaacttatcacagcaattaaaccttgctgatgagcctgttcaatgagtgaaatacatttttcaagggaaccaacgagcgttggcttaatcacaatagcggttagatttggctctttttttaccaaaaaatcaggctctcgtactgtttcatcccaagcgatatttatccctgtctgttcagcaaactgacgtgaaagttctggagttttgcagggttcctctaaaaactgaatgcgctttttgcgttcaggggaaattttacttgcaaaaagcaacgccttttctagcgtccatgagcgattagcatcaagccgcaattttaaatcgggaatcgcttctaaaaacatatccgcaataagcccatctcgattagcttcatataaccctactttaattttggcgattttttccccttgcatttggttcaattctgcataaagttcatctgggtcgccataacagagtggcacagtttgaaagttggcttcttcgcttaatgtttcattgagttctgctaaggcacagctgaccccaaatgcaacggacggtggataggatgttaaagaatcgtcttgatgatttagccacttttcaatccattggcgaactgcaatttccgcctctgctaaggtttcttggctaaattcaggcaatggggcgatttccccccagccttctttgtcagcatgttgcaaatgaataatcaaaccatctcgttgttttaaacggcggttacgtaagataatgcctgtttcaacaggtaaggaataacggtaaagttgagcggttttcatcggggttaactttgtatttatttatattcagacaacaaattactctcagccctcggttcaaaagggctgagatatttacgtagctgatacataataccgaaaaaacattcaaattacaccgcttaatactcaaaaaccacgccagcttcttccgcttgggctaaggcttggtacatagaaatccttcatacacgtaggggctaattacattagccccaaaatcatcggtaatatctggggcaaatgtaatttgcccctacaaattatcttctttcctgttttacaatcgtcgttggctcttggtggataatcacttatagaaatccttcatacacgtaggggctaatcacattagccccaaaatcatcggtaatatctggggcaaatgtaattttgccctacaaattatcttctttcctgttttacaatcgtcgttggctcttggtggataatcacttatagaaatccttcatacacgtaggggctaattacattagccccaaaatcatcggtaatatctggggcaaatgtaattttgccctacaaattatcttctttcctgttttacaatcgtcgttggctcttggtggataatcacttatagaaatccttcatatatgtaggggctcatcacattagccccaaaatcatcggtaatatctggggcaaatgtaatttgcccctacaaattatcttctttcctgttttacaatcgtcgttggctcttggtggataatcacttccgaatggggaaagactgccagtattttctgttctaggctgtcggtaatatcgtgtgcaacaaccaaaggcagatgatcgtccaattctaaatgtagctgaataaagcgaatcgcccctgctctgcgagttttgacatcgtgtatgccgataatgcgagggtgttgcaaagcaatcgcccaaatttgatcgacttcttcttggggtaaggctttatccaacaaggattgcaccgcttcccagcacattttagctgcattaaacagaatataaagagcaattccaatggcaaatagggcatcggcataaatcacgccgtagatatttaaaatcattgccataagaattgctgcgttcatatagagatccgtttgataatgtaacgaatcggcctcaatcgctgggctttgagtgagtttcaccacttttttctgatacagaactaatgcagcagtaagaacaatggaaaacaagctaatcgcaatacctaattcactgctttgcaccaattgcggttctgttaagcgttgaataccttgtagtaataggaatgttgcagaacctgtgataaaagcactttgagcaagggctgcgagggactctgctttgccgtgtccgaaagtgtgatcgtcatcagctggctgtaaagcaaaacgtaacacgagcatattggttaaagaggcgaacaaatccactaacgagtccgtcatcgccgctaaaatcgccatcgatcctgtctgccaccacgcaaacgcctttgcaataattaaggtggcagcgacaattactgcaaagttcgccgcccgttttacatattggttatactgtttttccattatttgcactcaatttgccacgctaattgcgaaaactgccacgccatttgttgaagttctttaatataagcggtgggttttggttgattttttgcagaaactgaccgcttgtccgagaactgcatttggctgtagccacactgagaatttcgtccacgagtgacttctagctgataatcattgaaacgttctgtcggtggataaagtacttggctttgtagctcgtcaccaacaatcgctactttcgctttggtatcaggctgtttagcgaaggtttgctgacgtaactctaccctatcagcaagacttttttgttggctgtttttatcggtaaacaacaatatgccttgttgccagttattcggatctttcgagctttctttgagtaaaaaaagcgattgttgcatttcatcaagctgattttgggtcactttttggtaggttttaccttgaaaattgacctgttcaggtatcgaaaattgcggtggtgttaccacgcagcccgttaaaaatagcggtaaaaaaaaggattttcgtaacattgtcacgctattgttcctcatatgtaaaatagactttagttaaagtattccaataaaacttttcattattctttttattcattaaagaattaatatcttctttctctttcatctctcgtaaataaaactaatgtttcattatacaaaaactgataataatagtcgtaagctaatacattttgcacatatccccttgtttctacaaaaggaatggaggcaataaattcgtccatcgccaaagtgccatttgcacgttctaaccaacggttcactcggtgaggccctgcgttatatgccgccgcaattaaaattcggttatttgggtaggtttcatttaactctgctaaatgggctgtccccaacataatgtttttaaaagggtcgagtaaatctttttcccctgtatagctcagttgatttgctttggctgtttggcttgctgtggttggcaataactgcattaaccctattgcatttgcgtgcgaacgtgcttgagcattccacgcactctcttggcgagcgattgccattgcaaaggttttagtgatttttttatgctgtaaattgagttcaaaccaatctgaataagcatttggcagacgtagcgataaataatcccacgcttttgcctgaatggttccttcaacggctaaatcaaaccaatcttgttgcaaagcaaagttactcaatgcaattttttcgtcaaaactcgccgcttgcagtaaatctacccaaacaattttggcagcactcagccgttttaacgcccttaactctgcaatgcggttaagctgaggcttaaatttaagggtttgttgttctgttaatttgttaatcgctggcaatacgggctgataaggctgtcctagggcttgagccgccagcataggataaaatcctcgctctgtggcaagttgctggaaaatagccgcttgttgtgctggctggcttttggctaaccaataacgccattccgctttggctcttgtttctgggcttaatagcactaaccatctatttaaatcgcttttctgccagatcgccattcgtaagcggcgttcggttaaactatcctcttttaattcggctaactgtgcatctcgccactgctggaactggggtgttgtgttatcaaaaaagcgttgtagaaactggattttccattcacgtacttgattttcgctaagttgccactgctctgcccaagtttgatatggggcaaaatccacattttgcatttgttcaggcaatgttttgagaagtttggggaaagcgtgcaatacaagctgtttattgagatcgttaagcggttgtttcgcaataaaatgttgcaaataattcggctcagacaagagtttttgtaaatcggcaagccattttcctaactcgacatcttggttatttaacgctaactggcttaactccgcttttgcatttgttatccataatttgaccgctttttgcttcactttatcttcggtttttaacccctgatctcgccagaaggcttccaagttcgcacagtcagagggcaatgagccgttattgatccaaaaatcatcaaactttgctaacagctgagctaactcaggcgataaaggttgagccagattatttgcttgtgccgcttctggatttaactgtaatttatctgcttggctttgatactgaaccgcccacacccgacattgattagcaacgcttagctcaccgactttgtcgctataggctagaagctctgaccatttttgctgtttgtaccacatttctatcgggaactgttccagcttattgcgttttgcgatatgcggatattgcttgataaagtgccgaatttcttcttgcgaaatagcgttcaattttagtttagtatttaatatagcccattttatctcttcaatcagagggtaatcaagcaacattgcctctaaatgcaccactcgctcaaatatcgcattagaaaattttccctctcgttccatctctcgtaataaagtctcaagcagcaaaaaatttactctttgcttttcaaattgacggtagatattttgttgctcgttctgccattgtaattttagtttctcaatttctggagatgactgagactgtgtagcccaagcagataaacacatcgccaaataaacaaataatatttttttccccataaactctcctagatactaaagcccaattagaaattaaaaaccgcttgaagtttatatcaacaagcggttaatttaattgaaagtttcacttcttattcatcaataatcactttcgcaatgtaatctaaattacgataatgctgtgcataatcaataccatatcccaccacaaactcatcagggatagcaaagccaacccattctactggtacatccacttctcgacgagaaggcttatctaataaagtacaaatcgcaagtgaggaaggttcgcgcaaatttaaaatatcatgcactttgttaagggtaaaaccagtatcaataatatcttctacaattaatacatctttgccttgaatttcactatccaaatccttcaagattttcacatctctgctcgattctgtacttaatccataacttgatgccgttaaaaaatcgacctcgacaggtaaatttaacttacgcaccaaatcagccataaacataaaagatcctctcaacagtccaacaacaaccagactctggctatttttatgttggtaatgttgattaatctgttctgctaactcagtaatgcggttttgaacttcttgagaagatatcatagtttcaatgtgatgttttttcataaacaaaccttttatctatatactatttaaaaatacaatatgatgtatcaaatgccattatacctcaatattctttgattaaataaaactacctattctccttttaagatcaatcaacatttaaatgtgttcactacatcatttcatctacatggccatctatgaatttaggtaaatcagcaacactatcaataacataatcagcgtttaattcaccttcaggtgtaattggtttacctgtccgaaccaatattttcactttcaccccagcgttctttgcagctaatatgtcctctaatttatctcctaccatgatagattttgaagggtcaatatccagatcagaaatagcttgtagcaataaaccagcttttggcttacgacaatcacaagcctttttataattaccaattccttcaggatgatgaggacaataataaataccatccaataccacaccatagtcttcatctaatgaccaatccatccattctgtcaattgatgaaattgtgcttcactaaaatagcctctagcaattcccgattgattagtcactatcactagcatatatcctttatcttgtaattgctttaatgcatggccaacacctttaataaacctgaaatcatcaatattatgtacatagccatgatcaatattaattgtaccatctcgatctagaaaaatagctttattcgccatcactatttccttttaaaaagttaattaccaactggtgatgttcttttgttttaaatttattaaatacagacataattttgccatactcatccactaaaaaactaattcggtgaaccccatcataactttttcctaaaaattttttctttccccacacgccaaatgcttctgctaccttatgatccacatccgacaatagaataaaattcaaactattcttctcaagaaattttgctagcttttctggcgaatcaggactaatgcccagaaccatcacatttaaagaatcaagttcttccttgctatcacgtaaaccacatgcttgtgatgtacaacctggtgttaatgctttaggataaaaataaattagaaattttttgtttggaaattgatctagagttacccaattaaaattttgatctaatagagagaatgatggtacagtatcgcccacctttaatgtatccattattattccttttagcccattatagaggcaataagtatatcatattctaaatatgcactaaaatattaagcataggaagattttcacaattcggttttaaataaaaatttgtgatctatgtcgtaaaatttaatttttcctattgcgtattttacatatttgactaaaatttacatcataatctaaccaagggagaaacattattatggaagttggtattgtaaaatggtttaacaacgccaaaggattcggatttatcacttcggactcatatgaaggtgatatttttgctcacttttcagttattgaaggagaaggctaccgctctttaaaaatgggacaaaaagttcattttgagttcactcatggagataagggagcttcagctgtacgcattgtaccaattactgaataatttcttaggggctactttagcccctaatttgttacccttaataaagactttggcataatagacaaaaatagtaattaaaaccttaacaggtagacagtacccgtcttttgaatcctcttaatgcttgcttaaaatagcctcaatcccaataagattatttttcttccctactaaaattacaatacatcttcccaaattcatcaaaatacgtcgggaaagtttttgccgtacatttcggatctaaaatcgtcaccgacgtatttgacaatgccaccaaagagaaacacatcgccatacggtgatcgttgtaggttgcgatttcagcgtgctggaacttatctaacgcaagcggttgaatacggataaaatcttccccttcttccacttccgctccgaccttacgcaactctgttgccattgctgtcaagcgatccgtttccttcacacgccagttataaatattacgaataacggtttcaccctcagcaaaaagagcggtagttgcaatcgtcattgccgcatcaggaatatggttcatatccatatcaatgcctttaagctccccctgctctgcttggataaaatcttcgccccaagtgattttggcgcccattttctcaagcacatcagcaaacaagcggtcgccttgaatggaatttttaccaatccctgtcactttgactttccccttaattgcccctgcggctaagaaataagaggcagaggacgcatcaccctcaaccaaatatttttgcggagaaacataatgctgattacctttcacaaagatagtctgatagttattgtgcgacaccgtcacgccaaaatctttcatcatcgcaagggtaatatcaatataaggcttggagaccaactcaccgacaatctcaatttccatatcgccggaggcaagcggtgcggacatcaaaagtgcggtcaaaaattgcgaagaaatcgaaccatcaatctgaattttgccgccttgaatacccaaattacgaatagcaatcggcggatagccttcattttcaagatattgcacggaagcccccgcttgcaataacgcatcaaccaaatgtttaatcggacgctctttcatacgcggctcgcccgttaaaatcacctcagcctcttgctcacctttcaaacaaagtgccgctgttaaaggacgcattgcggtgccggcattacctaaaaacagcgacaaaccattttgccactgaaacgcaccgcccacgccctcaacggtacaaacggttttattatcagaaagctgataattcacccccaaagctttcaaggcattgagcatatggcgaatatcatcgctatccaataaattcgttacttgcgttgtcccctgtgccaaggctgctaacaacaacgcacggtttgaaaggctttttgaacccggtaaattaatttcgccctcaacacgagcgataggatttagtgttaatttttccataatgaaatcctaataattaaatagtttttataatatctaaaaaaacaacctcttagaattcattaagaggttgtaatccagaatatactcccctaccccgtattacgcatacctgccgcaatacctgtgatagtaatcatcaacgcttgctctaaggctggatttggattttcgccttcagcacgtaagcggtgaagcagctcaacttgaagtaagttaagtggatcggtgtaaacgttacgcagagcaatagattctgctacccaaggtaaatccgccattaattgcccttcgtgagcaagagagagaacgctgttgatgtccgctgcaagctgattgcgtaaggtatttcctaaacggtgtaaatattgtggtacaaggcgctgatcgtaatgttctgcaagccataaatccgctttactaaagaccatctctaacattccgatacgggttgagaagaacggccattcggtacacatttcttttaatagtgcttcattaccttgttcgatcaactgttgtaacgcttgaccagctcccaaccacgcaggcaacatcaagcggttttgcatccacgcaaagatccacggaattgcacgcaaactttctacgccaccatttggattacgttttgcagggcgtgagcctagtggtaattttgaaagctcttgttcaggcgttgctgcacggaaatacggcacaaaatcaggttcgccacgcacaatgccacgataaatgtcacaagaaatttccgagcctttatccattacatctcgccattcttgtttaggttctggcggcgggcaaaggttggcttctaaaatcgcactagcgtataagtctagacttgatacagcaacggcaggtaaacccagtttaaagcggatcatttccccttgttctgtgacacgcaagccatttttgagtgagcgaggcggttgtgaaagtaacgccgcgtgagctggcgcaccaccacggccaatagtaccgccacgaccgtggaataaagttaattctacattgtatttctcagataaattcaccaacgcttcttgtgcacgatattgcgcccaagatgcagctaacataccagcatcttttgcagagtcagaatagccgatcattaccatctgtttgtcgttgatcacaccacgataccagccgatattgaatagatcggtcattactttctcgcaatgatcgaggtcgtctaatgtttcaaatagcggtgaaacaggaatggttgttttgcaacctgcttcttttaagagtaaatgaaccgctagtacatcagaggcttcacgcgccatagaaatcacataggcagagatcacgccttcaggctgttctgcaaccactttacaggtatctaaaatctctttcgtttcagggcttggtgtccagttggttgggacaagcggtcggcgagagcttaattcacgcacaaggaaagcttgtttatcatcttccgtccattgtgaataatcccctaaaccgatataacgtgtaatttccgcaatcgccatttcgtgacgagtactttcttgacgaatatctaaacgagataaacctaaaccaaaacaacgaatacggcgtaagcaatctaataagccaccgttagcgataatacgcattccgcattggtgtagtgattgataacagtcgtagagcggttcccaaagttgctcgtcatcggttaagatttcatcacggctaatggtaagcggtttatcttgcaagagttcatcataataagctaaggttttgataagtttggcacgcagatctttcaccaccacacgatatggctctaaatgatcgccatattttgcacggaaggcatctgttgcgtgaataacagaaagctcgtcggctaatgatttaatatcttcaaggaaaagctcggctgctttataacggttcatacgcaacactttgcgtgtcgtttctgcggtaacaaacgggttaccatcacggtcaccacccatccaagaagaaaaacgcacaggtgcaagcccaacagggtactgaacaccaaagtttttctctaaatggaaatttaattgacgacaaaattcaggtaccgctttccaaaggctattttcaattaccgccataccccattttgcttcatcaacaggggtcgggcgttgagtacggatttcattggtatgccaagctaacgcaattaattgcatcaaacgacgtttaagttttgtggtttctgcatcggttaaatcatcgtgttccaagcggcttaaacagcgattaatttcaacgtgtttatgcactaaagaacggcgagtaacttctgttgggtgagcggttagcactaaatcaatcaacagtttttcaacggtcgcaattactttttcagcaggcacattttgcgcttttaagcgagtaaataaagcacccatagagcgttcacctaacgttgcatctttattgtgacgagaaatcgtgtgatattgctctgcaatgttcgttaagtttaaaaattggctaaaggcacgagcaacagggataacatcttcgtttgaaatattggcaagaatatcaagaagttgctcacgtgatttttcatcacctgaacgtgatgcacgagacaatatacgaatattttcaattaaatctaaaatttcattcccttgggcatcgcgaatcgtttcgcccaaaaaatctcccaacatatgaatattactacgcatggattcataaatttggctcataaaatgtcctcttttcgataaaaattaactgggtgtagatataccgaaaaagagagcaaatggcaatggtatttagtttttttatgaaataaataagaaaattttatttttactcaatttttactttaatagcataataataaatttaataaggtgcttttagctaaaatcaatcgtcaaattaactgcttgtaaatacctagcctcatcaagcaagtccgccaatatcaaaggattctgcgccaagaatactttatcaaaggataaatgccacgatgaattttggatagataaattaagttccattggaatattcgttgcttgacgtgaacgatttagtaacactgccaagcggaatatgcgtaatagggttaaaatatcagggtgctgaaagcgacttgcaattttgagatcgtgtcgtttaaatcctttgaggtgataacgcattaatgtggctaacacagtttgttgttcagaatcaaaacctggtaaatctcggtttgcaataatatacgcagaatggcggtgaacaccgttgtggttaattgaaataccgacttcgtgcaataaacttgcccattgtaagatttctcgtaattcctgtatttgacgtttatttttccaagcggtcacttgatcaaacaaacgtaatgcggtgtcttttatgcgttctgcttgatgttgatcgatattaaattgttctgcgagggcttttgctgtccgttgtcgaatatctccaacttggaatccgctctcaacaccatataagattccttcacgcaatgccccatcggaatatcgcattgattgaatatggaaggtgtgaaataacgccagtaaaatggcaagccctggcactaagacatcggcacgctcttccaataatcctttgagctgaatttctttgagtgaatgaaatgctaaacaacgatcaattaaggtttgtaaacgtgcttctgtaattaatccatctcgatagccatttgcaatcaacaccttgctcacggttttaattgttcctgaagagcctagaacgtgttgccaacctaactcacgatattcccacgccaaatcatcgattttttccatcgctgtttgatatgcctgttcaaaacgtgcttgagttagttcaccagcagggaaaaaacgttttgcaaaactcacacagcccatatgacgactttctgctcgtaatggagtgaagccatcccctatcgtcatttctgtcgaaccaccaccaatatcaaccacaaatttacgctctttttctggttgtgtatgacttacccctgaatagattaagcgtgcttcttcttgccctgagataattttaatcggaaatgggaatacttgttgtgcttgtgttaaaaaatcttgattgtttaatgccctgcgtaatgtgtaagttcctacgactttcacattttcaggtgagaacccttttaaacgttcagcaaagagtgctaaacaagcaacgcctctgtctatagcttcttgatttaagtggcgatgctcgtccaatccttctgctaaacgtacacgacgtttaatacgagaaaggatttggattgagccattaacaatccttgcaacaatcatatgaaaactgtttgagcctaaatcaatcgcagcaaattcgcgtgaaggcatttccgacataaagcaccccaaatagaataattcaaagcaaagtgtatcactttttcattcaaaatcgtggtactgaacaattattttttcattttttaagttatatacccattattaatttgaggttattgatccgtttttgtctttttgttacattatcccattatttttttatggctttaaaaggagaggtaatgatcaacaacagaacaacagaacaacagaacaacagaacaacagcatttagcttagcatttagcttattactatgctgcttaggtattaatgcagagcagcttgaacttgatgaaatttctgtaatgggaaaagttcctgagggaaattcgataagttttctaaaagtaagtgatgctattattgatggagagaaattcaaaaatcgttctgcaacattagggaatgctctatctagtgaattaggcgtacatagcaccccatttggaggtggagcaagcgccccaattattcgagggcaagaaggtgttcgagttaagattttgcaaaataatgctgatgttgttgatatgtcaaatatttctcccgatcacgctatcactgcagatactctacttgctaatcaagtagaaattttacgcggtgcttcaacattgctttatgcaagtagctctcccgctggaattgtgaatatcgttgatcaacgtattccaaataaaatgcctaaaaaaggttatgaagtgacactttccagtcgatttgatacggcaagcaaagagaaagtgtatgcactaggtacaaccattggaattgggaaacatttagctttacgacttgaagggttagatcgtcaatcgcaaaattataaagtgccacaaattaaactaggtgaaacattaaattatgtgccagatacttatcatcaatcaaaagtaggaactattggtttatcttttattggtgaaaaaggttatctcggagcgtcttataatcagcgtaaagacagatatggattacctgggcataatcataaatttgatacttgtattgcccatatttacgatatgagattgcaaggaaagcattcttataccaatctttatccccatttaatgagtgatgaaatggtcacagaaaatcctcactttcattgtggtacagactacgatctcgatccaagccatagccacgatcacccttatggacacgaccacgatcatacccatattggaccttgggtagatttacactctaaacgaattgatataaagggagagattaaacaacctttgccgatgttggataaaattcagctaagttatgctcaaacagattactatcacgatgaaaaagacgcaggaaaatcaggcgatacaatcaacccaaaccgagtagataagagcaaagattttggtaaacccgtcaatattttcaaaaatcaaggcaaaaatgcccgcttggagttttttcatacgccaattggtggcttaactggaatgtttggcgtacagtatcaaaccctgcaaagcagcgctaatacaccaagcaaccgtgaagttcaatggcctttagtggataatcgcaacaagcaaattagcttatttgctttggaacaatacgcttgggataactttgcgattgaattaggattgcgaactgaaaagcagaatattcatattgactatgatttagctaagattcaaaaacaacaaaaattcaatgagaggacttatggtaaacaggttgatcctgatttatctgattatgatgaaaaagccatctcctatactggggcatttaattggtttttccacccagactatcagctctcgtttacagcttcccataatgaacgtttaccaactccgatggagctttattatcacggacaacatttggcaacaaactcgtttgaatatggaaacaaagatctaaaaaaagagatttccaataattttgaattaggtttgggctaccatacagaaaaattagattacaaattatcaacctattacaataattttgataattatatctacaatgaaacattatatcgctctaataacctctttatgcgccgttataatcaagctaaagccacattttatggacttgaaggcattattaactaccgttttacgcctgattatcaattcagtgtatttggcgatatggtaaaaggaaaattaaaacagctacccgacataaaaggattaaatgatgtctatggagagccaattcttaatcctgattacgatcctgaatatgatgaaccagaagaccaatactatcgtccttacttaggcaaagagatgattaaacaggcagatcgtgtttcgccacgtctaccgcctatacgtttaggggcaagatttaacgcacaattgacagaaaacctctcaggttcagttgaatggatgaaagtctttacacaaaataaagtctccaaattagaaagttcaacaaaaggctatcaattactcaatgcgagtttaaattaccgcagacaaataaaaggtgtggaatataccgttagtttgacgggaaataacttgttaaatcaagccgtttacattcacaactcttatcacccctatgtaccacaaataggcagaaattttatcttaggcttagatcttagtttctaaaacctaacattatgtagcacttacataaattataacttttcgtagggactggggttatccccaccctacacaacactagtttttagctgccacataatatcgtattctttaaaggggatttaaccgcttgttttactagtcttacaaggaaaatttctctataatcgaccgtctgcgataaatctaacgatttttccacaaaatcttgagcaaaattttaaaaggtataaatatgtctaaatttccaacaatttcagagattctttctggcaaagttgccgtaggggaagaagttgctgtacgtggttgggtacgcactcgtcgcgactcaaaagctggtttatcatttttagccgtgtatgacggttcttgtttcgatcctatccaagccattatcaataacgatttaagtaattatcaagatgaagtattacgtttaactgcaggctgttctgtgattgtgactggtgtgattgtagaatcaccagctgaaggacaagcggttgaattacaagcaaaatctgttgaagtcgtgggttgggttgaagatcctgatacttatccgatggcagcaaaacgccactctattgaatacttacgtgaagttgctcacttacgtcctcgtactaacttaatcggggcggtagcacgtgtgcgtcactgtttagcacaagccattcaccgcttcttccacgagcaaggtttctattgggttgcaacaccgttaatcaccgcttcagatacagaaggtgcaggtgaaatgttccgtgtttctactttagatttggaaaatttaccacgtggtgaagatggcaaagtcgatttcagccaagatttctttggtcgcgaatctttcttaaccgtatccggtcagttaaacggcgaaacctatgcctgtgcattaagcaaagtctatacctttggtccaacattccgtgcagaaaactcaaacactacccgtcacttagcagagttctggatggttgagcctgaatttgcgtttgcaaccttagcggataatgcaaaactggctgaagatatgttgaagtatgtgttccgtgcagtacttgaagaacgtaaagatgacttaaaattctttgagaaacacgttgataacacggtaatcagccgtttagagaactttattaattcagactttgctcaaattgactataccgatgcgattgaagtgttattaaaatcaggtaaaaacttcgagttcccagttgaatggggtattgacctctcttctgaacacgaacgtttccttgcagaggaatatttcaaatcaccagtagtcgtgaaaaactatccaaaagacattaaagcgttctatatgcgtttaaatgatgatggtaaaactgtggcagcaatggacgtattagcgccaggaatcggtgaaatcattggtggttcacaacgtgaagagcgtttagatgtgttagataaacgtatggtagaaatgggcttaaacccagaagattattggtggtatcgtgatttacgtcgttacggtactgtgccacactcaggcttcggtttaggctttgagcgtttaatcgtatacgtcacaggtttacagaatattcgtgaagtaatcccattcccacgcacaccgcgtaatgcgaatttctaatttttggaaaaaagataaggcaaggcgagagaatatctcgccttattgtttaaaccttgaatgataaggctttaagcccgtttttagcaataaatttgtctactgtgccaatttgtctattacaccaattttagtaagttatttaggaagagatttataaatgttctatcttattaaattcgattaactctcgcttttccccttggctttcaatcgcttggcgtagagcaagtgtggttggttcatcgtcttgataaagtcacttcaggcttgctaatccttgccctaaacccaacgagtgcaagttattttggtgagctttatggtggtgaaaaagccgatagagtttatttacacgcctatcagctcgatttttattatcactcacaacctatcagcgttcgtgtcttaccaagcggtcagttttggcaaaaacaaaacgatcaataatactcgtcttgtaattcgtcaaaggctgatccttcttcaaaaagttgctccaaaaaggtggctactttttgttttccctctttgcctagcccaaaaacgctaagatcgctattggataccgaaggtcgaactcgaacaatcgcatttggaaatgctttttcgacttgctctgccacaatgtctaaaagtcggttgaatttaccttgatccattttttgtaagttggctaaacgaatatcaatggttgcttgcataacattttcctcacctgactactgtatataaaaacattatatataaaaccagtttaactgtaaatagatacagatatttgttttggatcaaactttgatgctttaggtttatcacacgaagtgaagatcaaacttgatcctatcgtttactttgccggtatttcttataaattctaagaaaatcccatttcttacaaataaaataggcttccatcggaagcctatttttttagtggtacgccacaaatttgtctactatgccttctaaatcagcaccttcctcaacgccataaaaaatttatcattttcctctggcaacccgatactcacacgcaaatggtttggcataccatagcctgcaatcggacgaacgatcaccccttcgtgcaacaacgcctgataaatcggctgtgcaggctgtttcaaatctaccgtaataaaattgcctttagatggaatatattccaactgatttgccttaaaaaacgcctcatagcgttgcatttcattacgattattttctgccactttcgcaataaaatcatcatcttgcatcactgcaattgccgccgctaacgcaagactattacagttaaatggctgacgcacacgatttaataaatccgcaatttcagggtgcgaaaccgcataaccaatacgcaaaccagctaaaccataggctttagacagcgaacgagagacgatcaaattcggatatttctgcactaacgcaaaagaatttaatcgctcagcaggatcggtaaattccgtataagcctcgtccaacaccacaatcacatttacaggcactctgtctaaaaagcgttcaatttcctgttgcgataaaaaattccccgtcggattatttggattcgcgatataaatcaacttggttttgtcattaatcgcctgctcaaaggcactcaaatcgtgtccccaatcttttgcaggaatttcacgcgctaccgcattaatcgctttagtcacaagcggatagacaataaaggcatattgcgaataaataatctcatctttatcactggcaaacgtatgggcaaacagctcaagcagatcatttgagccatttcctaaggtaatttgattaggctgaaccccaaactttttctcaatggtcgctttcagctcaaaaccattggcatcaggatagcgagttaaatcattcaactgctttaaaatcgcttgtttcgcactttcaggaaaaccaaaggggttttcattcgaggcaagtttcacaatatttgaaatcccaagctcacgctcaagttcttcaatcggcttacctgcttgataaggggcaagggttttcacgccctcgttggcgatgttgataaattgcattgttgttccttttttcttgatgtttcgttgcagtttataccgtcgtcaattcatccgcaatcacttccgcttgttccaacacaaattggattgcctcatcgcatttatctggtggatatttgaataatctcaacgttacacgcaccaagtttcgcattttggcacgcacggcttctttatattgccagtcaatagtggcggatttacgcagtttatcggtaatcgcttttgccaagtttttcaaggcatcatcgcccaattctcgcaccgcactttcattgcgggcaagggcatcgtaaaaggcaatttctgctggcgataaacccaatttctccccacgttgcaagcgttcggcaaattccttgctcatattcagcaactcttccaacacttgcataatggtgagattttggttgtggtatttgtttaacgcctctttcaaacgctcggaaaaatctttttgcaccgccaaattgcctgttcctttttcattgatttggctacgcaaataacgctccaccgccaacagccaaagctctttggtttgactgtttttgattttctctaaaaactcttccgacaaaatattaatattcggctgttcacggttgagcaaatcaaacaggttaatcgcaccgcttgcgtccaccgctttatttaataatgccaccaactgcaactgacgttcttcgcttgaagcggtggaatttggctcacgttttgccaaaatcgcacgcaccgcatcataaaaggcaagctctttttggtactgctgaacatcgccgtctgcaccgcataagctaaagccttttttcgccaaacgtaccgcttttaaaaacgcattgcgtcttggggttttctcggttttatccgcaaccgtttgatgatctaaggcgagaatatggttcgcccccaacattacttgcttgaacaacgccagttcatcttcaattttcaaggcatcaaacagcttaaacggctgatcgttcacaggtgtagcaaactgcccacgcacaacatcaatatattccaacatctttgccttagtttcggcgatattgtgggtcatctgccctttgccgtgcgagcgagtatattgttctgtcgcttcccgaagttcgctggttagccccacataatccacaatcaaaccgccattatcacggcttttattgcggaacacacggtttacccgtgcaatcgcctgcattaaattatgccctttcatcggcttatcaatgtacatcgtattgcaacaaggggcatcaaaacccgttagccacatatcacgcacaatcacaattttcagcggatcgtcaggatctttaaaacggcgttccaacagctttttatcttgcgaagaatagatatgtttttgaatgtccgcaggatcgctcgccgcccccgtcatcacaatcttaatcgccccttcattcacatcatcgctatgccactctggacgaagtgcggtgattttttcgtacaatttcacacaaatctgacgactcatcgccaccaccattgccttgccgtcaattaaagcggtgcgttgttcaaaatgtttgacaaaatcttctgccaaacggctcaaacgcccctctgtccccattaatttttcacgcaaacggaagttgtagctactttcatcatcttcatctattaacgtttgggcttcttgcaccacattatcaaactcggcactctgtgcaatcggaatttgccgtgcttcataaataatcggcactgtcgccccatcttccaccgcatcggtaatatcgtaaatcgacacatatttaccgaacacttcctgcgtatctttatcttcaagactaatcggcgtgccggtaaaaccaataaaagacgcatttggcaaagcatcacgcaaatgttttgcatagccgacacggtatgtccctgtgcagtttttatcgttcagtttcacactttggctaaaaccatattgagaacggtgagcctcatcgctgatcacaataatattgtttcgctcgtttaacacagggtgagcctgctcgccctcttgcaaaccgaatttctgaatagtggtaaaaatcacaccgcctgtttcacgcttggcaagttcttcacgcaacgcctccctgccgtctgcctgcacaggttgctgacgaattaacgcctgaccgcctgaaaaggtggcataaagctgaccgtccaaatcattgcggtcagtaacgaccacaatagtcggattgcgtaactccgcttgcgacaacaatttgcccgcataaaacaacatcgacaacgacttgcccgaaccttgtgtatgccacatcaccccgattttgccattgccctgctcgctcgccgcccacagcgtacaatccaccgcttcattcacgccgtagaattgatgataagcggcaattttcttcactaaacgaccgcttgaggtttgctcaaacacaataaaattctggatataatctaacaaactcgcagggttaagcaagccacgcaccaagccttccaactcgtgttcaaacgaaatccgttgcttgctcttctcgtccaccacacgccaaggggtaaaccgctcaaaatctgccgtgagcgaaccgaccttcgccaaaataccatcgctgatcacaagggcttggttatacacaaacagatcgccgatttcctgcttataagtctgcaactgattaaacgcctgcggcaaatccgcattctctttcaagggatttttcagctccaacaccaccacaggcaagccattgatataacaaatcacatcaggacggcgattgcccttccgccccaaaatcgtcagctggttcaccacatcaaaacggttcaggcttggctgttgaaaatcaattaaacgggcaaactccaccttttgctcatcattttcccgatattccacccgaacgccctcacgcaagtagcgataggcttgctgattacgctccgttaaatctgtaatatccgttttgcacaccaacgccaccacttcgtccaccgtagcagacggcaactgcggatttaaccgctccaccgcctcacgcaacaccgaacgaaacaccacctcgtccgtccgcaaccgccaaggattttccccatcggcattgatggtcgaaccgtgcgtataatcccaacccaattcctgcaaaaatcgcaaacaggcttgttcaatggtgttttcgttgatgagcattgttttttttcctttttgaatataatcttgttttctttgttaatcactactgccaaatctcccccagcccctctttgctaaagaggggggcagatttcattgaagattcaaagaacaaagtcctacataaatattgtcaattttgcagatgaacatataaccaacctcaatccgttcccctcttttagcaaagaggaaagctggtttcattgaaaatttaaagaacaaagtcctacataaatattgtcaattttgcagatgaacatataaccaacctcgatccgtccccctcttttagcaaagaggaaagctggtttcattgaaaatttaaagaacaaagtcctacataaatattgtcaattttgcagatgaacatataaccaacctcaatccattcccctctttagcaaagaggggttaggggagatttggcagaagtaaaaacagcgtgagggattttttagccctcagattatgcctaaaattagtccttatacattgaaaaatactgtctccatttgaatattcttctttagtataattttgagaaaaaatatctaattttatatccgctgattttatacttctgagatttaaaatattactcacactaaacctccccactcaacaacttcggcaataataaatctcttactttagataaagattgattttcataaaaatgatgtagacgtttatcatatatttcttttactttctcagaatagaaatttagtatttcaatattagggattaatattttcactttactcatattctgaattgtaatttgaggctgaacagaacctgatgaaatttccttcaaattaatattgcttaaatatttctccaaataatacatacttacacaactgttttcatattcaataactaaagaattatttgtaacaaaagaatatggataacttaatgttacctgaccaacagtcccccgacagcctattaatacttgaggtttttcataagtgtagctatcgtagaaacctataacgccattagcaccaaaaacataaaatcctttttctgttaatttattcttaggtaagccttttccataaacaatattacaaacatcttttaaatatcgttcttcccaccccctcggcacgccctcttcatcaaccccactcggaaatgcctctgcgatttcccatagttgttggtattgttcgggatttgccgtctgcaagcggtgtaattcttgcgtgtttttaccactgatcactgccattgccgcttgggtggcttgttcagcggtttgtccgcttgccagtgcgttggctttggcgtgaacggggtcaaaatcaataaaccagcttttaaaaatcgtttgggcgatttgttctagggtttggttgatttgggtgttgagtgcaattttctcatctaaagtatataaaatatctgatacatatttctgacgttgaagactcggcaaaaaaataattgaatctttaatagcattagtacctaaattaacctgcacaccactattagatttactttgcaaagataaaatatattcttttgaattcataaagtaatataaatatttctcatcaacaaggtctttttttattaccctaatccttccaactctttgatttaatacaaacctattagatgttggtattcttgcagaatatcctaagatagccatactattcttcatatccgtcatagccatagcaatatctccttccaataagagatatttttctaagtttttaggataacttttaggaataaagactggtgatgaatcatctttatagccaccacctttatttatatatcccattctgaatacttctaaagcatcatcatttttttctatataatcttcatttttaaaagcaaatccattttgaaaatcacaaatctctttcaaagaatacttttctaaaatactcattgtaatgtccttagttataaaaacctaaaattcccaaattcgctttaatcttggcttccaactccgcactttgcttaaattgttgctgtaaaagagcggtcagttcttgcattttttctgcaaatggcacgccgtcatcttcttgctcggcggcaccgacataacgccctggggtaaggacgaagtcgttttgagcaatttcgtcaaggcttgcggtgtagcagaatgcagggatattttggtagtcggcggattgttgccagctgtggtaggtgtcggcgactttggctatgtcgtctgcagtgaagtcgcgtaagacacggtctttcatatagccaagttggcgtgcgtcaataaacagcacttcgcctttgcgagctttgtttttgttcaaaatccagatacaggctggaatttgggtgttggtaaagagttggcttggcagggcgatcatcgcttccactaggtcggctttgagaatatttttgcggatttcgccttcgttgttggtgttcgatgacattgagccgttggcaagcaacaacgccattcgtccgtttggcgaaaggtggtaaatcatatgttgtagccacgcaaagttggcgttgccttcgggcggtatgccatattgccaacgtgggtcttgggcaaggctttcgttccaccagtctttcatattgaacggtgggtttgccattacaaaatccatttttttatcacggtgttgcggattgctgaaggtgtcggcgttacctttgccgaagtcaaattcaatgccacggattgccatattcattgcggcaagtttccaagtggttgggttgaactcttgcccgaaaatgctcacttcgctgacgttgccttgatgttcgcggataaaacgttctgtttgcacaaaaaagccacccgaccccattgcagggtcgtaaatgcgtcctttgtagggttcgagcatttcgataatcagggtaacaatggattttggcgtgaaatattgaccgccctttttgccttccgcaagggcaaattgcccgagaaaatactcataaacgtgaccgagaatatcttttgccgccaaggaaatcggcttgccgtcaagggttggacggatgaaattggtattggaaaagagatcgattaagcctaataaaatgctttcatcgactttataagggctgatgcgttgaatgacgtttttgagtttagggttgtcttgttcgatggcgtcaaaggcatcatcaatcaggttggcaatgcctttaaaggttttctcgccccagattttgtcgccaatgttagctcgagccacgactttgatttcgtcccaacgggcttgttgcggcacccagaatacgttgtcttgggcgtagttgtcccgttcttccagttcggcattgagaatatcggcaagttcgctttcgctgtaagcggtcgggtcgagataaaaatcggacgttggatcggtgtagcgttgtttgatgatgtcttgttgtgccgagaagctgtcggaaacgtattttaagaagattaaaccgagaacgatgtgtttgtagttggcagcgtcaagctgttggcgaagtttatcggcagctttccaaaggtcggcatcgagtttgttgagaaaggcttgttgatctgcttgctgagtagctaaattttcagccagatgtgctgtgctgtgctgtgctgtgctgtgctgtgctgtgctgtgctgtgcattatactatatctccgtaaaaaaatctactcgtagggacacactgcgtgtgtccgaaaaatattaatgaaatcaaaaatacgtgaaaaacattgataacggacacacgcagtgtgtccctacaataaattatttattttctgcctcaaacttctgcataaacgcaatcaacgcttgtacgccttcaatcggcattgcgttgtagattgatgcacgcataccgcctaacactttgtgaccttttaaggcttgtaaaccgcaagcggttgcttccgccacaaattttgcattgagttcgtcgttgcctgtggtaaaggtgacattcattaaagagcggttcgctttggcaacagtgttgcggtagaagttgctgttatcaaggtagcgataaagtaattctgctttagcttgatttcgtttttcgacttcggctaatccgccgatattgagcaaatgcttgaataccaaagaacaaaggtaccacgcaaatgtcggcggtgtgttgatcatggagtcgttattggcttgggtttcataattccaaatagatggcgtagatttacgggctttgccgattaaatcctcacgtacaatcacaagggtaatccctgccggccctaaatttttttgcgcaccggcataaattaagccaaattggctgatgtcgattttgcgggaaagaatattggacgacatatctgcgaccagcaccgcattgcctactttcggcacatcaaaaatctctactccgctgatggtttcattcgggcagtaatgaacatagtcgtactgctctgcaatctcgctaaaatcaaggctacccaccttgagttcatcgccttgctctaaaatattgatttcatcaatttcacagaaattgcgagcttctttcgccgctgtcgctgaccaatgtccgctagttaaataaagcgccttgcctttttcgccgattaagttcatcggaattgccgcaaattgccctcttgcaccaccttgtaggaataaaattttgtagttttcaggaatgttatagagcttacggaaattttgttcacactctgcgatcatttccataaacaatttaccacgatggctaacttccattactgaagtgtgttgattttgccaattcaacaattctgcttgtgctttttctaatacggcagtcggcatcatcgccgggcctgcactgaaattataaacttgtgtcattgtgtttgcctcttataaaaaatggtgctttgcattctagcggaaatatggggctgtcaaaaatttcaatttttatagcttctcacgtcgataatataaggtttctgatacttcaaaatcatagtatctgcggtcataaaaaagacattttctacttccgcctgagccattaatagacgatcaaagggatctcgatgaataaaaggatactgagcttgttttagaatatggggtaattcaatagctagcattcgacaacctacctgaattaagccttgctctaaggcttctacatcaatgtcaaaatcaggtttacctaaactagatttaatcgcaatttcccataaacttgctaaactaaaatagatttcactggtcgggtcatcaagtaattccaccgcttgtggcgataggttttcttttttatcccacgcaagccaaagcaaaatatggctgtctaataagatcttcattcctcttttccttcaaacattgccacaatttcattttgatacaagcggtcaaaatcttcaggaatttgcatattttgctttttcataaaaccaaagcgactgccattttgtatagtatccaaaggcacaattttaacctgtggtttacctgattttgcgatgatgatcggctttccaaaacgtttcacatcttcaacaatgcgagaaaaattggtttttgcttcgtgcatattcacactttctaaagattgatttagcataacagcccctttttcttagtccgataagtgagtctagtcttattttctagcttattcaagagattaattcgtcgcttcccccattaccgcctcaatctccgcaatctctttcggcacacccgaagtgagatttttattgccgtattcagtgattaagagattatcttcaattcgaataccaatgcctttatattgctctggaacatcggcatctttcgggatatataatccaggctcaacggtcagcaccataccgatttcaagcggtcgatctcgttcattgccatagtcgccgacatcgtggacatctaagcctagccaatgtcctaagccgtgcatataaaattgtcggtaggctttattctcaattaactcatcaacattgccttttaatatgcctaaacgtaccattccttctgtcataatacgcactgctttatcgttagccagtttgatcgagctttgcggtacaagcagtttagtcgcttcttttaaggcttccaatacaatttcatacacctctttctgagccgtagaaaatttaccattaataggaatagttcgggtgatgtcgcctgcatacattgcaaactctgcccctgcatcaattagcagtaaatcaccatcttttaacacttgatcgttctcattatagtgcaaaatgcacgcattattgccccctgcaataatttgattataggacgcaaagcgagagccaaaacgagaaaattcgtattgaatttctccttcgatttccatttcgtaacgatttgggcgagtttgtttcattgctcgtaaatgcccaaaggctgaaatttggcaggcttgttgtaataaggcaatttcggcttcagatttgaacaatcgcatttcagagagtatcggttgccaatcaatcaaagttgttggggcttttttacggcttgcagtgatggcatcaaaggttgcaaaaacaatctgatcgccccacgtttgcacatttcttgcatagtaacaagcggtcaaatctgtccatttttctgcaagaatggtttgaatatcttcgatatcgtaggcttgatcgacgtttaacgtctgtggtgcaacttcaatacctaaacggcgaccgttccacgtttccattagcggatcttttttgcgtaaaaaaatcaagctctcacactgccctgcttttttcagcaacactaacgctgatttaggttcagcaaatcccgtgagataccaaaaatagctatctggacggaataaatagtcgcagtcgttattacggcgtttttctgtttcggtaaagacaatcaaggttgagttgtcttgcatttgttcaaacaaactctgacgacgagtgtgaaattcttcttgggggagtttttgtaaataagcgagatccataaccattccttaaaatcgatttttgaacgttacaagcatacctatcttcactgaaattgacaaatgttaatgctgtttccaactgttctaacaaattaattcgactgaaatctaacattacgctttaaaaaaccattgattacaatcaataaaacacccaaaatataagtacggacacactgcgtgtgtccgtaaataaaaaatgaaccatttaaattaaagtgtccgtagggacgccacgcttggcgtctgtttcatttaaccttactttacgggcggacacactcagtgtgtccctacgatattgatatttgtaaaaattatattgacattggacgccaagcgtggcgtccctactatatcttttgtttaaatgctatacataacaacaggtaaaaccgtttctttcaatctttaattattttttaaaagctcgcaaatacgctttttaaggaaaacactatggcaaccattcagcaatttttagatatcgttgagcgtttacgcgataaagaaacaggctgtccttgggatattaaacagacctttgacacaatgcttccgaatgtattggaagaaacctatgaagtggcggaagcaatttatactaaaaatcgtaccgctttgcgtgaagaattaggcgatctgttgctacaagtggtatttcttagccaattagccaaagaagaaggaacctttacctttcaagatgttctaaacgatattcacgacaaattaatttatcgccacccacacgttttcggagataccactgccactaacagtgaagaagcactacaaaactgggaagcacaaaaagccaaagagaaagaagcgaaacagcaaacgtctatattagatgatctgccttttgctctgcctgcccttactcgtgcagacaaactgcaaaagcgttgtgccaaagtcggttttgactgggataatccgcaagatgtctttgccaaagtggaagaagaattggctgaagtgcaagaagaaattcaacaacagcaaccggaaaaattagcagaagaattaggcgatttattatttgcaatggtcaatttatgccgtcatcacaaaattgacgcagaaactgcacttcgccatgcaaatgtaaaatttgaaaatcgctttagaaaaattgagaaccatctgatttatcaagggaaaaaaccgcaagactgcacattatctgaactagattttctatggaatgaaataaaaaaagtagaataaattgacaaaattaggtaaagtaatactatagatctgtttatgtaaagataatttatgtaaatagtcaagaaatgatcaatggaatagggaaatagagctatgccaaaaattttacttgttgacgatgatgtagatttaactgaattactttcagaattactctctcttgaaggctttgatattcatactgtacacaatggtcaggatgccttaactgaattaaagatacagagttacgatctcattctacttgatgtcatgatgccaattctcaatggtattgaaaccttaaaacaggttcgtcaaaaatactcaaccccagttcttatgttaagtgcaagagatgatgaaatcgaccgtgtacttggtttagaacttggtgcagatgattacctgccaaaaccgtttaacgatagagagttggttgcacgcataaaagctatcttacgcagatcaataacgcagaaaccaagtatgccagttgaaaccgctttcattgtgaatgatgatgacgaccgaaaactgttacaatttggtggcgttgagcttcaccccggtcgccaacaagcgatttacgaaggaaaagatttagatctcaccggtacggaatttgcactattacaaattttaatgcgtaaccccggacaaattcttttacgcgaactcttaagccttgagattttaggtaaacgtttaacgccatacgacagagcgattgatatgcatatatctaatttgcgtaaaaaacttcctgagcgtaatgataaccttccatggtttaaaaccttgcgtggtcgtggttatttactggtgactgaaaaataatcataacaaaataaagtccctcagcttgtgtatagttgggggatttttctatctataggttagccgttatgttaaaacttagaaatttccgaagatatttagcctatcaaatctttgcctcttttatggttattattgccattattttggctcttgctattttactgccaagtttagatactcgtcgtttcaagcaaattgacgattttcaattaggctttttacagcacgaaaccaaatatgtagaacaagaatataatttagacgaagtgtttcgcctcaatctctctgtagcatctattaatggttttgacattatcctctttgatcacgcctcacaacaattagcaggaataagagaggaaaataatgaagctttccacgcttttatatataaggcaaaaaatcaccgccaaccattacaaagacgcttcggcacaatggaattttacggtccttttcttgcaagttctcacactcgcacttacgacctctatttcactaaaaaagtgaaccctcaacgagagctcattaatacattatttgactcgccttggataatgctacttttgtttctttttgtcagtagcccagtgatgatctggctatcgtaccgcattgccaaaccagtaaaagaactgcgtttaaccgcaaatgcagtagcacgaggaaacttagccatcaatcccaaattagaaacctcaggcattgaagaactccgtcaagtaggagcaagttttaatgaaatgattgtcgcattagaacgactaaccaactatcagcatcgcctcttatctgatatttcgcacgaattaaaaacccctttgactcgaatgcaattagctttatctctcttgcttcgtcgaaatggtgaaagcagtgaaattactcgtattgaaggtgaaattacaaaactggacacaatgattcacgatttattggttttatctcgtaaacaagctaatcaccatctagagcgaaaagtctttccaatccataaaatatgggacgatgtattaaatgatgccaaatttgaattggaacaaagtggatttgatttagtcgtaagccaacgtatcctccaccctgagcgttactttgtaaatggcaatgttgtattgttagctagtgccgtcgaaaatgtcattcgcaacgcaaaaaaatatgctcaaacaaccgtaaaagtgatgttttacattgatgccagcgatctttatattcttgttgatgatgatggagaaggtgttccagaagatcaatataaagagatattccgtccgttctatcgtgttcaagaagacagagcaagacaaacggggggaacagggcttggtttatctattgttgccaatgcaatacgacaacatcacggttcagttagagcagaaaaaagcccattaggcggattacgcgtcaaaatgcaattgccgttgtgggtggaataatatcaacatattgtcaatatctttaaccttgttatgaaaatgtagatataatgtcgcactttattcaattttcaggtaaaacatgcgtttagataaatttatagcagaaaacactgggcttactcgctctcaggccagtaaagcgttacgagccgggcaagtcacagttaatggtgtagttgaaaaaaatagtgcaaccaaaatcagtgagcaagatgagatctgttttgatggcgaaccactagcttgggttgatgaagggcaatattttatgctgtataaaccacaaaattgtgtttgctctcacgatgatggcgactacccgacggtattccaattttttgactatccacttaccacaaaattacattgtgcggggcgtttagatgctgacacaacaggcttagttttattgaccgatgacggacaatggtcacaccgcattacttcccccaaacatcattgtgaaaaaacctacttagttacccttgctgatcccgtggaagatttttatgccacgcaatttgccgaaggcattttattgcgtggtgaaaaaacagcaacaaagccggctaaacttgaaattttagatgattacaacgttaatctaactatcagcgaggggcgttaccatcaagtcaaacgtatgtttgcggctcttggaaacaaagtcgttgcgttgcaccgttggcgaattggtgatgtggtacttgatgaaaatcttgctgaaggggaatttagagctttaactgaagatgaaatagcgagtttttaaatgaataaaataaccagacccaacgggttatttgtagtgattatgggattactctcaatgttgccaccgcttgcaattgatatgtatctgccatcttttcttgatattgcccaagatctgtcagtatctcaagaaaaggtgcaaacaactcttgcgatttttactttcggctttgcaattgggcaacttttttggggaccaattgccgatagtttcggacgtaaaccgattattttacttggcttatctggcggggctgtcgcagcttttttcttaacgcaagtattgagtattgaaaatttctatctattgcgtctattacaaggcttatttggagctgcacctgcagtggtacttggggctttagtgcgagatatattcgatcgcaaccagtttgcccgattaatgtccaccattatgattattacgatgatcgcaccgcttgtagcgcctattttaggcggatatgtagcgaagtggctacattggcacgctattttttatattttaatggtgatggggattgtctgcgtttgtttagtagcaacgcttattcctgaaaccttgagtacagaaaatcgaatgccgttgagttttcgtcaagtactacaaaattttacgacattgatttcccataaagcaacgttaggatatgttctcgttggtggaatgtcctttgcaggaatgttttgctttcttacttctggctcgctgatttatattgggctttatggggtttcatctgaatactttggctacttttttatgctaaatatagctgtgatgatggtgatgacctttatcaacggacgacttgtcaccaaaatcggctcagaaaaaatgttacgcattggaatgagcttacaactcctagcgggtatttggctgattatttctgcgacattgcaattaggtttgtggtcaatggcaattggcgtggcattttttgttggaatggtttcgaccattggtagtaatgcttcagcggcaattttagatcgctatccacaaatggcaggtaccgccaatgccgtagctggtactgctcgctttgggattggttcattagttggggcaggattatcccatattccgctaaccagcgagcgtccaatgctctatacgatggcggcttgtacggtagttggatttattgcctattattttctctcttgtagaaatcagcaacttcaatgacttttgcctattaattcataaaacagataatctttttttcgattgataaaaatcctaataaatccaaagcattaaatcttaaaaccataaaaacaagaagatttagcataatatgctaacatatcacttaatatgccaacttaaaacctatttcacagaataaaaaaatgcaattttcccaaaaatagcattttacttttgttttgagtagcgatatattccaaatcattcttttacaagcggttggatttgtaagaagttttaacaagatgtagggacacactacgtgtgtccacataacatcggtaaacggacacacgcagtgtgtccccacgtttatgttccatattgaaatgttgtggtaattttttatgtgatccccccgcttgtccccttgcatttgagagttggacttatgaaaaaaaccttatacgaaaaattatttgatgctcacgttgttcacgaagctgaaggtgaaacacctctaatttatatcaatcgccatttggttcacgaagtgacttcaccacaagcctttgacggtttgcgtgcgatggggcgtgaagtgcgtcagccaaccaaaacggtggcaacaatggatcataacgtacctaccgatagccgtgatttaggtggttcaggcgaaatggggcgtattcagatggttgagctggcaaaaaataccgagcagtttggcgtaaccctttatgatattaaccatattaatcaagggattgtgcacgttatggggcctgagcagggtttaacccttccaggtatgaccattgtgtgtggcgactctcatacggcgacacacggggcatttggtgcattggcgtttggtatcggtacatcagaagttgaacacgttcttgcaactcaaacggtaaaacaagcccgtgcgaaaaaaatgaaaattgaagtgcgtggcaaagtgcgtgaaggcattacggcgaaagatattgtgcttgccattatcggtaaaactacgatggctggcggtacaggacacgttgttgagttctgcggtgaggcgatccgtgatttatctatggaaggtcgtatgaccgtgtgtaatatggcgattgagcttggtgcaaaatcaggtttaattgcaccagatgaaaccacttttgcttatttaaaagatcgtccgtctgcaccgaaaggtaaggattgggacgatgcagtcgcttattggaaaaccttgcacacggacgaaggggcagaatttgatactgtggtcactttagaagccagtgagattgagccacaagtgacttggggaacaaacccaggacacgttatcggtatcaatgaaacgatcccgaaccctgcggatatggcagatccgattgagcgtcaatcggcggaaaaagccttagcttatatgggcttaccgcacagtattaaattgactgatgtggctatcgacaaagtgtttatcggttcttgcaccaactctcgtatcgaagacttacgtgcagcagccgccgtggcaaaaggacgcaaagtcgctgatggtgttcaagccttagtggtaccaggttcaggcttagtgcgtgaacaagcggaaaaagaaggtttagataaaatctttattgaagcaggctttgagtggcgacaaccaggttgctcaatgtgtttggcaatgaacaatgaccgtttagagccaggtgaacgctgtgcttcaaccagtaaccgtaactttgaaggccgtcaaggtcgtggcggacgtactcacctggttagccctgcaatggcagctgcggcagctgttcacggcaaattcgtcgatattcgcaacgtagaattacactaaggaataagaaaatggcaaaagaatttaaacaacatactggtttagcagttccacttgatgcttcgcacgttgataccgatgcaattattccaaagcaattcttacaaaaagtgacccgtgtcggctttggcgctcacttattccacgaatggcgttttttagatgatgaaggtaaacagccaaatcctgatttcgtgctaaattttccacgttatcaaggggcaagcattttattggctcgtgaaaactttggttgtgggtcttcccgtgaacacgcaccttgggcgttagatgattacggcattcgtgctattatcgccccaagttttgcggatattttctatggcaacagtttaaataaccaaatgttgcctgtacgtttaagcgaagaagaagttgatgaacttttcaaatatgtcgaagcaaatgaaggtgcgaccattaccgtcgatttagaagctcaaacggtttcggcaaatggaaaaacctactcttttgaaatcgacagtttccgtcgtcactgcttgttaaatggtttagacaatatcggtttaactttgcaacacgaagaaaaaattgcagcttacgaaagcaaaattcctgcgtttttgcgttagttgcagataagtttttctgtttaaaacgtctacaattattggtggcagttttgtctattacaccattttgtggggcatagtagacaagtttgtctactatgcctgtctctgctgagaatcagcttttacgaataattaaatgataagaacacgccgtgtttctacccatcaacaccccaatctctcgctcaatctgtgctaaagtggttcatatagacaattaacaacggaattttcccttgttcaaataattttacttcctctttccaccaacatttttctaataaaatcgaatgatgatataaagtttttagctgtgataaactttcagcaaccgcttgattttaggatcttcaaataaatctttacgataaaaaagcatcagaaaacttggatcaaagggaacctaataaatttttttgttgaaattggcaaaaactgtgaagaacattgcttgaaaaatagttcgataatgtttctaaagaaagataattttcttctttaatccgctttataatttctcgctctttttcttcctggttataagtgagataaagttcaaaaataaaattatcttgctgaaagtttgcattcagattttcatacaggctactatattttacatcaataatatttggcagaataatcgcaattttattgcttacgccccgttttaactgagccgcttgcatattgcgttggtagactaatttttcaatcgcacgctgtactttttcaattttgtctaaacttacgccactcttgccatttagcacatttagaaaccgtacataaagaacccctgcttctttagcaagatcttttatcgttacaatcattgtcgtaccttaaaactttactgctctatttttgccttactatacaaaaataactattaccatgagtcaagcacatgaaacatgtatttacattatgttaatcagttttccagtattatgtagctttgaaccaaagaaagaacagtaggaacgccacacttggtcttcctactgtataaaaagtttatgcatatattatacagcctgaagataattttcatcgttttattctcccgacactttcaatttttccaataaaattgaacctgtctgaatattcgaacgatgttcaatatcatcaccaacagcaacgatatttttaaacatctcttgtagctgtcctgcaatggtaatttctgcaacaggatattgtatttcgccattttcaacccaaaaacctgcagctccccgtgaatactctccagtcacgccattaatcgcactgcctaacatttcggtgacaagtaaacctgttcccatctctttaagtaatgcagttaatccccctgtgcgattaggtttgactagccagttgtgaataccgcctgcgtgtcctgtcgtttgcatacctaattttttagcactgtatgtcgttaaaagataggtctgtaatgcgccatctttaatgatttggtgatcgcgagtgtaaacgccctcgctgtcaaaaggtgatgaagcaagttggcgaagtaaatgcggtttttcgttaatttcaaaccaagtcggtaaaatctgttcacctaatttgtcttgcaagaaactggctttgcggcataaagctccaccactaattgcacctgcgaggtgtccgataagccccgtggcaatgtcgttataaaaaatcacaggaacttcacaggttgccagtttttgagggtttagacgatcaacagctttgactgcagcttgttgcccaacccattttggcgaagcaagttggtcaaattgacgagagatagtgtattcgtaatctcgctctaactgatcttcataggctgaaatgacactacaagagagggaatatcggctagatagatagctttgtagcataccgtgtgtgttgccataaactctaatgcctgcgtgtgaattgaaggttgccccttcgctattgacaatgcgatcatcgctgtgtagtgcatagtgttccgcttcaatagccagttcaaccgcttgatcaacggtaatgtctgcttgatgatataacgccaaatcgggggcttggtatgccatcatttttttatcggctaaacctgcacagtcgtcctctgaggtatattttgcaattgcaagtgccgattcaaccgcttgttgaatagattttggttgcaaatcggaagttgaagcattgccctttcgtttaccgagatagacagaaataccgagtgagccgtcgttgttaaattcaatattttctgtttgttctaagcgtgtagaaactgataagcctgcgactttggttacgcccacttctgccgttgcacccgctttttgggctaaatccagtgcaatttcaacggcttgacgtaaggtttgttcttgagcttgaagttcttgtttggtaataaatgacataattttccttctataagcggtaggattagcgaaaatttttgtaaaactgttctcttttcacttaatctcgccattctactctaaatttctgataaactacgcaaattttgtaaaagaaaggaatagctatggctaaaaaacaacgtaatgagattgattggacagatgaagaagaggagatcatctgggtaagtaaaagtgaaattaaacgtgatgcggaacatcttaaaaaattaggggcaagtttgatagaactgaatagtgctaatcttgctaaaatgcctattgatgataccttgcgtgaagcaattgagttagcgcaacgcttacgtttagaagctcgtcgccgtcaaattcaatatatcggaaaattgctacgcaatgtcgatcacgaacctattcaggaagcattggataaagttgaaaatcgccataatcagcaacaagccctattgcacaaattagagttaattcgagatgaactcattgagcaaggcgacagtgcaatcaatccgcttgtagatgaatatccgacattggatcgtcagcatttacgcaatttaatccgtgccgtacagaaagagaagcaagcaaataaaccaccgaaaaattatcgtgaaatttttcaatatttaaaatctacaattattgaacaaaattaaataaggacaaaattaatgcaaacgatcttttatactcatattggtttagcttacctcagcttaatgctattactggttcgcggattactttccgcaagaatggttgattggcgacaatataaactcttaaaaattgcaccacacgctgttgatagcttgttattactgtctggtgtgggcatttttgtctatttcgccatggattttcaaacgtggattttagcgaagttattctttttggtgatgtatatttattatgcgacaaaagccttcaagaaagagcaacctttttctctcaaacatttcattcttgctgtcgtcagttttatgatggtgatgatggtagcaacagttaaataaacaataaggcatagtattactactatgccttatctttatagatgaataaaataacttctgtttctgactctattttgcttttgagctcgcactgaatttcttggcataataaaataatatcgtttaataaaacgtctttattaaaatgaagtttcaaactttctccgctattcaactgtaacattcccctctttgccgacaaaagaggaagagggcaacggtaagcggtgagatcaagtgaataattcaccattaaacccgacggcgctctgccataatctgcccgattgagttgagttcttcttggcttagatgctctcgccctaattcaaaaagcggttcttcaatcgcaatatgttgatcgtaacctaccacaaagcgttggattaactcgcggtcaatgtgttgaatttcgccattgagtaaggcgactaattgggcggagagttcgtcccaattttgatgtaattcaatgtgttgtgcttcgagcaaatctacgtccgtttgcgcttctgggcgttgcttaatcaatgctgggaagaaatctttttcttcgtcatcgtggtgtaagggtgcagattgattgaagtaatttaagatctgctgtacatcatttttgaccgcttgatttaccccgtttttcgctaagtaatctggcaacagttgtaactgacggcagaaacttttgacctttccgtggcaagcataaagcatttcaatcggttcatcccaagtgacaaattcttgaggagttaaaatgtacatatagttatccttttgtgtaagtattacatcatcacatgtactggatattatatatagtaaataatcctaaattaagcctcaatcataaaaatgtgttactatctgaaaaataatgcgacctactgtggtaatgatttggctaaatcctattgagtacgtttgattccttccccctttttcccttttctgatataatcctgcctaattttcggcagattttgccgttgtcgatttaagttaatataggaacaacaatgtcagaacaaaatcaaccaaatagctatgattcttctagcattaaagtattacgtggtcttgatgctgtacgtaagcgtccaggtatgtatatcggagatactgatgacggcacaggtttacaccatatggtttttgaagttgtggacaatgcaatcgatgaggctttagctggttactgtaatgatattgtcgtgactattcattcggacaattcagtgtctgtgcaagatgatgggcgaggtattcctgtggggattcaccctgaagaaggagtgtctgcggcggaagttattatgaccgtattacacgcaggcggtaagtttgatgataattcttacaaagtgtcaggcggcttgcacggggttggggtgtcagtggtaaatgccctctcgtccaaacttcaactgactattcgtcgtgaaggtcacgttcacgaacaattttatagtttaggagatcctgatgcacctttagcagtaattggagaaacagaaaagacaggaacaaccgtccgtttctggccgagttatgatattttcaaaaataaaacggaatttgaatatgcgattttatctaaacgcttacgtgaactttcattcttaaattcaggtgtatcgattcgcttaattgatgaacgtaatgataaggaagaacatttcaaatatgagggtggtatccgtgcttatgttgaatatttgaatgaaggtaaaaacgtaattcacccaacgccattttatctttcaacagaaaaagatggtataggcattgaaatttcaatgcaatggaatgatagttttaacgaaaatgtatattgtttcaccaataatattccacagcgtgatggcggtacgcacttagcaggtttccgtggtgcattaacccgtgccttgaaaaactatatggaaacaggggcaaaactaaaaaagaagatgccaaaattgatgcgtcgggtgatgatgcacgtgaaggtttagtcgctgttatttcagtgaaagtaccagatccaaaattctcttctcaaacaaaagataaattagtttcttctgaagttagaaatccattggaaagctcaatgaatgaagcactacaggaatatctattagaaaatccaaatgatgctcaaaatattgtgactaaaatcattgatgcagcccgtgcccgtgaagcagcacgtaaagctcgtgaaatgactcgtcgtaaaggcgcattggatttaggggggttaccgggtaaattggcagactgccaagagaaagatcctgcattatctgaactttacttagttgagggggattctgcaggtggctccgcaaaacaagggcgtgatcgtaaaaaccaagcgattttaccgttaaaaggaaaaatcttaaacgtagaaaaggcacgttttgacaaaatgctttcttcacaagaagttgcgacgttaattactgcattaggtgcaggtattggtcgtgatgaatataacattgagaaattgcgttatcataaaattattattatgaccgatgcggacgtcgatggtgcacacatccgtaccttgcttttgacattcttctatcgtcaaatgccagaattaattgaacgtggttatgtctatattgcacagccaccactttataaagtgaaaaaaggtaagcaagagaaatatattcaagataatacggaaatggagcaatatgaattagcattagccttagatggtgcttcactttacgtaagtgataaagcgccagcattaaatggcttagcacttgagaaattaattgctgaatataatgatgttcaaaaattgtttgagcgtttaacccgtcgttatccaactgctttactgaatgaattaatttatcagccagccctcacgacagaatttgtaaaaaatgaaactgaagtgaccgcttggaataacaaaattgttgagatcttaacagctaaagaaactagtggaagtacttatgttgcagaggtattttataatgcagaacgccatatttatgaacctcaagtaattgttactacacacggaattagcacaacttactgtttggatttcaattttattacaagtaatgaatatactcgtattactaaattaggcgaacaagtaagcgatctccttgaacctacagcgtatgtacaacgtggtgaacgccagcaatcaatagaaagtgttgccgaagccattgattggttggttaaagaatctcgtaaaggtttaaccattcaacgttataaaggcttaggtgaaatgaaccctgagcagctttgggaaacaacgatggatcctgtagcacgtaagatgttacaagttactattaccgatgcaattgcagcagataaactctttacaacattaatgggtgatgaagtagaaccacgtcgtgattttatcgaaaataatgccttatatgcaaatttagacatttaatccctactaaattattttgtagggcgaatatctattcgtcttattcttttctactcagactgtttatttgaggaacaaaatgaaatacgaactaaaaaaaacaaacggcaacgctcgtcgtggtcgattaactttttctcgtccaaagggcgaatatcacgttgaaacccctgcatttatgcctgtggggacttacggcacggttaaaggaatgacccctgaagaagtggcgcaaacaggcgcgcaaattctgcttggcaacactttccacctatggttacgtccagggcaagagattatgcgtcagcacggcgacttgcacgattttatgcaatggcacggtccaattcttacggactcgggcggtttccaagtctttagtttaggcaaattacgcaaaatcaaagaagaaggcgtttatttccaaaacccaatcagtggtgaaaaagtctttttatcccctgaaaaatcaatggaaatccaatacgatctcggctcggatattgtgatgattttcgatgaatgtaccccatacccagcggcctttcattatgcaaaacaatctatggaaatgtcgctacgttgggcaaaacgcagtcgtgatcgctttgacgaattacaaaacccaaatgcgttattcggcattattcaagggagcgtttatgaagaattgcgtaaagtttccgtagaaaaactggttgaaatcggctttgatggctatgcggtgggcggtttagccgttggcgaaccaaaagaagatatgcaccgtattttagaatatgtttgtccgcaaatcccagccgataaaccacgctacttaatgggcgttggtaaacctgaagatctagtggaaggcgttcgccgtgggatcgatatgttcgactgtgtaatgccaactcgcaacgctcgcaacggacacttattcgtcaccaacggtattgtcaaaatccgcaatgcgaaatatcgcaatgacatctcaccgcttgatcctgaatgtgattgctacacctgtaaaaactacaccaaagcctacctatatcaccttgataaatgcggtgaaattttaggggcaagattaaacaccattcacaatttacgttattaccaacgtttaatggcagaaatccgccaagcgattgatgaagatcgctttgatgattttgttgtcgaattttatcaacgtatcggcaaggaagttccaccgttacaattagccaaagagggtgaaaatgcttaattaatttgacaaacacaatagtaaattgctgtttaaacttgcagagttacgttgtaaattttcttgatcaaagtaaacattgactatagattttctcaaattatcacaaggagatataaatgagaaagctcacatatctaacttcacttgctatttttacaagtgctttacttggttgcagttgtagttgtgaaaaaacgcaaaaaccacaggaagagaaaaaggatgatcaggcgttgtttgaggaaacgctaaaccctacgccccctttaccaataagtctgttaaaactgcctggcccaccaacggtcaatttgttagcaaccagtccatcaaatactgccgaatttaatgactttatcagcattatgggacaaaatggggcagtgattacgatgtggtctgttgatcgtcgtagctggctttggatgtatccgccgcttaattctcaagattttggcaaattgcgtaattggcgaattgagcggagcttccgtcaagaacattttcgttttactaatcagcagatgggatcttgtatgcaggcttatggaaatggtgtgattcaagatagctgtgatccaaataatttagatcaagattttgagttactgccaacctcgacaggatcggtgttcattaaaagtgtttctcaacaacgttgcttaacttacaatgcggtgagtaccactggctattttacgctgactttggatcgttgtgatgataaacgtattacaccgttacacgatcaaaccttctatctcacaccaccattacttagtgctaatccattataggaggaaaaatgacgttatttaatcgagctatagcattagtatgttgtttacttcctcaaattgccttggcaaatttggaaaactatacggttgcaacgtggaacttgcaaggttcttctgcgattaatgaaagtaaatggaacatcaatgttcgtcagcttttgacggggcctcaagcggcaggtattttaatggttcaagaagcaggctctttgccatcaacagccgttcatacacgccgaatggttcagcccgagggggttggctttccaattgatgaatatgtgtggaacttagggacaagaagtcgtccaaataatgtttatatctattactctcgcttagatgtcggggcaaatcgagttaatcttgcgattattgctcgtcgtatggcaagcgaagtatatgtgattaactctggttctagtgtattaacctctcgtccagccataggcattcgtattgataatgatgctttctttagtattcacgctctatcttcaggcggtgctgattcattaagtttgattcaaaatattcatacgttctttaatactgaggaaagacgacatatcaattggatggcagtaggtgatttcaatcgttctccaggcagaatgcaagaagcattaaacacagaaccaggattaagcaatgccacattaattgttgcaccaacggaacctacccatcgttctggcaatgtattggattatgcagtgttacacaatgcgaatcaaaccacacaaaacacgacggtcagtgccagcattatgtttaatcagatgagatcgcagattacctctgatcatttcccagtcagctttgtgaaaaaacgttaagggggaactatgttaaagcgttttactttattgatgacattaggactatgccagttttcccttgcagaaacaccaccgatgccacctgcacctacgccaacaccatcaacttatcctgatgttgttgaaataaagccccctgttatctctttacgcagtttaaatacgggggagcctgtatctaatcgtagctatgatcgcaatgatccaagagaggtgcagtggcgacttgttgatgctattgttaaaaatcgtcggttcgtacaatttaaagtatttgataaagaagatcgttgcttggttggagatggtggtactttaccctgtggacaaacagacactttatttaggttagtcccaaccgatacaggggcatttattctgacagaccccaatacgggaaaatgtttaaccagcgagaattatggcagttatggttttcaaaactgcttgcgaacttcttctgcagaacctagcaatattccgctaaaacatctttggatcattgctccgccttttgggcctagtaggttattataacattacaatttttaggggctaaattgatttccattccaaatgatgtaagatgttgtttatacaagatttttttaaataaaaggcatagttttcacgaaattagcaaccattttgtctactatgccaaataaaaagggttgctaatgtttaaagaaaacaaacattagcaacaaacttgtctactatgcctttgtaaaattagtccatcaacattttaaatttactgcccctattctttgatgtacaagtacattatttagatgtagataccttcactacttttatatgaaataacgaattaggtgataatttataaatataaaaattatcattatttgcatgtatctcattagctaaaataaaagtatcgctatattttgccaatatataataggttttatgatcaatatctattatatcaaaagtatttttaaaattaggacgaatataacccgttataaaagcaaacattacaaaacagcaatatgtacagataattatatacacctgatttttatataaaaattgcatagttgctttaacagaaatacttggaatattatgatttatatagttcttaaatattaaagtaaataataatatcaataataaataacctaatccgacataagtgttacatcttcctattgaagcaatatagccaaatagaagaggacttagccctatgcaaatcaaaatatatgctcgtaaaaattgaatatacggttctggcatatatttcttagcttttattagaatatataatccaattaaataagtaagaaataaaatagccgtattccaaagcacatatcctaaacttctagcaacattactaattcccacatcaacataccaccaagggaaaccataaaagtatgactgcccccaaccataggcataagcaaccgaccacccagttacccccaaaaaagccattgaaatagaagaagaaataaatttattcgcaattttcaacataatatacctacaacttatgcggcaacttttgccaagtcacttcatttctcaaataaacaggttcaatatcaaacgccgactgtacttttccttgtacaaccttctcaattgccaaagataacatatattttgctgatggtaaggtaatctccgttactttgacagcgaggttagcctgctcaaattgtggataggctgcccagcctgttcctacaataaccgtattttgggtaggttgcatttgagcaattgctttttctggcgaacagacttgctctacaacctgagtttgccagccctgttctgttcgttcaaattgtgcaaaatagacctcattcattcgagcatctattaatgcaatcacactgttagcattcaaggtttgataagcctcttccgccattgtcagtaaattagatactggtacaacaggtaattcggcaccaagagctaacccctgagcgatcccaacgccaacacgcacccccgtaaaactcccaggacctcttccgaaagcgagaacatcaatctgttgcacagaaatccccgcttgtgtcagcaattcatctaccatcggcagaatgcgttgagtatgggttcttggacttaattcatcaataaatgtggttttaccttgatgtaacaaagccactgagcaggcttcagtggcagtatctagtgctaaaatagttttgttcataatgtcatataaagaaaataatgttgaactcgcttgaaaaaagcgagacgacataataccaattatttgcctaattgacggcgttttgctaccgcatcagcaagttggaatagcactttttcactgtcctcccagccaatacagccatcggtaatactctgtccgtaaaccaattctttaccttcaactaaatcttggcgaccttcaacaaggtgactttcgatcattacccctgaaataaggtgtgagccgttcgcaatttgttgtgccacatcattgcatacatctaattgacgtttgaactgtttttggctatttgcgtggctgaaatcaatcataacgtgcggacggcgaccagatttttcgatatccacacacacttttgcaatagagtccgcatcataatttgtgccattatcaccgccacgcaaaataatgtgacaatctggattacccgctgttgaaacaatcgcggaatgcccgaacttagttacggataaaaagtggtgaggggcttctgctgcgccgatcgcatctaaggcaatcttcacgccaccatttgttccatttttaaagcctacagcacaagataagccagatgcaagttcacggtgaacttgtgattcggttgttcttgcaccaatcgctccccagctcataaagtctgcaacatattgcggggtgatcatatctaaaaattcccctgcagctggtacggttaaatcattaatatccgataacactttgcgagcaatacgcaagccgtcgtttagtgcaaaagtttcgtttaggtaaggatcgttaataagccctttccaacccacagtggtgcgtggtttttcaaaatagacgcgcataattacttcaagatgttgattaatatacggatttgcacgcatttcttgaatttttttcgcatatgctaatgcggctttcgggtcgtgaatagaacaaggcccgatcaccactaacaagcggtcatctgctccgtgtaaaatacgatgaactgcttcacgagcggttgcgactgtttccgctgcaacatcacttgcgggaaaacgctctaatagtgccactggtggtaacagttcttcaatatggttaatacgaacatcatcatttttatacattgtgttgcccactttattgctcattgctataaatccttatgttatataattgttattctttctaaagtaaaagaatgccataggtttgtcaaatactccaaacacctttatctcgccagcacttctcgcttgcctcgactatctggagcagaaataatcccctgttcttctagttgatcaataattctcgctgcacggttaaagcctagtgagaagcgacgttgtacgccactaattgaggttgccccaccgtcaatcataaattgagcaatttcgtcaaacagtggatctaactcaccgcttgtgcgttctgagttttcgccattttcatcaccctctggtgttgccacaatgctttcaatatattctggtttacctctcgctcgccagttatccgccacacgctgaacatcttcatcggtcataaatgccccgtgaacacggatcatttcagggctgcccgcaccagaatagagcatatcgcctcgccctaataaagattctgctccgcctttatctaaaatggttcgagagtcaatttggcttgccaccgtaaatgcaatacggcttgggatatttgctttgatcaccccagtaatcacatcagttgatggacgttgtgtcgctaaaattaagtgaataccgaccgctcgtgctttttgggcgatccgcataatgtgatcttccacctgtttacctgccgacatcattagatccgcaaactcatcgacaatcaacacaatgtagcttaatttttctaatggtggtggcaaactatccattgtatcgccaggtcgccacaacggatttggaataggcagatccattgctgccgcttgatcgattttcgcattaaacccctcaatgtttcggacatttaaactactcaccagtaggtaacggcgctccatctcctccaccgcccaacgcaacgcattttcggcttttttcatatccgtcaccaccggggtcagcaaatgcggaatatcgttgtaaatcgacagttcaactactttcgggtcgatcataatgaagcgaacctgctcaggcgatagcttgaacaataggcttaaaatcatcgtgtttactccgaccgattttccgccccccgtctgccctgcaaccagtaaatgcggcatttttgccatatcgaccacaatcggcttgccgctgatgtcttttcctaatgccatcggcaatgtcgctttggtatggcgaaactcattgctatccagcacatcacgcaaccaaactgtttcacgctgacggttaggggtttcaattcccatataaggtttgccggggacaacatctgtaatacgaatggcttcaaaaatcagcgaacgtgcaagatctgaagctaagttggtaatcttcgccgctttcacgcctgctgccggtttgatttcatagcgtgtcaccacagggcctaccaacacatcttccaccgttgccctcaccccaaagttcgctaattcacgctcaattcgagctgaggtatctcgaatttcttgctctgtaatttgctgttcttctgatttcactgtcgtcaataaatcaatcgtcggcaacggcgtggttggcttttcgacctttctcttagtttgtaacaacgggtgaataaggctatcgccatagcctttcggataagttacgcccttcttttcaggctgtgcctctgctgttgctactttaggttcaaatagcggtaggttttcttgtaaaaattgcacagttgattgtgcttcttcaaacggctctactgtaggctctgccgccacttccaccacagggtttaaacgcacctttggcattaccggctcagtaacgtttggcataatcactgtttcttccggcgactcaaaggaagttgatacagaagggacagaaacatcaaactctggaacagtaatgcttggcaatgaacttgggttctccactttaaattttgttacatcggttaattcaacgtcagctgcgacttcttcctcttgaacggttttcaagcccgtaatatgcggacgagtaaactgagaaacatctgtgtattgtgggttatctacggtttcttcgctttcactctccgcttcgactttctcctcattttcctctgtttgaacagcctcgtcagtatttaacgtactcggcttatcttcggtttttccttccacgatccaatgatacaagcggttaaataattgcaacaaaatctgtcccgaacaaaaatagaaacctaccgccgttaatagcattgcaacgagcaacaataccatttgagaattgagccaagacgctaacattcccccaataaaaccacccgaaagatagtaaggggaattttcaaacaatacgctcgacaaccccgccagcccgactaaaaataagaaaaagctccctagccaaaacccaattttcgcccagtttagatcgtcagctaaccgtaaaatcaatacataaatcgacgtaaatgccagcccaaaaggaacaaataccgcaactttaccaaacatcgcaaagagcaaatcaactaaatacgcccccaatgcccctgttttatttaatgtttcgtgggtaatagaacttgccgtactccaagcattatccaacggactataactcgcccacgccgtgatcagataaatcccaaaacacgccgaaagcaacaacactaatctaatcaggttctctttcccttttaaacgatcaatcacagctaatccttatttcaaaagtagatagttagtttgcttcacttcttccatcaccacataggtacgagtgtcgttcacccctggtaaacgcaacaaggttgttcccaataatttacgatacgcctccatatcagccacacgagttttaagcaaatagtcaaaatcccctgataccaaatggcactcttgaatttcatcaagttgttgtaccgcccgattaaattcctcaaagacatcaggtttaccacgaacaagagtaatttctacaatcacgagcaaaggggcttctaataattctggattaagtaaagcacgataccccattatgacattctgtttttctaaacgtttcacacgctccaaacaaggcgttggcgaaagcccaacacgtttagagagttcaatgtttgaaattttaccattacgttgtaattcatttaggatttttaaatcaatagcgtctaaggcttttgttagttttttattttccatttgaagacctttctagcggattgttctaaaaactccattctatcacttctttttagagggactaaggctatttgcaaaaaacaataattacagcaatcatcatctacatacattattgtctcaccattcttaaattttctggtattccttcaaaatttgagcgaaaaggattaatatctagccctccacgacgcgtataacgagcatatacagtcaacttttgaggctgagcaaattccattaaatcacaaaaaattcgttcaacacattgctcatgaaattcgttatgttctctgaacgaaactaaataacgcagcagtttctctctatctaattgcttccctacataacaaatttgaatacttccccaatctggttgagaagtaatcaaacaattagatttcaataaatgacttactaatctctcttctacaatttccccatttgcaataccttgtaaggactctcttgtaaaatcataacgattaatacagatgttttgattatctatacattctccattaaactcagaaattgatcgcatagcaaaatcagataatttataaatttgcactgtgacatctccttgggcacatttacttaaatcagactgaatacgtctttgtacatcttctcttgaaggaaaacgcatttgattaaaactattcaaataaagtttaaaactttttgactcaattatatttgaactactactatcaataataacatctgcaattgctacttggggcactccattttgattaagccatgaaagttcatagagagtccaaatatctgctcctaccgtaaaaggttgctgtttaacaatacctaaactctctctatttaaataacgaggtaccgcttgtaacaaactaggatcataagtacttttatactctgttttttttcctagttttaacatggaaagacattcattattgtaattcattttaaatccctcactcttacatcaaaaatcgttgccaacaagttgctacatactgacgttcatcaataaattcgctggcatcaacaatactctctttattcaataaatttaaacgatgaatttgatcgcgtaaaccagtataacaccctttcaatcgttcaccttcatctgcagtcaaaataccacaatccaccgctcgttcaaaaatacgaacattgtccgaccaatccgccatttgtggatattgatgggtatagtttaacacaagatactgagcaataaattcaatatccgtgatcccaccttgatcggtttttaaataaaaccgccctgcggtagttttactcagatggtggtacattttttctcgcatattgcgaatatcttctcgtaactgaccgcttgaacgctcttggcttaacgtttctcgccgaatttgctcaaatttttgtcgaagttccgcagtaccatatactgcacgagttcgcacaagggcttgactttcccacgtccacgcctcgtgtttctgatagtggttgtaagcattaaatgtactcaccaacaacccagcttctccagagggtcgcagtcgcatatccacttcataaagcacgccagcactggtattcaagttaaaaataccattaattttttgggctaacttaagataaaactgatggctcgaaatggatttttttccgccaactgtttcgctctgttcaggggcattgtgtaaaaacaccagatccaaatctgaattatagccaagctcaattccccctaacttgccataagcaatcaccacaaaatctttctcgccgttttgtaaatgttcaggctcaccaaaccgctgtgccacttgtcgccacgctaaattcaccacttccccgataatagcttctgccagataggttaggtgatcgctgattttcattacgggcaatacccccaaaatatctgcccctgcaatacgcaataaatggctctgtttaaactggcgtaacccgtcaatcaatgcttcttcgtcgtcctctgggatacgcaacaaatactctcgcaaggcttgaggataagcctcaagcggtaagatcgtcattaaactttgctgaaaaatcaactcatcaagcaacatcggataacgtgcaatttgctctgctaacattattgattgcccacacagttgcaatagttgaggcaaaatctgctctttttctaacaacaattcaaggtaagtggtacgcaaggtgattttatctacgatcttcaaaatgcgtggcaataacagtaaataatccgcctcgtgaaaaatctgatccaacactttcggcatcagcttctgtagcacctctcgccctctcactccaatcgggcgtttcacccattcttgtagagtggttataagctgttggtagatctccctatgagcttgagttgctacaggataggtcgcaagaacagtggctaaatcctcttgggtaagttgtacatttaaaatatctcgccattcggcaaattttgggttttcctcaccgctttcctcactgccgtcctcaccaatcaattcattaaaaatcgctcgaacattctgctggtgttgatgtagttgcaataaaaagctttcccaatccattgccccatttgcaaccgccaaccttgcccgatccacttcatttgtcggcaaggtttgtgtctgttgatcattaattgcctgcaacacattttctgtgtgtcgcaaaaatagatacgcctcacgcaaattattcacctgcgtttcgctcaacaaattcaactgagccaactgtggcaacactgccaacaaacttcgttgctgtaaaattttatctcgcccccctcgcatcatctgaaaggtttgcacaataaattccacctcacgaataccaccagcccccagcttaatgttatctaccagcccttgccgtaacacctcacgactaattttctgcttcatctctcgcaacgactggatcgcactaaaatccaaataacgacgatagacaaaaggacgcaacatctgcttcaaatacttatggttaatgttcgtcagatcttcgcctaaaattttcgccttaatcatcgcatagcgttcccaatcacgcccctgctcttgataataatcctccatcgccgtaaaactcagcaccaaagtaccgctatccccaaaaggacgcagtcgcatatctgttcgataaacaaagccatcaagggtaatttcgtctaacgctcggatcaatcgctgtcctaaacgagtgaaaaacttactgttttccatcggcttcctaccgcctaccgtttccccaacatcaggataggtaaaaatcagatcgatatccgacgaaaaattcagctctcgcccccccagtttacccatacccaaaatcagcaactcttgcttttccccaagctcattcatcggcgtgccatattcgccacacatctgctcaaacagccaatccctcgcccccaaaatcaaggcttcagctaaatccgacaaccgctcaaacacctgctgggtcgaagctcgctgattagattgaataaaactcaaggttgccatttcacggtgacgaaaacgacgtagctcacgctgtaattcttcttcatttttcaccgtagaaatcaccgcttgcaaccgctctgcataacgctcacaatcctcaatttcaggcgatttttcaagccaagcggtcaataattcaggttgtttttgcaactgttgagccacgaaatccgacattgcaatagctttgataagcggcgggatttggggggaatgttgcggatgttcgggaatttgatgtaacgtcattaacgtcttcaatttcatttcagcttgagcaaaaagagaattaaacataagaggatctcaaagttgggtggtttggggttattgtacggggaaaacaggctagtaacaaagatatcataaaagtgaaatacataaaccttatcccaaatatattaaagttaagacatacatttattcttcattattttttaattcacatgctttcattgttaaaagagctttttccaatcactctttttcgcaaacgccactctattttccgtatgtttaattcgggtaaagctaatttcccacacatcgctactcatcaattttgcaagtggatgcttttgccaataaatttgtaaagcagtttgtttttcttgttcattctcaagacaacgagcaacggcttgaaattgaatgccttcaatctctcgaatgttgtcgggttgccctgcaatagtgcctgtaatgttggggttggctaacatcaatttgccgtgttcggtagtttgctttgacagcacgatcaagcggtgagatttttcatcaaatgcgtaaaagcaactggctgaccaaagctgattttgatgatggcacgcaaggctcacaacgtgatttttcaagataaattgcacaatgtgcgtaggaattggattattcatctactttcctgtccagcgtggaatatcaatttcaagatcaaacatatctaacgcacgagcgacgctatgggtcacaatttcatcgacggttttaggttgatgatagagtgctggcacaggcggaaaaataataccccccatttcggtgactttacgcatattatccaaatgagttaagtgcaacggcgtttctctcaccattaacaccaatttacgtcgttcttttaacactacatcggcggcacgagccaataaattatcgctaaaaccgtgagcaactgatgctagggttcgcattgagcaagggacgataagcattccaatagtcttaaatgaaccgcttgaaatagaagcgcctaaattgtggatagggtgaaccacatcggcaagggatagtagctgttcttcgctgatgttggtttcatattggcgagtgagttccgccccttttgaaatcaccaaatgggtttcgatattgtctagcggtttaagcagttcaagagctttgtagccatactgaaagccacttgcaccgctaatgccgataataatgcgtttatttaacatatttttccttgtaggttgggcatttatgcccgacgtttatgtaattggttttatgttgattttatggattgtaataattgtcgggcataaatgcccgacctacttcagaaatacttgaaaaaaatagcaaactggttactatgtgccactttattttgtttaatccgaatttgttaaattatgcaccaagacgctgttcaagacacgcaaaaagagaaaaaaattgcctataacttcaataaattgcaaaaacgcttacgccgaaatgtaggcaatgcgattgcggattttaatatgattgaagatggcgacaaagtaatggtttgtttatcgggtgggaaagatagctatactttgctggatattctgctcaatttaaggctcaacgcccctattcattttgatattgtggcggtgaatttagatcaaaaacagccaggcttcccagaacacgttttacctgagtatcttgagagtatcggcgtagagtataaaattgtcgaagaaaacacctacggcattgtgaaagagaaaattcctgaagggaaaacaacttgctcgctctgttctcgcctgcgccgtgggattttatatcgtactgccacagaactaggtgcaaccaaaatcgcgttaggacatcatcgtgatgatatgcttgaaacactttttttaaatatgttttacggtggaaagctcaaatctatgccaccaaagctaattagcgatgatggtaaacagatcgtgatccgaccgcttgcgtactgcaaagagaaagacattgaaaaatatgccgtggcaaaacagttcccgatcattccgtgtaacttatgtggttcccagcctaacttacagcgacaagtggtgaaagagatgttgcagacttgggatcgtcaatatccaggacgtattgaaacgatgtttagtgccttgcagaatgtggctccatcacatctatgcgatccaaatctctttgattttaaaggcattaaacgtggtcagctaattgacggtgttgaaggagatattgcctttgataaagcagaaattccgtctgctcctgtggttcaagataaagatgatgcagcagattatgcggaaagcggtttaattcagattaaagcggtgagttagtcgaaaaaatctgcaaaaagcgaaataaacgtttgcttttcatttttttctaggatatatttcggcacattcaattttggagctactatgaacattctctcaaacattcgtcaccgtcatcaccatttacctgaataatctttcgggcatttggcgtgttcggaagaaacttccgagcggtgcaaaatgagagtagatctaaaaaccaatttccaccccttcggaagatgatttcgaaggggttcttttttatctcgtagaattgaataataggtttatttttttattacattaagaggaaaacacaatgttattatcaaacgatgtggtcatctcgattatcgtgttactcgcattaagtttattgcgaattaacgttgtaattgcgttgattattgccgccttaacttgcggtattttaggtaattctggcaacggaatggcattaggtgaggctttaacgacaaccgtaaaaagtttcactggtggtttaggcggtggtgctgaaactgcaatgaactatgcagtattaggtgcttttgccgtcgctttatcaaaatcaggtgttaccgatttactggcatataaaatcattaaagcctttggcaaacgtccatctggtcgttcactgttttggtttaaatatgcggtactctttacgttagttgccttcgcaatggcatcacaaaacgttattccagttcacattgcgtttatcccaatcgttgttccaccattacttagcgtaatgaaccaacttaaaattgaccgtcgtgcagtcgcttgtgcattaacctttggtttaacggcaacttatatgttaattccagcaggtttcggtcaaatctttatcgaaaatatcttggtaaaaaatatcaaccaagcagggcaaccatttaacctagtgaccaacactgcagaagttactcaagcaatggcaattcctgtggcgggtatgatcgtgggtttattattagcgttctttgtaacctaccgcaaaccacgtgtttatgtggaagatcgcccagaaccaaccgctgatgatattgaagctcgtgtagcaaatgtgaaatcattccacatcggcgtgagtatcgcagcaattgttgctacctgttttgttcagttatcaacaaactcaacggtattaggtggcttagtcggtttgattatctttgccgttggcggtgtgttcaaacttaaacaaagcaacgatattttccaagatggcttacgtttaatggcgatgatcggctttgtaatgattgcagcttcaggctatgcaagtgttgtaaactcaacaggtggcgtggctgaattagttgaaggcttaaaagactcgatcggaagcaaaggtatggctgcattcttaatgctcttcgttggcttattaattaccatggggatcggttcttcattctcaacagtaccaattattacctctatctatgtaccattgtgtctttcattcggtttctcaccgcttgcaacagtatcaatcgtaggcgttgctgcagcgttaggtgatgcaggttcaccagcgtctgactcaaccttaggaccaacatcaggcttgaatgctgatggcaaacacgaccacatttgggattccgttgttccaacctttatccactacaatatcccgttattagtgtttggttggattgcagcaatgattttataggaaattccccccccctttttttcaaagggggggaaattttgttttaatttggatcattttctctcattaaatcccctttgaaaaagaggcatttagagagatttaaaggacaatatgaaattcatctcttttaatatcaatggcttgcgagcaagaccccaccaactcgaagcgcttattgaaaaacatcagcccgatgtgatcggcttacaagaaatcaaagtggcagatgaagatttcccttacgatttagtcaatcaccttggctatcacgtttttcatcacggacaaaaagggcattatggcgttgcacttttaaccaaaaaccaaccgcttgcagtgcgtaaaggttttccaacggacaacgcagatgcacaaaagcgtatgattatggcagatcttgaaaccccattcggaacccttaccgtcttaaacggttatttcccacaaggcgaaaaccgtagtcacgaaacaaaattccctgctaaagaaaaattttatgcggatttacaacgttatttagaaacagaactcaagcctgaaaacccgattatcattatgggcgatatgaacatcagcccaacagatttagacatcgggattggcgaagtgaaccgcaaacgctggttgcgtgatggcaaatgttcatttctacctgaagaaagagaatggctaggacgtttacatggatacggtttagtcgatactttccgagcaatgaacccaacggcagaaggcaaattctcgtggtttgactatcgctctaaaggttttgatgataaccgtggtttacgcattgacttagtacttgcttcaaaccctttggctgaacgctgtgtcgaaacaggcattgacttagaaattcgagcaatggacaaaccttctgaccacgcacctgtgtgggcggtgtttaagtaattatttaataaggtggcttgcccaccttatttttcatcctattacgattcatttttccatttcactaatcgctcaataagatagactaattccgaacgttgctggctatctaattgctgtaacaatttttcgataactttggcttgatcgatcgaacggttactggtttctgtcactaaatccgccacttcacaatgaaaaatctctgaaagctccaacaaacgcaaaacagttggaattgttttgccccgttccattctcgaaacagcatcattgctaatgcctaaaatttccgctaattgtgcttgcgttaagcctgatgcttgacggtatttcgcaatcgcttgcccaatcgtttgtattaattgctcacttttatctaacacacgatttctccctttataaagaaagaaataataggcattgactttttttgataaatagcgaatgatacttatattagactttaaaaatctaaataaaataaaagagcaaatttatttaaaaatttttgtaaaagtctgatttttttgttgagctgacacaacctgtcgtcaccatttgggtacactgtacgcattcaaaatcagaggatttaaatgtatgcaaaagaatactgttctagcacaacgacttagtgaaattttatccctgctcaatcagggaaaacgcattgatattaatcaacttgcggaagattttggggtaagtgttcgtaccattcaacgtgatattaaagatcgtttagcctttctagaatgggaagagagcggaccacgacattacaaaatcaaccgttataaacttggcttactttctcaacaagacatctctcgttttgcgttatttgccagtatttcagaccttttcccaaaggtagatcgcgatttttatcaagaaaaactcaccgacagcgtcaaagtgaaaggttttcaatatgaagacattcgccacttagacaacgaatttcaactgatcaaacaagccattgaagcacataaatttatcgattttttatataagaaaagcggtcagattgatggcaaattttacaaaatcgccccttatagcctaatcaataaaaatggcatttggtatttaatcggcacagatgaagacaaacagaaaacgttctgcttcactcaaatcacaatgctcaagatgcttgatgaaactttcgaaccaaaccaacagctacaagaagagatcaaaagtaacgacagtatctcttttggcaatcagctcagtgaagtcttagttaaagtatccagctttgcctccccttacttccttcgacgaaatttactgcctaatcaaaaattagtgcataaatcggaaaacggcgaacttattttagccagcgaaaacgtaaacgaactcgacatcgtaccgcttgtgcaatattggattccccatttaaccatcatcagccctaacggcttgcaggaaaaaatggtggagaagttgaaacaatatattgcgaatgattagggggaaatatgaaaaaaattgatattagcgagccattttcaaccattaaagcattaattaatgaacgtcaaagttttgaaacctgtggcattgatgcaggtaatttattcgcctttagtcaagaacttgaaaaatatattgaaagtttaaatttgaagtgtcgcctttataccaaaaatcgcttagccgtaggcttatcagcggtattaaatccccgttggggcattttatcccttgcagcaattgcagcacataatttactgaccttaaaccccgactgtgagatctatcgagatcttgcgaataaaagggttggggtggtttggaagaaaaaattttcttcgtaaaaaatgtttttaaaggaataagatatgatgagtaagtttggcgatgaatcaaaaccaattaatggctttttttaaatataaaaagcgtatagaagatatgacaccagtagagcttatacaacgtggttggccttttaatattttcaaaaatccaacagaagaaacgaagctagctgcagtaaaagtggatggttgtgctattcaatatattgaaaatccaacagaagaaatgaagttgcttgcgattaaagaaaatggttatgctattcgatatataaaaaatccaacagaagaaatgaaacaagaggcagataaacaggaggatcctctatgtttttataagggaaaataaactatatagatatttaaatgatctattccgcaatttttataaaaaaagaaacgatgatttagtattttcactaaagtatttctatcttttgtaacaattgctatataaattactgaccttaaaccccgactgtgaaatctatcgagatcttgtgaataaaagggttgggggggagtggaataaactgtaattattaggagaaattttatatggcttatgtctatgatgttgatttagagtttttagctcaatgtacaaacgaggatctacaacccttagtagatattttaactaaggataaagatggtaaaaaacgttatacggagggcttaacaagctctagagtttacaaagtattttaccctgatcataatctttattggaaagagattgcagaagaaattcagaaattcggagcaaatactattgctacgttatttagactagggaaaggggtttcatataaaactattcttattgaagtttgtgaaaaaatgaaagtaaatttcaataaagaaagttcaaccgaacttattgaaaaacatttattggataaagtattaactagtgctatcgaagagctatctgaagatgatttaaaaaaattagcagaagaattaaaaattccagctactcatttaggtaaacaatctttaacggctcttgttctagttgaattaaattctcttttatctaccccagttctttggaagactattcatacaatgtttcctcaaactatcggtacactattagcaggcacagccttagggcgtattttaggctttgccacaggtcctattggttgggggataacaggaatttgggcattaaaagatatttcaggtcctgcaactcgcgtaacagtacctgctgtgatccaaattgcatttttgagaaaaaagtattctatcaacaattaaaccaacacaaacaacaggagaaaaatatgtttgtacaaaatttaacagcagagcaacaatctgcattaatttacttagcccacgaaattgcacgagcagatggctcttcagatgaattgcaattaggtatggtagagattctaacaaagcaatcagaagatggtgtaacagaaaaagcaattacagttgatgaacttgttacgttatttacaacggaaagagcaaaatgttcactattacttgagttattaggtgttgctcacgcaaatgaagaatatcatttaagtgagaaagatatgattgctgggtatgcaagaaaactgggtatttctaatgaaaaattaaatgcactagaaagctgggtagaaaagcaatttgctttatctagagaagttacattattgttagattaagcataggagtttattatgcctttaccgtttattttggctggtgctgctgccgtgactataggaacaggaattaaaaaaggaattgatggttttaaagataattccgctgcaaaagatattactgaagccgccgaaagtctttatgatacagaaaaaaagttatttgatgagcaagatgccgcaactaatgcatcattggaatcattaggtcaattgcaattgtccataggttcagactttgctgaattcaaacgcatttctgaattgctattggaaaaattagctcaacataaggaagctaaagacttacaaattaatattcctaaaaatgaattagataaaattgaagggattgctttttcagctgtcgcctatttagggcaactagctggaggggctgcaattggtgctggtgctgcttatgctgtttacggtggtgtaatggcattggctgctgcttcaactggcactcctattgcagccctttctggagctgccgcatataaagctaccatggctgcaattggtggtggtgctatttctgctggtggctttggaatggctggaggtgcagcaattttaggtggtgttgttgtagctccaatagtattagttgctggcttagcttttgcaaaacattcggagaaaaaacttgaatcagcaagagattatcgtacacaagttaaaaatgcagttagtagtatgaaacttggtcgccatcatttaaaagaaactgaggaatattcaaataagatctataaagaacttaatcgtgtttatcagatttttggtcaatatttccaagatcttaaaaatatggataccttagttcgtaatggagttgatatcaataccatctcatcagcaattattaagattgttgataatggttataaagtagcagctattttaacagatattattactaccccattatttaaacctaaaaaagatgataatggagagttagttaaaaacaaagaagatactgttgaatttgaaacagataaagatggtatgaaagtcattaataaagaagatattgatgcgcatattacgttatcaacatataaatcaaaagattttgagtaaattatgctaggcgagaggaatctcgcctttttatagggagtgaaatatgtcaaatgtacttatgactaagcctgaatttgattggacaggtgaattagaaaaaacggtagtaaattcattagtcactacttttggtttagatttcttgctttttgaagataagcgtggtggagatgttgatactgttcttaaagcacgagaatatcaaaaagaaattaaacaaaaggggagttcaacaatccatgtttcaaatgaacttgctagtcaattagattctaatggaagaaatatagatccttataagaaagttaaatacgatcaacagggaaatgttcaaaaagatggtaaaggaaaagtaaaaaaagaagatgattatcatggaaaaagtacattatatacaaaacgaaaagctaaagataaagaacaagaagatttaggaaccatggttgatggttatactggagagaaaatcaatgcagatgatatcaagaaggaacgaaatgggaaagaatttgagtatgttacagaattagatcatgttgtcgctgcaagtgaaatacacgatgatttaggtcgaatactatctggattagatggcgtagagcttgcaaatagcgaagataatttagtttctacacactggattataaataatgaaaaaaatgatcataactttaaaacctttcttgaaaaaggtggcgttagagatcaaagagttgagaaaatggcacaagagattacccaaaagaaatctgaactgaataatagtaatctatctcaagaagaacgagctaaaaaagaaaaagagctaagaatcctagaaagaaaaaaagaaattttagaaaatcttgatgaggagcaatgtcgtaaaatagaaaaagatgctagagataaatataataataaaattaattataaatattatacaagttccaaatttttcaaatcaacagcacttgcagcaggtaaagctggtttaaaaatgggaacacgtcaggcattaggtttagttcttgcagaaatttggtttgagttaagagagagaatacctgagatttatcaaaatctaaaacaaaactttacgattacaaagtttttagaaaaaattgctaagacattaagtaatatttttgaacgtgtaaaagaacgttttaaagatcttttaactgcatttaaagatggagcaattgcaggcttttttagcaacattagcactacagtaatgaatatatttcttgtttctgaaaaaatggtggtaaagctcattcgtgaaatgtggaatagcattgtaagtgtaattaaactaattacttttaatccagataatcttaatgcaaaagaattgtttaaaggcgtattaaaaatacttaggaccctatcccaaattctgtgtaaacacccatttcaacttaatggtgatcgtctaggcgatcaccaaaatcaatcataaatcgattcatcgccagtttccagttctgaatcggcattgtccatttttttgatgcatctttaatcgcaagccaaatcactttgaaaactgaatcatccgtcgggaatacatttcgttttttaatcacgcgacgaatcacgctattaagcgattccacggcattcgtggtataaatcgctttacgaatgtcagccggataatcaaaaaatgtggcaatatttgcccagttatcttcccagcctttcgccacaagcgggtattttgcctgccatttttgcgaaagtgcggtcagattttcgcgagcctgtgcttccgtcgaggcctgataaacctgctttaaatctgcggtgacggctttgtaatctttccacgaaacgaatttcaaagctgttacgcactaaatgcacaatgcaaagctgaatcttcgttttaggatagactgcattgatggcttctgggaagccttttaaaccgtctacacaggcaataaaaatgtcttttaagcctcgattttgaagctctgtcagcacatttgcccagaacttcgcaccttcattttcagcaatccaatcacggtcacgaggcgtctcaatttctatctcaccttcatcacaaatgacggtcttagatgtgtaaccgttacgtgcatttttaccttttctaggctgatgtttttcataaccaagatggtcggtcagttcaccatttaacgcagcctcgacggtgattttcttgagcatccgtgaaaattgattgaggtcttctggtgtttttaggtttttggcaaattccgctgccaaggcgtgaagttgtttttcgttcataataaaatacctgtgtctgaatgtattatctcagaaacagttatttacacaaattgtgggagaggctcgctagtttagcagtcaaatgagttctttagcttctttcccctgcaattcctgtggcaaatgctgtcgccgagtgaatttaagtgaacaaaccgcttatttagatcgtggtgatggcgtttgccatcattttgatgaacaaactaatttgtgcaaaatctatgaaaaccgaccgcttgtttgccgagtggaagattactataaagcccatttatctcatctgtatagttgggaagagtttgttaaattgaatttagaaatttgcaataaactttaaaccaaataagaaataggaaataatatgaatttttttgatattttagggcgagtagccaaggctattagccgttctgtaggaaattctatggaaaatcacataattgaactttggaataaattaaaacatctcgacaatgaccgatttatttcatttataaattcaaaggatacattaaatactcaggtgtatatatctgttttatctatatattccaagagtatcaattcttattatgatttcatttatacaataggaaaaaccaagtataacaaggatgaaataattagaggaaccttgcgtatatgtaaatctaatattattcaactatctaataaaagagaaatgaatgaaattagacagatagctaataaatttgctactgaattttcataagtgcatagttagtatttaatatacccattttaccaaatgtaaggataagaaaatgaactttgaagaacaacttgttaaagaagtcgttgctcgtatgacggaagaagaaaaatgggaaacattcaaggcacttcaaaagtttgattttgatgaaatggatagaatgtttgaagaatacgataaaaaacttagaaatattgaacaaacactcaggaaaagtgaacagctcttggaaaaaatgaaagctgaacataactctagaaaggtgtaatagacaacatagtcgctaaaaactggctcaaagccttatagtataaggctttaaagagcctctcccacaatttgtgtaaatacctgtttctgagataatacattcagacacaggtattttattatgaacgaaaaacaacttcacgccttggtagcggaatttgccaaaaacctaaaaacaccagaagacctcaatcaattttcacggatgctcaagaaaattaccgtcgaggccgcgttaaatgatgaactgaccgaccatcttggttatctaaaacgaagattcagctttgcattgtgcatttagtgcgtaacagcgtgaaattcgtttcgtggaaagattacaaagccgtcactgcagatttaaagcaggtttatcaagccccgacggaagtacaagctcgcgaaaatctgaccgcactttcgcaaaaatggcaggcaaaatacccgcttgtaaagatgcatcaaaaaaatggacaatgccgattcagaactggaaactggcgatgaatcgatttatgattgattttggtgatcgcctagacgatcaccgttaagttgaaatgggtgtttacacagaatttgggatagggtcgttataagttatccccaataatttgacaatgccctctaatttcctctgtggaaatttcagtcattaatttatatccaaaatacttcttaatttccctttcgtaagtcgcaagtcttaatgctcttgtactttccgcaaaatcagtttcggcaatatatttaagtgcaaacgcttcaaaattattcgcactttttatttgatttttcttcttccgtttttctgtggctggagaaatcccatcactcaccattttacgagccatcattagcttttctcttgcttcaacaagagatatgccgtcctttccatattttcctattgttaatgtttctcttcgtccgttaatacgataatcatacctaaacgtaaccgtgccagcaggagatacaacaacgtacaatccatcacgatctgctactttataagccttatcctttgcttttaaagatttaattttactatctgtcagcattcttcccccctattttaaaataccgtcaaattaatgacggtattttgatattaagggataaacagctcaatccttaccgacaatttttacgcaaaaaaaattgaaatactatgaaaagctgtgaataggtgggatattattcccactctatcgtagctgggggttttccgctaacatcatacaccacgcgagaaatcccgttcacttcgttgataatacgatttgagattttacctaatagatcataaggtaaatgcgcccaatgtgcagtcataaagtcgatagtttcgactgcacgcagggaaacagcccaatcatatttacgtccatcgcccattacgcctactgatttgactggtaggaacacagtaaaggcttggctgactttgtagtaccagcctgaggcgtgtagttcttccataaagatcgcgtcagctcggcggactaaatcgcagtattcttttttgatttcacctaacacacgcacgcctaagcctggaccggggaatggatggcggttgagcatttcagctggtaagcctaatgccaagccgattttacgtacttcatctttgaacaattcacgcaatggttcaactaaaccgagtttcatataatctggcaagccgcctacgttgtgatgcgatttgatcacgtgtgctttgcctgttttgctggcggcggattcgattacatctgggtaaatcgtgccttgtgctaaccattttactgaagtgagttttttcgattcatcatcgaacacatcaacgaatactttaccgatagttttgcgtttcgcttcaggttcatcaatgcctttgagtgcatctaaaaaacgggcttcagcgtttacacgaatgatgttcaagccgaatttatcgccgaacatctccatcacttgatcaccttcgtttaagcgtaataagccgttatctacgaatacgcagtgcaagtttttgccgattgcacggtgtaaaagtagtgcggtaacagaagagtccacaccgcctgataagcctaaaatcacttcatcatcgccaacttgggctttaatgcgagctacggcatcttcaatgatgttttccgctgtccattttgtttcgcaaccacaaatgccgaccacgaaatttttcagtaattctagaccacttttagtgtgagtcacttccgggtggaattgcacgccatagaaacggcgactttcgtccgacattgctgcaatcgggcaagttggggttacacctgtgatttggaagtttgacggcaaacgtgtgactttgtcgccgtggctcatccaaacgtcaagttttgggttacaagcggtcagatcatcgtttaattttgcaaataaactgtcagttgcttttaactcaacagatgcatagccaaattcacggtgatctgaagtttccgttaaaccacctaattgcatcgccatggtttgcataccgtagcaaataccaagcactggtacgccagcgttaaacacatattcaggcgcacgtgggctgttttcttcggtggtactttcaggcccgccggaaagaataatccctgttgggttaaattcacggatctgttcttccgtcacgtcccaagcccaaagctcacagtaaaccccgatttcacgcacacgacgtgcgattagttgggtatattgtgaaccaaagtcaaggattaagattttgtggttgtgtatgtttgtcattgtgtttctctgttttgtaaaaattactagtaaggtttgatagcgatatattcatcaatatcaattccaaatttttctagaacccattcagatataacaaatagggctattatcgatagaaatggtagaataatcaaaataataggaattgataataacgtatggttaaagtctgtttttctataaatataagttagcaagcctataaaaattaatgaagatagtaagcaaagagtatatccattccatttatctatggatacttcagaaataataataccagaagtaaataaaaccccaatgattgcttcaataataaagatttttttagaaaatatatcaaatttgaatttcgtccaatatatcctaaaaactttacgaataaaaagaaagagaagataaccaataagaacagcacctaaaataccaccaattatttgtaatgtaagcataaagactccttaaatttttgattgtatttatcctagggcttacgccctaggttaagcataattgagctacttcgtagctctttgttcatttgtcacttccatctccaacggagctgacttatgcgtaaccccgtactgcttgccgtgcggggaataagcggtattatttatataaaattttgcaaaatccgaccgcactttattttaatttctttttactttccgccaacatcgctttggctgaaatctgactaacgacttttttacccgttttgctctctaactcttgtaaagcgactttggcaacattgccgccttgttcggcgactttttgattttcttcaaaggtttcagggttcaccgcttgtgaaatatctttaactgaggcttcggctaacatattgagaatgagctcggtgttcgtcatattatcgcgtaagttttctttctttaaccctttgaattgcttatattttttggtgtttttccgctccacgctttagtgataatatcggttaaaacggcaaattgttgaccttcttttacgccgacacgtttccattcgtccgtcagttccttacggatttcaatgctttttaaacgttggttaatccaattttccgaatagcctaatcgcaagtaatcctgcattgctcgattgatagtaagttctggatcttgcaattcatctaaacgttcacttcccacttgagctaaccaaagtttaaatggctcagctttcggggacggaatggattgaattaagcgcagtagttgcggtacatcggctacgtcagttagtcgtaacttgccatcttccgctctcattttcaactggttacaatttgtaaccgtttcatttccttcttttaataaacggctttttagaactttccaatagttccttgcaccttgataattgggttgttccgtcaaaatttcgattacatcaataatcgaaaaataccatttttcttgttcttcgtcccaaacggaacgcacttctttgtgttcaaaaagtttgatgtccatattttcaaccattattaaattgctaacttagttttgcttatgctgattaaaccacccaacataatcaaactgatcgtaaaaacgtttcccattcaaaccgcaatactcaaacagatcgcctattttttgctgttgttcaaagccttgaatataaactgcggaggttagttctggatatggtttatgggtaaagacaactttattcttaaacggtagttgttcaaattcaagcagatcttcatagcgacagccatctcgctctgccatcataatgaaaagattattgagatccattcgagcggtgcgttcttgccatttttttacagcttcttgctctgaatgatagtgcataaaataaatgtgaatatcgcctagtagcccaacggggtattttctttgaatttctttggggaaagtgatttcttgggtttggtagtgggcaatattttttacatatttaataaaatcagtgggggttaaaaataaatttacaaaaggggagttaaagcgtaaacctaaatcgtgcaacataaaagcccctgtgcagttactagcaattacagtcagggtgttggtgtttaatcgttggcgatttttggcgttgtgttttttgcgaaaaaaatcgttgattttatttgttatttttctgattaaaggcatttatattccttgttagcggtaagatttcccgttattttaccgcttgttttcagtattatgtatcaaagaaagaaacaaggggcatcacgcttggtgtccatcgaataaagcaggacaccaagcgtagcaaaaaattaactcattcgatagttcggcgcttctttcgtaatggttacatcgtgaacgtggctctctttgatacctgcaccactaatgcggacaaattgtgctttggtgcgaagttcatcaatggttgcacagccagttaagcccatacaagagcgtaaaccacccatttgttgatggataatttctttgagtaagcctttgtaaggaatgcgaccttcgataccctcaggaactaatttatctgcggcattatcggattggaaatagcggtcagatgaaccttttgacattgcccctaatgatcccattccacgataggctttgaatgctcgcccttggtaaagctcgatttcacctggggcttcttctgtgcctgcaaacattgaacccaccattacacaagatgcacctgcagcaattgccttagcaatatcgcctgaatagcggataccaccatctgcgatgacaggaatgccacgatcttttaaggcttccgccgcatcagcaattgctgtgatttgtggcacacctacgcctgtaacaatacgagttgtacaaattgaacctggaccgataccaattttaactgcgcttgctcccgcatcagcaagggcaatcgcaccttcagcagttgccacgttgcctgcgacaataggtaagttcgggtatttcgcacgggtttcacgcacacgttgtaacacaccctcagagtgaccgtgggaagagtcgataagcaagacatcaacaccagcctgaacaagagcatcaatacgttcttcattacctggaccagcaccgactgccgcaccgacacgcagacgacctaactcatctttacaggcgttcggtttttgctcagctttttgataatctttaacggtaatcatcccttttagtttgaagttatcatccaccattaacactttttcaactcggtgatcgtgcataagttctaaaatttcttcacgattagccccttctttgatcgtcactaaacgctctttaggtgtcatcactttagaaacgggcttatttaaatcacgcacaaaacgggtatcacgagcggtgataatacctacaaggttatcttctgcatctacgacaggatagcctgcaaaaccatttttcttcactaattcagctaactcgcctaatgttaaatcaggggaaacggtcaccggttcagaaacgataccgctttcaaactttttcactttacgcacacgatctgcttggcgttcaattgacatatttttatggataaagccaattccgccctcttgagcaagggaaatcgctaacttagcttctgtcacggtatccattgctgcagaaagcattgggatatttaagcgaatgtctttggtaagttgagtagaaaggtttgcggtatttggaagcacggtagagtgtgctgggacaagaagaacatcatcaaaagtcagtgcttctttaattactcgtagcattgcaatagttccttaatttgaaagttaaaaaataaaactggaaaaattgcgagcggattatacagagatttagttgggttgtaaatttacaagtggttagatttgttaaattttttgccaaaaagatgggctattagcccatctatctttgttagacaatctcgtaatacaactcttgatactgctgtgccacttttgcccaaccgaaatcttgagcaagggcattttggcgtacgctcgaccacaatttatttttaccccataaattgatcgcacgcagtacggcatcgtagaaattatctgcgtcaggatagttaaacacaaatcctgttgctgtgcggttttcaatgctttctttgtgtgcgtcattgacagtatcggctaaaccacctgttcggcgaactaatggtagcgtaccgtattttaagccgtaaagttgggttaaaccacaaggttcaaagcgacttgggactaagataacatcaccacctgcgataatttggtgtgaaagagcttcatcataaccaatttttaagccgattttatgtgggtaacgagattgtgcatcacgcaatgcccattctaagtcaggcgatccactaccaagcactacaagttgaacgttgtgttgcatcatttggtcaatgcgtgcaagtaagaaatctgcccctttttgttcggttaagcgagtaaccatcacaaataagagtgcatctttatcttctggcaagccaaagtaacgttgtagttccgatttgtttttacctttaccttgcatatagttcgggcggtaatttgccacgatgtttgtgtcggtttcagggttccaaacagcatcatctacgccatttaaaatgccacgcaatgccccttctgcaaggcgttgttgcagtaagccgtgcattcctgcccctgcaatttgctcagtaatttcacgagcataggttgggcttacggttgttacacgatctgcgtagaataaacctgctttcagataagagatttcgccgtaaaattctaaaccgtgaacattataaaattcccaaggcaaggctaattctgctaagtggtaggcttggaaacgtccagggtaggcgatattgtgaatggtgaagacacttttcacagggctgttccagcttttgagataagcacaagctaaacctgcttgccagtcgtgagcgtgtaacacatcacttctgccccaccaatgatctaaacctgaagcaagttgtgctccgagataacctaatagtgcaaaacgtttgtagttatcggtgtaatcttggtagttgtcgtcgtagtaaggtaaacgacgatcaaagagatgtggggcatcaatcacatatacgcctaagccattcaaataagcaaaacgaacagtgacaacacctgcaaaggtaccgacggtcgcaacttcaacggtttcgcctaacttggaagccacttgtggataataaggaattaatactcgaacatcatttccagctgattgttgtgcatagggtaacgctcccattacatcagcaagtccgcctgttttgataagcgggtacatttctgaacaaatatgtaaaattttcatttaattaactatattgatgttgtgaataaatgtagggtgggttttaacccaccgctcatagataaactttaaaaggtgggtcaagacccaccctacatattaagcaaccgctttatcttttgccaatttgtctaacattttttggcaaactaagacaataccacctttactgatacggaaatatttcgcatcttcttctggatttacaccgatttgtaacccatctggaatgtcacagtgacggtcgattactgcacgtttaattatacagtttttaccaatattcacctgtggcagaataacagattgctcaattacgctgtcttcttcaacgtgtacacggctaaagagaacagaattactgatctctgcatcggtaatcacacagccccctgcaatcaatgagttatcaagggtatgcgcacgcgcttttttatagaagaaacgagctggtgcagtttgttgtggacgaccgtggatcggccaagattcatcgtataagtctaattgtggattttcactcacaagatccatatgagcagcccaatagctgtcaatcgttcctacatcacgccagtagattgtacctgttgtgttacgaccttcgcaagaacgctcaaatgggtgagcataaatcacaccttgttcaacggcttttggaataatgtctttaccaaagtcgtgtgaagtatctgggttgctgacttctttttctaacatttcatagagataatctgcgtcaaacacatagatccccatagacgcaagagatgagtctggtttgtctggcattgctggtggatctgacggtttttccacgaaggctttaacttttaatttttcattaactgccatcacaccaaattccgttgcttgttcacgtggcacttcgatacaacctacggtacattttgcccctgaatcaacgtgatcttcaagcatacggttgtagttcattttatagatatggtcacccgcaagaataatcacatattttggacgatagtgcgatttcatcatttccatattttgataaaccgcatcagctgtaccacgataccaagtgttctcatcaatttgttgacgagctggaagcatatcaatgtattgattacgctcataaggtaagaatgaccaaccacgttgtaagtggcggagtagtgaatgcgccgcatactgtgtaatcaccccaactttcaataagttagagttaatacagttggaaagggcgaagtcaataatacgacggctaccaccaaaataaaccgcaggttttgcacgtttgtcggttaattcataaaggcgtgaaccacgaccgcctgccaagataagaactaaagtttgtgcagtaagattacgtctgtcagttgatgcttcctgttttagcatattgttatctccaaattgggatggtgaatattaattcctttgaagtacacatacctcaatgtgattgagagtaaccgcaagcgtatcggtcattagagtggtttctttttcacctaaaagtatttgccaatcacccttaggtaataaaaattgttgcattgcttgtttggcattgaccaaaataagccatttatcttctaatagtatttgtaaggctttggttgaatagtcttgccaatctttaaattgaataacattcgcatcagggcgtagccactgaactttttcaccagaccaccattgattatcacgagataacaaagggatctgcttacgaatagcaatcagctttgacgtataatcaatcaatgcttcgtcagcggtttgccagtcaatccagctaatctcgttatcttggcaatagctgttattgttaccttgttggctatgccctaattcatcaccagccaacaacatcggtgttccgctcgagagcaacatcgtcgccagcagagcttttttcgctaactgccgttgctcaataatcgttttatcgttggtatcgccttctaccccgaaattatggctgatgttatttccgtgtccatcccgattttgttcaccatttgcccaattatgtttttcgttatagctgactaaatcgtgcaaggtaaaaccatcgtgagccgtaataaagttcacactgtttgaaggtaaacgatggcgagcaaaaatatcatcactgcctgcaaatcggagaacaaacagccctaaatcaccgcttgtttgcaaaaagaaacgacgcatatcatcacggaaacggtcgttccactcggcgaatggtttagggaatgcccctaattgataaccactccagccaatatcccacggctctgcaatcaacttaacgtgagataattttgaattactatatatcgctgtaaaaaaggcggatttttccgaaaacgtcggagaacgtcctaagacagcccctaaatcaaaacggaaaccatcaacgtgacactctttaacccaatagcagaggcaatcaatcacccaacgcaacaccgccacatcagacgacacattgagcgtattgccacagccagtccagtttagatagtcactattatcagtaagccaataatatgcttcattatcaatgccacgctgagatagcgttggaccatctttaccagcttccgccgtatgattaaagaccacgtccataatcacttcgatccctgctttatgaagcgttttgaccaactgcttaaattccgttagcggatcggctttgttataagctaatttaggatcaaccgcaaaatgccctaaaacgttataaccccaatagttgcataacccgattttttgcaaatgcggttcatcaatatgataggtaatcggcaacaattccactgccgttacccctaaacgtttcaaatgagcaattgacgtttcgtgggctaaccctgcaaaagtgcctgcaatttcgcttggcactttaggattaagtttactaaaccctttaacgtgcgtttcataaataatcgtttcagcccaaggggtaaaaggtttatagtcaccttcccaatcaaaagtatctcgtgcaaccacgacagattttggggctaggtgagcattatctctcggatcattccactgaaaccatttcaccgcttcatcactggataaatcaggttgtcctacaatgccatttgcataaggatctaccagtaatttattggggttaaacaggtcgcctttttcttcatttacacaccctgttacccgatagccatattgcgtccctgcttttagaccgaccacaaacaaatgccaaatttcatcggttttgatcatcggtaaacgaatttctttaccgtcgcaaaaaattgctaattccacaccgcttgcacggcgagaaaacaatgcaaaatttatgcctttttctccatttatttcagttaatcggctacccaatggaaatagtctgcctgcaagatacttcatatacagccttagtacttattgtagcaactgtgtttacacacaaaaaagttattcaattttgacccacagattctgtggataagtagcgtgtagcgtcccatttttcattgcgtctaaccaacgcattcataatggttagcagtttacgcatacacgccataatagcgactttcttcgctttgccttttgcaaccaatcgggtgtaaaaggctttaaaaacaggttcaaagcgaattgccgatagtgctgccatatataaggcattacgaacaatcgctcgaccaccatagcaaaaggattttcctttccattgaccgctttcctgtggatgcggaataacgccaacgagtgaggcaattcttttgctgcttagcttgcctaattccggcaggcttgacatcatcacggcgacgcaatttttgccaacgcctttgatgtctgagataaggtcagctttatcactaaaatgcttactttggtcgtcgatatctttatcaagttcggcgattaatttatcaagcatttcaatgtgttgttggatattgtccaactgggtttcgtggctttgttgcaaacgatttagctctgctactcgcatatccacaagctgacgacggcgaaccacaagggcttccagctgttcttcttgctcagaaagcggaacatacaactgatgctctacttcgcctttaagctcacaagtgagcccatagaaagcgagattaaccgcatcttttgcatcggttttggctctcgtttgagattttgcaaactcactggctttcagtggattagcaataaatacacgataacctgctcgagcaagggcttttgccacgggaatttctaatccacccgttgcttcaagcgttatcagagccacattaaactggcttaaatagtccaaggtatgttgaatacctttggcgttattggtttcggttttggtctttttctgatgggaaaaaccaatcacgaaattgcgtttagcaacatcaataccacaataaatcggagcgttcatcggtaacctgccttgtcttcgggtttatatttcaactgttcggttttgctgatgaagttatccacgcctacgctacagaacgagttttagctctagggacacccaagctgtggataacgttatggtttatgttgctagtttactataattttaatatacaagggacacactgcgtgtgtccgacatcttaaacaattatattatttgaaatcttcgctccccctgtttacggggggagctgggcgaagccctgaggggggaacaataatatccccccttccgccttcggcaccttcccccgtaaacgggggaagggaatttaatcaaatttttgtaactactacataatgtagaacatttgaattattagatttgtaattaatggacacacgcagtgtgtccctacattattttgcttttttggcttttactgctttggttttttccactttcggctcttccgctttttttaccacttttgcagattttttcgcttttttcaccgcttgtggtttggcttctttgacgataaaaatcgtcgcaagcggtgggatagtgagcgaaatggaataaggtttaccgtgcgactcaatctcttcacattgaatagtaccgaaattccctaagttactgcccatatagtaagctgagtcagagttgagaatttctttatattccgcatcttcgtgaacgccaaaacggtaattatcacgagggatcggggtaaagttactgaccacaataatgcttgctccctcttttgctttacgttcaaaggcaaacacagactgctctgcatcatcaaccaccaaccactcaaagccagcaggatcgtaatccaactgatacagtgctggatattgacgataaatacggttcaaatcacgcacccagttcaacatacctttatgccaaccgccgtgttcatcgttaagcaagaaccaatccaaactctcttgataattccactcacgcccttgagcaaactcgttgcccataaagagcagttttttacctggataaccccacatataaccgtaatatgctcttaggtttgcaaactgttgccagcaatccccaggcattttaccgagtaacgaacatttaccgtgaacaacttcatcgtgggaaagcggtaacataaacttttcgctatactgataaatcataccgaatgtcatcaaatcgtgatgatatttacgataaatcggctcggtcttcatatagcgtaatgtatcgttcatccaccccatattccatttataatcaaagcctaagccgtgatgttccgttgggtgagtaatacccgcaaaagaagtggactcttccgcaatagtcacaccgcctttgccttctttcgctaacatatcattcgttgaacgtaagaaatctaacgcttccaaattctcacgaccgccatagcgatttgggatccactcgccatctttgcgagagtaatcacgataaatcattgaggcaaccgcatcgacacgcaatgcatcaataccgaaacgctcaatccaataaagcgcattacccgtcaaatagttacgcacttcgtgacgaccataattgaaaatcagggtattccaatcttggtgataaccttcttttggatcggaatgttcatagagatgagtaccatcaaaatacgccagactatgttcatcggttgggaaatgtcctaccacccagtctaaaatcacattaatccctgcttcgtgagccttactgattaaggtgcgtaaaccttcaggtgaaccaaaacgactggttggggcataaattcctgttggttgataaccccaggagccatcaaatggaaactctgtgactggcaataactcaatatgggtaaagcccatttccttcacataaggaattagctcattcgcaatctcttcataatttagccaatagttattttctaaattacgtcgccaagagcctaaatgcacttcatagacagaaatcggctgatcaggatcgttcgcacgacgacgtttctcgtcactctcaacaatcgcaggtaaaccagaagcaacagaagccgtatcaggacggaattgagctgagaacgcataagggtctgatttcaaacggatttgtccatttctatctaaaatttcaaatttatagagcgttccttttggcaagtttggcacaaaaatatcccaaataccgctgtttgaatgaaaacgcattgaatggcgacgaccgtcccaatagttaaaatcacccaccacagatacacggcgagcattcggcgcccaaaggctaaagtgaataccgccaacttcattttgggtaacaagatgagcacctaatttttcataagggcgaacgtgggttccttcagaaagcaaccaattatctaaatcggaaaaatgggactggaaacggtaaggatcttcaatatcaatttcagtgtgggcataacgcactaacaagcggtaggaaaggtcagttttttcaccaaccaaattcgcagcaaagaagccacgatcatcaatttgctccatctgcacaatcggctcactgttatcattaataactgttacctgttctgcttcaggtagataagcccgaacaatcacgccatcatcaacttgatgaacccctaaataagcaaaaggatcttggcaacacccgttcgcaagctgttctatgaattgattatcttgcttgagtgaggtggtatttttaactttttctttcatttgctctccttggctaatttatatacgctgggaatgatgaaataaacgtttgcgtagcattctattaaaaatagctttacaaaacaatcacaatttttgatatagatcataatctcatagagaaaagctccaatagttaaaaatcaataagttaaataaaaaatgatagatataaaaaatttttcaaatgtataaaaaattttcatttgaaatatggaacttaactttgtaaataaaagtaaataaagatgaattactttatactaactcagcagtgcggcactgcctaaaagatagggaacaacttccatcgcatcagataaatgcacaaataagtggctggtttccacctttgcataagcacaaacgccctgcgttaagctgagcgtaaatacaacaaaaaagcggttaaagttgttcaaacaatgatttacccaagtaatcattttcatctttaactcctgcaaagcacgcaaataatccgctaccgatatgggtaatgtattcgttcatcttgtcgatattgccaaggctgttttgaatggtaataaattgttgcggatctttttggaacgagataaacaacaagcctgcatcaaactgccctgttttcggatcaacaccgctggcataagagaaggaacgtcttaacatctgtaaccctgtctttttcgccaataacacattcacatcttggaagcgatcagcaatctcttttgccaatttcgcatctttttgctctaattttggcttaaagatcgcataaatttttttccgccccttcaatgttggctttgaaatcataaaggtcagtttttgaaaaaatctcttcttcgcccgttacttttgtggtggatacttcatttaacaaatccaccgcactggtaatcattaaatcaggggtgacttccgccgttggaattttcgcacgcagttctttcacatctttgatcaactgatcagcggtcgcttctgtgccttttgtggtattttgctcccaaagcactttctcaattttatggaaacccgaccaatctttctcggtttgcccttcttcacttaaatccgcaagacgagcatcaatacgagggtctaaatcgccaaaactctctgcaatcggctctgaacgctcaaagtacatacgtgcaagcggatagatttgcttcgctttttccacatcgcctgccttcaaataccccacaaatttctcggtatctgtcactaattgatcgatttgcccaactacaaattccttataagtttgtgtttctttagataaatccgttgcaaaaacggaagtggcaacaaataaacttgaaatcgcaagggtgagagattttaaacgcatagaaagctccttgattttatcttatgaagaaaaataaataaaacttattatcaataagaataaagttttcatttacgtttacaattgaatttactacaaaattaataaaattttaatttagcttaatttttaagctacaaaacagtcaaaataaaaacagattctttaaaaagaaaaaagccgatcaactatttagatgatcggcatacaataattacatttaatttgacgttaccgtttcttcgcaaactctttttcaagttcaggtaacacttcttcacgataccaacgagggtggtgtttcttcgcccagcggactgtaacccaaccttcaaccattcctcgaattgaacctttcacccagaatgccatatacatatgcaccatgatgccagtgaacaacataaaggcacaagctgagtggaataagatcgcaatacgaattactggaattgagaaattatgtgcgaaatattgacgccacataataattcctgtaatcagcaaggtgaacattgcaaggatcaaagtccagaacaacattttttgaccaaggttatatttgccgttgtcggaaactgcgtgttcgttaccttttaatacttccacaatgttgatcaaccatacccagtcatttttctctggaatattatgatgccagtaaatacgaaccatatttacgaaagcaaggaacataataatccctgtgaatgggtggatcattcgggctaattgtggtgtacctaaaatatccactaaccacgcaaaatcagggaagaagaatgctaaccctgataagccagttgtgaagaagcagatcaccagtaaccagtggctccaacgagcaggcaatttatggcgaacgattcggtaatcgttagggatttgaatcttactcatctttgcctcctttatgttcttcaccctgttcaccgtggtgttcttcgtgttcgtcaagatcctctgtatttggaccgattgcgatatagtgtgcaatttcagaaagaaccaagccgcccattgccactgcagcaactggtttgagtacgtctttccaaagggtgacacttaaatcaatctgcggatctttcggtaaacctgagtatagctctggcttgtctgcgtgatgtaacacatacataacgtgtgtgccgcccacgccttctgggtcgtataagcctgcattttcgtagccacgagatttgagatcggcaatgcgtttagacgcatattctttcatctcttctttgctaccaaagcggattgcacccgtagggcaggttttcacacaagctggctcttgtcccacagtgacacgatccacacagagtgtacatttgtacacacggtgatcttcagggttcattcgtggaatattaaacggacagcctgcgatacagtaaccacagccgatacatttgtctgattggaaatctacaataccgtttgcgtattgaatgattgcacctggtgatgggcaagccttcaaacagcctggctcagaacagtgcatacagccatctttacggatcagccattccaagcggtcgttttcttccacttcgttaaatcgcattaccgtccacgctttcggattgagatccgcagggttgtcatagaccccagtacaagctgcatctggggttgaacgaatgtcgttccactctgaacagcccacttgacaggctttacagccgatacaagtggtgacatcaatcaatttcgctacttccacttgatgactacgagcctgtggcggtggagttaagaatgaaattgcagaggatttaataatatcttgagattgaactgtactcatattatgcccccacaatcttctcaatattgactaacatacatttcgattcaggcgtttgtgtatttgcatcacctgcacgaaccgttaagttattggcaaagaaaccttttttcgctccagtggttgccgcaaagccccagtggattggcacaccgatagtgtgaattggttttccatctgacactaatgcacggatacgttttgtcaccactgcgaccgctttaatatagccacgtttagagctgactttcaccatatcaccgttattaatgcctttttctttcgcgagtgcctcgccgatttccacgaattgctccggttgagcaatcacgtttaagagagcatttttcgtccagtagtggaaatgttccgttaagcgatatgttgtcgcaacataagggaactcagcagaagtaccaagctgttctttatccgttggaaaaatacgagcaactgggcttgaaaccacattcgggtgtaatgggtttgtgccgattggcgtttccattggctcatagtgttctgggaacggaccatcaaccatacgctcacgcacgaataagcaacttaccccttcaggttgcataatgtatggcaatgtcgggctatctggcggtgcagcaccaaagtcggcaacgtccacatagttccagtttttaccattccatttaacaagctgacgtttcgggttccacggtttgcctgataaatccgcagatgcacggttataaatgatacggcggttcattggccacgcaaagccccaacctaaggtattacctaagttagatgggtctgagttatcgcggtttgccatttggttgcctttttctgtccattgacccgtgtagatccagcacgcacctgaagtcgtaccgtcatcacgcatttgtgcaaagcttgaaagtagctgaccttttttcaaaataacattgccatttgcatctaaaagatcttctaaggcatagccgttattctcttttgccacttcttctgcttttggttcaagtggatttgcatagttccagctcattgcctccaacggttcaagcggtgcttttccgccttctttatgataaaggtgaattaattccgcacgcaattcagagaggatttcgccgtctgttttcgcctcacctggtggttctgcccctttccagtgccattgtaaccaacgtccagagttagcaattgagccatcttcttcaacgaaacaagtggttggcaagcggaatacttctgtttgaatttcttcggttttcacgtcgttaaattcgccgtaatttttccagaattcagaagtatcggtaataagcgggtcgaaaataaccaaatatttcaatttgcttaatgctttaacaattttttgcgaatttggataagaggcaatcgggttcataccttgacagaaataacctgttaccttgccttgatacatttcttcaatgtaacgcatatgatccattccgtcttttggtaatttaggcaagtaatggtagccaaattcattatctttcgtcgctttatcaccatagaaggatttcagcatactcaccataaatttcggtgtatttgcccaatagttcacctgatctttcatcatctgtttcggcgtaatacgtcctaagaatttctctaaagaagtatccgcttccgttggtaatggaagataagctggtaaacgatttgggaataaacctaagtcggtgataccttgtacgtttgagtgcccacgcaatgcgttcacaccgccacctgcaaccccaatgttacctaataacaactggataattgccattgtacggatattttgtgaacccacagtatgctgtgtccaacctaacgcataaaggaacgttgccgctttttctggtgcagcagttttcgcaatttcttcacagaaaatgtggaaatctttttgtggtgtacccgtaatacgttcaaccatttcaggcgtataacgtgaaacgtgtccttttagcatattgatcacacaacgtggatcttgcattgtcatatcacgttttggttgcccttcttcatcaaattgataaccccaagttgaacggtcgtatttacgcgtttcagggtcataacctgagaataaaccgtcttcaaacttaaagttttcattcactaagaatgtcgcattggtatagtgtttaacgtattcgtgttggatcttatcgttttctaagagataacgaataacacccgataagaatgcaatgtcagtacctggacgaagtggcatataaatatccgccacagcagcagtacggttaaagcgtggatcaaccaccattaacttcgcaccgttctgttttttcgcctcaatcgcccaacggaagccaacagggtgggcttctgcggcgttaccacccattacaataacgagatcagcgtttttaatgtcaacccagtggttagtcatcgcaccgcgaccaaatgatggagcaagacttgctaccgttggtccgtgtcagatactcgcttggttgtcagtaaaaacgataccgagagaacgtacaaatttttgagtaagaatacccgtttcattactacacgcagagcctgctaagaaacctgctgtcatccaacggtttaccgtttcacccgcttcatttttctcaataaagttagcatcacggtcatctttcatatggcgagcaatacgctcaattgcttcgtgccaagaaatacgtttccactcttttgagcctgcttcacgcacttctggataacgtacacggcgatcactatttacataatctaacgcaccagcacctttcggacataacgccccacggctcactgggtggtctgggtccccttcaatatgaataagtttcccacgactattcattgctccatcgccaagactgtatagcaacataccacagcctacagcacaataagtacaggtgttacgagtttcttttgctcgtaatagtttgtattcacgaggtgcggctaatgctgttgctggggcaaatcccaacatagcagcagacgtacctgccataccacctgcacagatcttgaagaattttcttctactgacctgcataaatcactccaaaccgcatttgcggtgtttattaataaataataaaattttgtctatctaacaaaataattaatgatattatcctactaaaccaacttaaaaagcagcactattacggattaattaccatctatttgatataagctaaaattctgtaaatcatacaattttttaacaaaataaactacttaataaacaaattttttcgaggaataatgtgaagaagatcactaaatttgatgtagatcgactttttgttgagaatggttctctacaacagcaatttcaacaagataatatcatcagagaagtgcctgtggctctcgtttataatggaatttcacatacagttatgatgtgtacccccgacaatttagccgattttgccttaggtttttcccttgccgaagggattttaaaacagaaaagcgacctctacggcttagacattgttgaaagttgtaacggcatcgaaatccaaatggaaatttccactcgtcaattcactcaattgaaaaagaaacgtcgttcaatggcaggcagaacaggctgtggcatctgtggggttgaacaacttgaacaagtcaaacagagttaccaaacttttccacaatcgcaccgcttgtcaaatatatcccctttaatcttagatgattgtttagctcaattagaacaggctcaaactcttgctaaagaaactggggcaagccacgctgctgctttttttagccctgacggcacactcttagctatccgagaagatgtagggcgacacgttgccttagataaactgttaggctggtatgcaaaagaaaatgccccacttggctttgtgtttgtcacaagccgagccagttttgaaatggtacaaaaatgtttagcttgtggcattgaaatgctttgtgcgatttcggctaccactgaaatggcagtcaatatcgcaagggaaaacgactttacactactcgcttttactcgaaaaggaaaggcaacagtctattcggggggtaatcgtttgtattttattaaataacccataataacatccgcatacaaaacatgcggatgttattttatctcaaagagaaattaagcattaccgccagtgattttcgctacttctgctgcgaaatcttcttcaactttctcaataccttcacctacttctaaacgaacgaagttagctacagaggtattaactgattttaagtaagcacctacagtttgtgatggatccataacgaatggctgaccagttaatgaaacttcgccagtgaatttcgccatacgaccttcaaccattttctctgcgatttcttttggtttaccagagttcattgcgatttcgatttggatttcacgctctttagcaacgacttccgcagaaacatcttctgggtttacgaaatcaggtttagacgcagcaacgtgcattgcaactttcttaagttcttcttcagcaccttgaccagcaactaatacaccgattttcgcaccgtgtaagtattgtgcaatcacttgaccttctaagtattgaacacgacggatgttcatgttctcaccaattttagccactaatgcagcacgtttttcttcgaattgtgcttgtaatgcttcgattgatgtacctttgtttgcaagtgcataatctgccacttcgtttgctaaaccaacgaaacctgcatcttttgctacgaagtcagtttcgcagttcatttcaactaacacaccgaaacctgcaccgatacgagcaaggataacaccttcagctgctacacgacctgcttttttcgctgctttcgcttgacctgatttacgcatattgtcgatagctaattcgatatcaccgtttgcttctactaacgcttttttacattccatcataccagcgccagtacgctcacgaagttcttttactaatgctgctgtaatttcagccattttttattcctctcttaatagataaaaaagcaggggtataattgcccctgcttcacaatgttgaatgtgttttaagggcttgccttaaagacgattactcagccgcttcttctgcaacaaattcagcagcaacggtttcttgaccacgaccttctttgattgctgctactgctgcatctaagtaaagttggatcgcacgcgctgcatcatcgttacctgggataacgtagtttacgccagctgggcttgcgttagtatcaacgatagcaaatacaggaatacctaagttatttgcttctttgattgcgatatgctcgtagtctgcaccgataacgaaaattgcatcaggaagaccagacatatctttgataccgcctaagcttaattcaagtttagccatatcacgagtacggtctaatgcttctttcttcgttaatttgtcaaaagtgccgtcttgtgattgcgcttctaaatcttttaagcgtttgattgattgacgaactgttttccagttagtcaacataccacctaaccaacggtggtttacatagaattgttggctttctactgctgctgctttaactgcgtcagatgctgcacgttttgtaccaacgaaaagaattttaccgttgttgcttgcaatgcgagttaattctgctaatgcatcgttgaataatggtaatgttttctctaagttgatgatatgaacaccgttacgagcaccgaagatgaaaggtttcatttgtgggttccagtaacgagtttggtgaccgaagtgaacgcctgcgttaagcatatcgcgcatagatacttgtgccataagaatagtttccttgttgttgtttctgccgcggcagaaagggttttgcctccacatatcctaagtcatcgaccgtttttcaacagcaccccgacgcttagtctgcgatatgtgtgtgatttagtgaataaaaaataaaatgttttttgcctacattaatctgcaaggacaaaaaacgggcggattttacttgaatctgaagcaaaaaaccagtacttttcaataaaacgtgtacaagattttgaaaatttatatattaagaaattattccaatagaataacaactagtttcgtaacattatgctattgttcctcacgtttaaacaccaattcggtgtctgttgaagccgtttcatcaaaccaatagccaccataattaaaggctttaagctgttcaacgctggttggttgggtctgcaacataaaccgcaccatcattccacgggcttttttcgcataaaagctaatcactttgtatttgccattcttttcgtctaagaaaacgggtttgacaatttttgcggttaatctctccgcttgcaccaccccgaagtattcatcagaagcaagattgactaagatgttatcttcttgtgcatcaatagcttgctggagatgttgagtaatgatgttatcccaaaagtgatataaatctttgccttttgggttagccaatttcgttcccatttctaaacggtacggctgcattaaatctaaaggttttaataaaccatatagccccgataacatacgcaaatggcgttgagcatagtcgatttcagcattggttagtgtttctgcttctaagcccgtataaacatcacctttaaaagcaaataatgccgctttggcgttttgctcattgtgttccattgtccattcggcaaagcgagcaacatttaggcttgccagtttgtcgctaattgacatcaatgatgccacttccgcaggggaaaattgtttgcaaatatcaattaattgctggctgtaagcggttagttcaggctgagaaaatacaaatccgtcaattttagtttcaaaatcaagggttttggctggggaaataatggcaagcattttgacctcaaattagtttgatagatagaattaaatggctagcttcttagctctaatactgtttctgggtggcgagcagcaatttttaataatgtggcagctgcacctgttggcttacgtctgccctgttcccatccttgtaaagtgcgtaccgaaatgcccatcactttcgcaaaagcagattgtgataagcctgttttctggcgtgcttctattacttcatttgttatctgtctctctgcacatttccccattttaatttgtcttacggaggcaagaagtaactcgcccaactcatcctcagtaaattcatattccactgcgttaatatggttcaaatctatagccatacttctaactcctgtttcaattgtttcaatatatgtgctgggatattttcagatttagctttcgtataaatcaataataaacaaattttgccattttctaggcgattaaagtaaattactcgacaaccaccctgttttcccatacattgacgatgccaacgtaattttcgacaaccacctgaagcaggaataacatcaccacattctggctcagaagcaataaatgtcgcaagttcctcttgctctttttgcgttaaaatatcagcaactaacttagtataaatctcagactcaacgatagtgtacacctcgattccctcattttcatacgtcattgtagtataataaaaaataatgtcaaaatacctttatttaaacagtatttaaaatagttatttccaaaaagcacaagggatactaactaaagtagtatccctatttgcttttataatgggtaaataaacctatttctgacgcattgctgggaataggatcacatcacggattgacggtgcgttagcaaaaatcatcgctaagcggtcgatacctaagccttcgcctgctgttggtggtaaaccgtgttcaagggcgacaacgaaatcgtcatcgtagaacatcgcttcatcatcacccgcttcttttgctgcaacttgtgcttggaaacgttccgcttgatcttcagcatcatttaattctgagaagccgttaccgatttcacgtccgccgataaataattcaaaacggtctgtcacttctggattttcatcattacggcgtgcaagcggtgaaatttccgctgggtgagccattaagaaggtcggctgaattaattgatgctctgccacttcttcaaaaatcgcattgacgatagaacctaaaccccacgatttttggatttcgatatttaagccttttgcaattgccactgctttgtcgaaatcgtgtaggtcgtccattgaaataccgttgccatatttcacaatcgcttcgtgcattgtgatacgttcaaacggtttaccgaaatcaaacacatattcgccgtaaggcacggtcgttgtacctaaaatatctaaggctaatttgcgtaataattcttcggtgttatccattaaatcgtggtaatctgcataggcttggtagtattcaatcatcgtaaattcaggattgtgacgaacagacaccccttcgttacggaagttacggtttaactcgaatacacgctcaaaaccgccaaccacaaggcgttttaagtaaagctctggagcgatacgcagatacatatccacatctaatgcgttatggtgagtaataaagggttttgccgctgcaccacctgggatcacctgcaacatcggcgtttccacttcgataaaatctttctctaagaagaattgacggatacctgataccacttttgagcggataacaaaagcacggcgagattcttcattcgcaataagatctaaataacgctgacgatagcgagtttcttggtcagttaagcctttatgtttgtttggtaacggacgaagcgctttggtgagcagttgtaattcggctgcacgaacagttaattcacctgttttggttttaaatagcgtgccttttacaccgataatatcgcctaaatctaataagcccaccgtgttttcatattcaccttcgtgcaaattatcgcgagccacataaagctggatctgaccgcttacatcttgaatagtaacaaatgtcgctttacccatcacacgacgcaacataatacgccctgcaactaccgcaggaatttctttggctttgagttcttcgccgtcgacttcatcatattttgcgtgaagctcttcagctttatcttcacgacggaatgtgtttgggaacggattaccacgctcacgcaattgagctaatttttcacggcgagcgatcatttcgccattcagatctaattcttggttttcgacttctgacattgtattaccttaacattttaaaaataaattcggtttaattcatttaagtttgaaagggcgagattataagcgattttggaagattttggtagaaaacaagcggtaagatccgctaagtttttacaaaaaaatcaaggttggaaaaccaaccttgacttagaacattttagattaattgtgctttttgtaatgctgcagtaattaccggatgatactgttcagataatactgtaagcggtaaacgtaagcacggatcactaattaatcccattttatgagctgcccatttcactggaatcgggttgccctcaacaaacagatttgtatgtaaatccattaagcgttggttgatctcttctgcttcatcaaatttaccttcaagagcaagttcgcacatttttgccatatctgccgcagctaggttattagttacagaaatcacaccttgcccacctaatttcattgattctaaaccagtcgcatcatcgccacttaagaagataaaatcttcgccagcaagtgctttgatttgtgcaacacggcttagatcaccagttgcttcttttactgcaacgatatttggaattttagctaaacgtgcgattgtttcaggttttaaatctgttcccgtacgacctggcacgttatataaaatttgaggtaacgatgtacattctgcaatcgctttataatgttgatataaaccttcttgggttggtttattgtagtaaggtacaacactcaaacagccagcaacatcactgtctgcaagcaattttgtcattgtaattgcttcacttgttgcgtttgaacctgtacctgcaataacaggaatgcgtcctgctgcaaattcaacggttttcttaatcactttcacattttcgtcaatacttaatgtgctacattcacccgttgtaccaacagaaacgatagcgtgtgtccccgctttaatatgaaactcaactaactcttttaatccatcaaagtcaatttctccgtgtttcattggggtaatcaaagccacaatactgcctgaaaaaagaggttttgacataattttctcctgtatatcttttttgttaaataatacgatagcttgcaaaattcggcttcaatatgcaaatgttttccaccaaaattgcaaattttttctaaaatcctaccgctattcaatgcccttttgataagacatcattacaagtgttcgccatttttcattaccatcgctgtctttccccatattcgcaatatttggaaaacgcccccaacactcaaagccgtgttttttcattaaattcatacttacttgatttaattcaaaaacatacgccatcaaagtatgaatcccatgctctagcatcttatcttgcatatactggataattttcgagccatagcctttaccttttgctttttcatcaaggtaaaggctgatttctgaagtatgcacaaatgctgggcgttcataatatggggaaaagctaaaccagccgattaccccattttcatcttccactgtccataagggatatttctcactagatagatgaaattcaaaccacgctttgcgtgtttctcttgttgcaaaataaagatctgcagtcatttggtgggtcggaatcgcttgattataaatggctaaaatagcatcaaaatccgtttcaactgatttgcgaatatgcattcatagatccttttaatttagctgtaataattcatttagcgtttgagcaatactgtcttcgttatttgagccgatcacttttttcgcactttgctggacttccagctctgattcgcccattgcaatccccataccaaccagttttaacatactaatgtcgttaaaattatcaccaaaggcaatcacattctctggatcaatttgttctcgttttaataactctgccaaacaagcccctttactatttcctgctttagtaatatcgacacgatctacccaagaccattcagcactcacctcaagcggtaatgtttcgacaaatttttgcattttctctaggttaggatcgctaattaacactttccaaatggttgtgccattatcaataaaggtttggaaattttcggcttgatacacattagggcgaacattttcaggacaacttacaacccattttaagaatttggtgaaatgtgcatttaacacttcgtaggtcatcgcatcacgagtataaacagcaacatgaatcccttctgcttttgctgaatgaattaacttttctgccaatgcattacctaacgggttagccgataacactttatcattctgaaaatcatacaaataagtcccgttacaacagacaacaggggtatctaacccaagttctgcataataaggaagtaccgccgtatgatgacgacccgttacaatataaacctttagtcctttctcttgtgcttgcttaattgcttttttacttgattctaaaatggtgccttgacttgacagcagtgtgccgtcaaggtcgaatgcaatcgcttgataagacattacttcgctccttataaaacaaaaaaagggtcactcccttacgaattgacccttttattttactacgtcataaacatcaaagcagcaaattatttagctggattatatgaaggagtttgataaagcggagctgggccttgaggacctgcaacattaccactttcgttctgttttaatacaccaccattagctgtaatttccacacgacggtttggacgtaaacagtcacgtaatgcttgacctgattcaccatcacaagctttaacttggtttgctttaccataaccaacagcctcaatcggcactttaataccttgctctactaaacgagctttaaccatattagcacgacgttgtgacaaatctaagttatattcctcagaacctaggcgatcagcgtaacccacaagtttaaccttctctgcacctgaagattttaattgttctgcaacattatcaacaacctctctgccctttgtagttaatatatctttatcaaaatcaaagaggaaatcaccaactaaattaaatgaagaattaccattacaaccatttggataccaaaagaaactttgcgcattcatatttttatcaaacaaaattttgaattgacaaattttgtgtacgcccttttccctatagttaaaagcatagtcccactcacgtacttcataaagtccttcagaaaaatgagggcgaccaatcaaattataaagctgatctttgttcatccctttttcaatttgacgaacattttcccaattcggccatgatccaaattgagagccatcatgattaaattttgattccggaatttttggaaataccggtttttctgttgtaccctcatcggacaccttactcaaactaccacaagcagtaattgtaatcgctatagccgataatactccacgaaaaaaaattgtttttttcattctttatcccttaaatgtcaaattaactatctcttagtatagaatattatcagaaatatctatacttctttctataataaaaacctagcatgattctactacacaaaatcgtcttattctatctttttttatttgaattgatcatcttctaataaatattcaataagtagttggaggttttttcctcccctaaattcattaatatccaatttataaacaaatgttgcctgtttaatagataaatcaggatagcattttacatcaacattaaaccagattgcatcgaatagcgtaccatattcattttccaccatcattttcagatgttttccagccaaaagtttctgttgcaagatacgaaacctcccctcaaaagtcggttctggaaaatgttgcccccaaggccccgcttgtttgagtagttctgccgttgctagattaaattcatcggctaacaactcgccgtctgtataaatcacaccttgtaaccattcaggttctgcaacttcgttcacggtttcgtcaaatacagtttgaaattgagctaaatgatcttgatgaatggtcaaaccggccgccattgcgtgtccgccaaacttgacaatcaaattatcatatttagcatcgatacgttctaataaatctcgcatatgcagcccagcaatagaacgagcagatccttttaaatattcactatcatcactttcctgagcaaatgcaataacaggacggtgaaactgatctttaatgcgagaagccaagatgccaatcaccccttgatgccaatcaggttgatataacacgataccttgtgcttgattttgctgagagagcgttggcaacttagcacaaagggctaaggcttccgctttcatctcttgctcaaattctttacgagtctgatttaatgaatccagctctagggcaaattgacgagccaacgcgagattatcggaaatcaacagctctacccccaaagacatattctctaatcgcccagccgcattcaatcttggggcaatggcaaaccctagatcgctggcttgcaaagcatagagatctcgtttagccacctctgccaatgcttggatccccactcggcaatgccctgaacgaatacgatttaaaccctgattaaccaaaatgcgattattgtgatcaagcggaacgacatctgcaactgttcctaaagcaacaagatctaataattctgcaatgttaggctctttctctttgaagtagcacagctcacgcattttagctcgcagggccatcatcacatagaaaatcaccccgacaccagccaaagactttgagggaaaagtacaagcggccagatttgggtttaccattgcatctgcatttggcaggctgtctgcaggtaaatggtgatcggttacaagaacccgaatcccttgagctttaagtaaagcaatcccttcaaaagaagaaatgccattatctaccgttaaaacaaaatctgccccttttgccatgaccatttccgcaacactaaggcttaagccatagccttgtgaaaagcgatcagggattaaataatcaacctgctgaaaaccgaactgccgtagcgccaaaatcgccaaagcggtactggttgcaccatctgcgtcaaaatcccccacaatcacaatccgatcttgtcgagttaaactgtctaacagtaaatccacggcttgttccatattggcaagccctttagggtgatgtaaacctttgagagataaatccaactctgcagggctttttacccctcgactttgatagatacggtttaatagaggattttctgataatcgttgttctgttaattggggacgacgttggactaatttctgcataaaaccaaacttagttgtaataatatttatccatgctttaaagtagatatcattccgtttgcttacgatctagataatgataagactgaattttacgaatagtacgagaacgtcctcgaataagtaaggtctctgtcactgctaaatttccttgacgtagaatacccttaagcaaatctcctgaagtaatcccagtcgcagaaaaaactaaattatcatctctaactagatcttcaagcttcaatatttcattaatcggtacattcaatgcttcgcaacgatttatctctttttccgcataagcaaaattctctaaggaattacctttaacttggttccgtggaattaatctcgcttgcatatcaccgcctaaagcacgaactgctgccgcagccacgacaccctctggagcaccaccaatgccatataacatatctaaatctgcttcaggtaaacagcactgaactgctgcagccacatcaccatcaggaatcgccatcacacgaacgcctaatttttgcatttcagcaataacgtctttatggcgtggtttatctagcaccgcaacggttagttgagaaagtaattttccttttttagaggcaacacgacgtagattttgctcaataggaaggcttaaatcgatcatacctttagcttcactgccaactaccaatttttccatatacatatcaggggcttgtaagaaagtttcttttccccccgcagctaataccgataatgcattcgcttgccccatcgctgtcatacgagtaccatcaatcggatcaaccgcaatgctgacttcttcatcttcaggacggcataaaccgattttttcaccgatataaagcattggagcctgatcaatttccccctcgccaataaccacttcaccacgaatttccatttgattcaacaaaaaacgcatggcttttactgcagcatcgtcggcagcattcttattaccacgaccaagccaagcaaatgcagccagtgccgccgcttctgttacacgggaaaattcgatagaaagggatcttttcattttaggttccttaaatagagatgtgtttgcaaaatttttgaggaatcctaccgcttgtagtaggtcataagcggaagcaaattgtaagggttagtagttttttagtcaatttttatcacaaattgggctaactattttgagttcgccttaatcgcgtgtagaatgtttcgttatttttactagtaagagagcgattatgagcaacgaagagattttacacgacgaacaccacgatgttcgtgccaactttattacccatatcattgatgaagatttagcctcaggaaaacataacaacgtctatactcgtttcccaccggaaccaaatggttatttgcatatcggccacgcaaaatctatctgcttaaacttcgggattgcagaagattataaaggtttatgtaacttacgttttgacgatacgaaccctgttaaagaaaacgtggaatacgttgattcaatcaaagaagatgtgaaatggttaggctttgaatgggaaggcgagccacgttatgcgtctgattatttcgatcaactttacggctatgcgattgaattaattaacaaaggtttagcctatgttgatgagctgtcgcctgatgaaatgcgtgaatatcgtggtacattaactgaaccaggtaaaaacagcccatatcgtgatcgtccgattgaagaaaacttagcgttattcgaaaaaatgaaaaatggcgaaatcgaagaaggaaaaatgagcttgcgtgcgaaaattgatatggcttcaccatttatcgtaatgcgtgaccctgtattgtatcgtatcaaatttgcgagccaccaccaaacaggcgataaatggtgcatttacccgatgtacgattttacccactgtatttcggacgcgattgagcgtattactcactcaatttgtacattggagttccaagataaccgccgtttgtatgactgggtattagaaaacatttcgattgaacgtccattaccgcatcagtatgaattttcacgtttaaatttagaaggcacattaacctctaaacgtaagctgttgaaattggtaaatgacggtattgttgatggttggaacgaccctcgtatgccgacaatttcgggcttacgtcgtcgtggctatacccctgggtctatccgtgaattctgccgccgtattggtgtaacaaaacaagataacgtggtggaatacagtgcattagagtcttgtattcgtaatgacttaaataccaacgcaccgcgtgcaatggctgtgattaacccagttaaagttgtgattgaaaactttgaaggcgaagaatggctaaccgcaccaaatcacccaaatcgtgaagaacttggcagccgagaattgctgtttacccgtgaactttacattgatgaagcagacttccgtgaagaagcaaacaaacagtacaaacgtcttgtattaggcaaagaagtgcgtttgcgtaatgcttatgtgattaaagcggaacatgtagaaaaagatgcaagcggtaagatcactacaatttattgcacctacgatcctgaaaccttaggtaaaaaccctgcagacggacgaaaagtgaaaggcgtaattcactgggtatctgcattacataataaacctgcggaattccgtatttacgaccgcttgttcaccgttgcaaatccaggtgcggaagaagatatttgttctgtggtaaatccaacatcgttagtggttaaacaaggttttgttgagccaagtttagcgaatgcaaaagcagaacaaggttatcaatttgaacgtgaaggctattactgtttagacagtaaagacggtagtgcagataatctcgtctttaacttaacggtaagtttaaaagagagcgtagcgttttaaggctataaataagataagcaaataagcgggcggatagcccacttattttgtaaattttcttgatcaaagtaaacattgactatagattttctcaaattatcacaaggagatataaatgagaaagctcacatatctaacttcacttgctatttttacaagtgctttacttggttgcagttgtagttgtgaaaaaacgcaaaaaccacaggaagagaaaaaagatgatcaggcgttatttgaggaaacgctaaaccctacgccccctttaccaacaagtctgttaaaactgcctggcccaccaacggtcaatttgttagcaaccagtccatcaaatactgccgaatttaacgactttatcagtattatgggacaaaatggggcagtgattacgatgtggtctgttgatcgtcgtagctggctttggatgtatccgccgcttaattctcaagattttggcaaattgcgtaattggcgaattgagcggagcttccgtcaagaacattttcgttttactaatcagcagatgggatcttgtatgcaggcttatggaaatggtgtgattcaagatagctgtgatccaaataatttagatcaagattttgagttactgccaacctcgacaggatcggtgttcattaaaagtgtttcccagcagcgttgcttaacttacaatgcggtgagtaccactggctattttacgctgactttggatcgttgtgatgataaacgtattacaccgttacacgatcaaaccttctatctcacaccaccattacttagtgctaatccattataggaggaaaaatgacgttatttaatcgagctatagcattagtatgttgtttacttcctcaaattgtcttggcaaatttggaaaactatacggttgcaacgtggaacttgcaaggttcttctgcgattaatgaaagtaaatggaacatcaatgttcgtcagcttttgacggggcctcaagcggcaggtattttaatggttcaagaagctggctcattgccatctaccgccgttcatacacgccgaatggttcagcccgagggggttggctttccaattgatgaatatgtgtggaacttagggacaagaagtcgtccaaataatgtttatatctattactctcgtcttgatgtgggggcaaatcgagttaatcttgcgattattgctcgtcgtatggcaagcgaagtgttcgtgattaattccagttccagtgtattaacttctcgtccagccataggtattcgtattgatgacgatgctttctttagtattcatgctctttcatctggaggagcagattcactaagtttgattcaaaatattcatacgttctttaatactgagggaagacgacatattaattggatggcggtaggggatttcaatcgcgctcctggtcgtatgcaagaggctctagattctgaacctggactgcgtaatgctacactgattgttgcaccaacggaacctacccatcgttctggtggagtattggattatgcagtgttacacaatgcgaatcaaaccacacaaaacacgacggtcagtgccagtattatgtttaatcagatgagatcgcagattacctccgatcatttcccagtcagctttgtgaaaaaacgttaagggggaagttatgctaaagcgttttactttattgatgacattaggagtatgccagttttcccttgcagaaacaccaccgatgccacctgcacctacgccaacaccatcaacttatcctgatgttgttgaaataaagccccctattatctctttacgcagcttaaatacgggtgagcctgtatctaatcgtagctatgatcggaatgatccaagagaggtgcagtggcgacttgttgatgttattgttaaaaatcgtcggttcgttcaatttcaagtatttggtaaagaaaatcgatgtttagttggagatggtggtactttaccctgtggacaaacagacactttatttaggttagtcccaaccgatacgggggcatttattctgacagaccccaatacgggaaaatgtttaaccagcgagaattatggcagttatggttttcaaaactgcttgcgaacttcttcagcagaacctagcaatattccgctaaaacatctttggatcattgctccgccttttgggcctagtaggttattataacattacaatttttaggggctaaattgattagccccaattccaaatcagtgccttcctcaatgccataaaaaaatctatcgttttcctctgccaaccagatactgacacgcaaggtttgtatgccataacctgcatccaaacatcccatttcctatcttttttacttcattgcaaacacaattttatttataggaaatttttatgtctcatctttctgttgctaaatttggtggaaccagcgttgccaattttgaagcaatgtctgcctgtgcaaatatcgttactgcagacgcaaatactcgggttgttgtgttatctgcttccgcaggtgtaacaaactatttagttgaactggcgaatggttgtgaagcagagcgtcgtgaagaaattttagcggcagttcgtaccattcaatataacattatcgaaaaattacaaaaccctgcggcagtttctgcagaaattgacgcattgttagaacacgtttcagccctagcctctctgcaagccttgcgacttcggcagccctcactgatgaattaatttgccacggcgaaatgatgtccactaaaatcttcactcagctattaaaagagcgtaattatcctgctgtatgggttgatgtgagagagattgttgccaccaataaccattacggcaaagccgcaccaaatgatgagaaaacccaagctcaatcagatgctatccttaaaccattaattgcagaaggcaaagtagctattactcaaggctttatcggtcgtgatgatgaaggcaaaacaaccacattaggacgtggcggtagtgactattcagcagcattgttagccgaagtgttaaatgcaaatgatgtgttaatttggactgatgtgccaggcatttacaccaccgatcctcgtgttgtacccgctgcaaaacgtattgatacaatgagctttaacgaagccgcggaaatggcaaccttcggtgcgaaagttttacacccagcgaccttgttgcctgcggtgcgtagcaatattccagtatatgttggctcaagtaaagccccagaacaaggtggtacttgggtaactcgagatccacaacctcgcccaagagcctctctcacaatttgtgtaaatacctgtttctgagataatacattcagacacaggtattttattatgaacgaaaaacaacttcacgccttggcagcggaatttgccaattaccattaaaacggcacagcacattaatttccccttgaatttgggtaagttcaataaggcggtcaagatagtccatcatttttcattaatacaataagcatgagctatctcaacttcatctgaaaaatcaccgcttccgcttggcaactaaataagaatttcgcttgtaacaaaaagccatcttcggtttggctgatttggctactgatattgcacggatcactttcaacttctcttgcttttgccgttaatgtggccagtccttgttctgcatctgcttgggttggatagacaagggctaattcaatggtgctgtccgcattgtcgaacatagacgtgctacttggtttacaaataccaccacaacaattggcttggtcactaaaggtttttgacatatttactccttgatattttgaaatttaagtaaagcgtatcataatatggtaatcaattcattgaggggaaacaaattatgtctatttctaaacaagctattcttgatgccttccattatcgccacgcttgcaagcaatacgatccaacgaaaaaaatcagtgatgaagatttccaatttattttggaaacagggcgtttatcgccaagttcttttggctttgagccgtggcgatttttagtgattgaaaaccacgctatccgtgagcttattcgtgataatgcgtggggggcaaaagataaggtgatggattgtagccattttgttgtgatccttgttcgtcagcctgaaactctgcttgctgacggcgaatatgtacaacatattatgcgagatgttcaccatattcctgaagaagcgttaaaaatgcgtcaaggtttttatcgtaacttcagtgaaaaggattttggcttgacccaagaacctgtggcgttttatcactgggcttgtcgccaaagctatattgcattagccaatatgctaacagcttcagcaatgattggcattgatagcaccgcgattgaaggtttcccattggaaaaaatggatcagctttttgtcgaaaaagggttgtatgatccgaaagtctataaacttagtgtgatggtcgcctttggttatcgtgcggtagaacctaaagcgaagacccgtcaagcaatctctgatgtggtggaatacatagaataatgcttcttaatacaccaatcctaatatatccgaattaatatacctatgataatatccactacaaatatctaccttgtcggtggtgcagtacgggatcaactgctcggcttagcagtcaaagatcgtgattggttgattgttggggcaacgcccgaacagcttttagctcaaggctatcaacaagtcggtaacgatttccccgtatttttacaccctaaaaccaaagaagaatacgcccttgcccgtaccgaactcaaaaacggcaatggctataacggttttatctgcgactttacccctgaggttacccttgaacaagatttaatccgccgagatctcacgattaatgcgattgctcaagatcttgacggcaactaccacgatttttacggggggattgccgatcttaaacatcgcctgcttcgccacgtttcccctgcctttgctgaagatccgctacgtgtgttgcgtgtggctcgctttgccgcacgcttccattctctcggatttcggattgctcctgaaacggtaaaattaatgcaagaaatgaccgcttgcggtgagttagctcatttaacagcggagcgtgtttggcaggaaacccaaaaagccttcgccaccgacacaccacacatctatttccaagtgctacgagaagtcggggcattgaaagtgctatttcctgaagtggaagcactctttggcgttccacaacctgaaaaaaatcaccctgaaattgatagtggagttcataccttgatggttttggagcaggcgaaaaaattagcggttcaagcaaatgatcctgaaagtgtgttatttgccgcactctgtcacgatcttggcaaagctctaaccccaaaggatattctgccccatcattatggacacggacagaaaggcgttgccccaacagaacaactggcaaatcgcttgaaagtgcaagctcatactaaagcattcgctaaactggtgacggaatttcacacccatagccataaaatcacagagctacgccctgaaaccgtggtgaaattgtttaataaacttgatgtatggcgtaaacccgaacgtttttttgattttttattggtttgcgaagcggatagcaaagggcgtttgggctttgaaaatcgggaatacccacaagcggattatgcaaaacagctctatcaagtcgcttgtgaagtggatattcaagcggtgattaacgatggcttcgagaaagcggggattaaaagagaaattgatcacagaagacagctagttatcctagctaggaaagaggaaaacctgaactgtaagaagccaaaaacatagctaaataaagtagctttaatcccctactctccaagacttaaagctacttttgtctactaaaccttcccaaaccccttcaatccaacaacgtgtacatactcttggttattcgtgatcttacgcactaacttgtaggttgtaccacgttctgggctgatgttttctggggcggcgataagcaactgcatatccaaacgctcgcagagttcaaacaaggtattgatcgaggttgcgtctaaacgtgccgcttcgtcgaggaagagcaagcgagcaggcagaatatccttagcacgcatacggcgagattcttcttcccaactttgcaccaccattaacaagatcgacatacctgtaccaatcgcttctcctgtcgataacgcactactttccgcacgcatccaaccgtctgcaccacggaaggtttcaacttccagatcgagataattacggtagtccaatagctcttcgccaatggtctgcggtgtacgttgccctagttcaatatgtggattaacacgtttgtagagcattgccaacgcttctgagaaactgagtttttggttctcaaacagatcgctatgttgctcacggtcgtttgataaggcgttgagtaaaattgcgtgggtatcacgaatgtttaccaccaaacgcacccctttcacctgaccgaacgcaatattttgcaagccttggttcagttgcaaaatacggttttgttcacgttgaatggttttacgcaagatatttgccacactttctgagctgatcgccaattttttctcacggctagtcagttcattagttaagcgagatagctcgatttccatctgttcaatcgcatcaatcggatcgtccgttttgatgatgtcttggcgaatacgctcacgcaaatgctgataaaccgaaataaagaacgccactttattttcaggcttacggctatcttctgacgcacgcaagctatcacgcaagtattcgttatccgccactgcggttcgcaacgcaccaagagctttatcggaaatcgaacgcaactcttccgccgattgataagccagctcacggcgatttaagcgtttttctacatcactattgcgagagagtttcaacaccaaacaccaactcactttcgcctgcaccacaatttcacgctgagtatggtaatcacgctctgctttacgcaccgctttgttgagattatccatttccgcttgaataaccgccacttgcttatcaatataagatttacgcatacggtgttggcttaaacgttgttgcaattcatcacggcgtattctcgcacactcttctgccccatcatcattgcggataccgtattcgtccatctcttgcaacaactcttgaagcatctgatttttcgcatcaaaggcactgcgtaacgacgttaaaacttggttatattcgctaaattgtgctgtcgcttggcgaagctgttcacgagcctgctcacgctcacgttgtgcattgtctaaacgttggcgaagctgttcgttaagagcagaaccttccgcccctactgtttcttgatagctgaaatgcaaacgtcggttcatcacatcagcaagggcaaagactttctgctgttgcaatttttgttgctcaacagaccgcttgtaatctgcttgtagctgttcaaactgggtcggatcgctctttaacgccaccgcaatcggctcaagttgtgctaacgcattaccaaattgacggataaattgttcatcttcttgggcttctaacagctgttcacggcactcttccacgcgatcttgtaaggtttcatcggcaagaatgttgagttgtggcaacactttattcaacagttgcaactgtgctttgctgttttccagctggtgacgtaattgctgttccgtaccgcttgcttgattgagttcacgctcaatttcaacccgtttttgtgcaatctcttgcattgccacttcaggatcaggctggaaagctaaagctaaatgcgtgccgacaaactggcttaaatgttggtgtaaacgttggcatttctgcacatcaaaggcacgttctgcgtgtttttctgtcgtttcatcacgttctgcttttactttctcaagctgtttctcacgagaagcacgaccaaagaccgcaaattcagagaacttagagtaacgccattgacggtcagacagttgcaccaccacgccatcgcccagttcttccgatttaaagacattatcgtcaaaggcattcggatcaccttcgatcaaatagagattttcaggacaatcatcaagttgctgtaactgtgctttgactgcttccaaatcacgcaccacaatagcgtggcgagcatcgccatagagtgcggagaaataaggtgcatcttcaatcgacacatcttcatataactctgaaatcagcacaccgccaaatttttccgccagctgatttaagcgaatatcttccgcgccgtcaggctggcttaggcgtgaaatttgatcatctaataactgttcacggcgagcaagttcatcacgttcaagggttgcttcacgctcacggcttaaggtattttgcataaactgcataaccgcttggctactgtcaaaggtttcgccacactgctcttgcaagcgggctaatgccgattgtgccgtatgccacgcaggtgcagcttgtgcaagttgttgatattgttgatttaattgctcacgttgctgacgttgtgttgaacgtacttcaacaaattcagccagatccgcttccaaatcttcaagacgagcttgttgctcttcataatagctttcaagatcttctgcatcttccaactctgcttgtgctttttgattaaactcagcaagcaaacgttctgcattatgttgttgatgtaaacgctgttctaattctgtcaatttttgacgcaaagccaccgcttgttgtgcgtgggctttttggcttggatacgcactcagcaattcacgggcaacgctgtctgcttgtaagcggtcagtttcccctgcaattttgcaaacaagttcataggctttatcaaactggcttttcgccatatcggacactgataaacgctgttcaagctcaaacaccttgtcggtgatttcgtcagcttgagccacaaattcagcgtgataatcttcgacattgtgtaaatctaaattagccagtccgctgatctgtttcgctttttctaacgcatttaccgcttgctgatattgcaatgctcgagtttgctgtgcgtccaacgcctgttgataatccgccatttgagaacgcaattcttcaacttgatcttcggcttctgttgcacgagcttgagccatctcttgacgttccgccacttcttccaacgccatttgttgttcttctaggcgttcatttagctctgcaacatcatcttgataacgttccactttttcttgatgacgaaccgcattcatcactaaattgagatgatcggaagcactattgtactcggcttcaagactactttcgccctgttccagatcttgcatttcacggctaaattcaaccaaacgttgctgttcaagggttaatttagatttagactgataccactcttgacgcttttcaatcgcctgttgcacattgccacggcgttcgttggcgtgtcgcatatagtctgccgacacataattagtggactcggtaatcagctttttgaacatatcccgatctgactgcgtaaccttgattgcctcaagggtcatacggttttcacgcaatgccgactccatatcctgaaaggcttggcgaacgccagtattttcaggcaaaagataatcacgcaaagatttggtaataacgctagaaataccgccgtaaagggaagcctcaatcaacttatagaacttgctacggtcgcctgatgtgcgtaaacgttttggaataacgccaagatcaaagagaaaactatgataatcggtaatcgaatggtactgtttaaattgcacctcactgccatcaaatttctcttttagatcatttaacgccagcactcgtgcatttttctcaccaacctgctcagttaaaatagagataaccgattgattttcattgatattttgtaatgaaaacgaacgaatatcgactttcttatcacgccctgcgatctgctgtaaacgcacaccactaatcacacgttgtgcacgggaattttcgctttccaacaccgcataacaaacgcctgctttcaatttaccgtacaaccctttatcacgagagctagaagttgaacctgcttcggtggtattacggaagttaagcaaggtgagatcaggaattaacgccgtcacaaacccagccatcgtggtcgatttacccgccccgttaccgcctgaaagggtcgttaccagttcgtccaagtcaaaggttcgagcaaaaaaaccgttccagttgattaaggttagggaacggaatttgctacggctcacactaggtatagacgattgtacatgtgtcgcaaccatgatattttgagaagtgacgttttgttcaaataagtcgtttttttctgtcatatatttgcctaaatactaaatttcaatttgatacagcttctcaacactgtctttatcatagaatttatgatcactttgaatgatttttatgctttcactttctgtaatttgaatttgtttcaatttttcaactaactggttaaattcatctgtatgagctagaacaaaatcatttatccccatgtaactattttcttctttacgtcgagcaagcacctcattttcagataaggtaacaacataacacaatgcttctcgatgcacatatttagtcgccatagcttctaaatctgcttgcttccaacgctctctaagagttgtttttgcactaatagtaataggggtcttacggttatataacacaatatccaaaataacattcggaacaaatgctaattctgcttgaacatatacaggtgatattttctctcttaacagagctagcacaagtaactgttcaaatacaccaccattaactgaattgttagattcaaattccgatgtgtacacattccaataaaaagaaatcaattcatttggcttccatttttgatttatcggatatttatgaaccattaattttactatatcggttacttttgttcctttcgccatattatctttatcctagccttaaatgctccaaaattttctctgccgttgcttgcactgcaggtattgcaactgaatttccaaattgcttgtatgcttgtgtatctgtgacagggataatataactatcaggaaacccttgtaatctagcccattctctaggtgtcatttttctaataccttccctattcacattaccttttatcttcgtagttggtgtaaagtcagtgattcgatgatctattaccaaatttctctcacgccccataccaccaacaacgatcgcatttgcaataccatcatcaggaataatctcatacccaaaaccattgcctttatcttggtggcgagctttgtgctttcttaaagtttcaatatattgtgttgataaataatatttcgttggtacaacatttttttctttcacatcattaaaacaaactttcctatttaatggtgcaggataataaaaagagtttatcgcaaggtcttgtctaaacccaacaataaaaattctttctcgattctgtggtacaccaaaatcttttgcattaagtattttaggatctggtacaaaataatttagatcttctcgtaacacatttaaaattgtgcttagtgttcttcctttatcgtggctactcaatccctttacattttcaagaaaaaatgctttaggctgatgtctgcgaataatttcagctacttcaaaaaataatgttcctcttgtatcttcaaaccccccctctttttcccgcaatagaaaaagcttggcaaggaaatcctgcacatagaatgtcaaaggttgttggtataaggcgtttcgtttcttctaaagtaatatcgccgtatggtttttcaccaaaattagttgcgtatgttttttgtgcattttcatcaatttcactagaaaaaacacaataaccacctagcttctccatagcaagcctaaacccaccaattcctgcaaacaagtcaataaatgtaaattcagaatatgaaggaaatgcttctttaaataagttgtattgtattgagggttcttctactttctcatgttccattacaattaatatatcctcactattcttcaccatcatctatttcttcatttgcaaattcttcgtcaaaactgaccgcttgttctttcgcaatcgtaggctttgttgcctcaccatcacggattaaacgacgttgagcttcacgaggatcgtcccctgttctcacatcagccccaaaacggaacactgactctgaaatcacaaattttttgctgttttgatcgccaacacgagtaatcactcctaaacgacctaaacggcgtaatgccccacctactttctcagccagcttcgctttgtctaaatctgatcctgttgaacgtggattgattgctttaagcaacttgatttcgtccgccaaattaagcaactcatcgtacacttcgtcatagtggaaaatcccttgctgtgcaaggcgttctggactgagatagagataacacaacacttttcctaccaacatttccatttcagacatcgccgaacgagcaatcaaagttgttgctttaggtcgaagatagaaaaagccttctggtgcacgaataagttcgacgtgataacggcggtaaaactgttcaagctcgctttggtaatccatcaaaaaagcgtgttcatcaagggcttctaaactaatatgtcgccctgctcttaattgactgtcaagttgcggaaaaatcgggttagcaatcgcttcagccaatttggttgaaataagttcttgggtgtttgtcattgtcgttctctatttttgtaaaactttaattaaaactgaccgcttgttatttattgtattggtcaatcacattcgcctgtacttctgcacctttatcattaatcgactgccattctgggtaaatcgcttggctgtcttggcttgccataccgagtttaacggcttgatcgacgataattcgtgctacatcaaaatggcgagaaagcggatacattgccaactgttcacgcaaaatcgcaccgagatcaatcggtttgccttgttcacggaatgggacaagatattcttgcattgctgcaataatctgctcctgcacttgggtgagggactcatattctagctcagtcggtagctcgcctacggcttccgcttcatttaattcggtttcatcatcacgcagatccatcaaaggctctgctttggcaatataaagttgccacgggctttcaaaataatcttgaatagactggcgtaaacgttgcccaaagacacgatttttatccatatcaatggcggtacggataaatttatggacgtggcggtcatagccgatccagagatcgatcgcctgctgtccccaactgataatacggtcaagtttattctgcaaattcacaatcaattgatcgacaaaatccaaatcatcacgtccaatcaagcaactttgaatacgcaataattgagattgcaacttatcccctgacgcatttaatacatcttgcaactcacgcaaattccccgaagtttcgtctaacaactgctgacaagtcgcaatagcttcgtgccaattttggcttaacaacgccgcaatacgctcacggatctgctgttgattttcgtccatcatacgctgggaaagatcaatgctgtcaaaaatttctgcaaccgagaattttaatggcgcaaacacttgattacgccagaaacgttcatcaccgccttcttctgctgcattggacgcacgctgaatttcatcggcaacaatagaaagttggatcgatagacgtaaagtcgaaaattcacgttggcgaatataatattcagatacgcctacaccaagtggcgttaagcgataaatcgccaagccttcggtaaattcgctggaaaaacggtttaaaaaacgttgtttgacaagatcgttgatcgcattattcgcgcgctgtgtttgtgttgcttcagactgctcaaaggcatttgaaacatgacggaaaatatcttgtaaatcgctttcaagcaattcaccgtcagtgcgttcgttattatacagggctatcgccaataaaaatgccaagcggtcggaagaaagggaaagcgaaaattctcgctcttttgtccataaaatcagttctgggatcgtttgtgctaattcgtgttgcataggcgatattatttaaatataaaaataggcattattgtaccttaatcagagcagaatggaaaagacaagcggtgagatttgtacaatttattacagttctcaccgcttataggctattaactaaattatctcaataaatattggatcattaaatctgcaatatccactttagtcacctgctcaatcatttcaagcccagggcttgcattgacttctaacaccattatgccttgttgagaacggataagatcgacacctgccacatctaagccgatagcttttgctgcttgaactgcgattttttgttctgcatcagacagttgaatggcttgggcggtgccacctctgtgaatattggctctaaactcaccgcttgcaccagtgcgttccattgttgcaacaacttgctcaccaattacaaaagctcgaatatcttgccctttagcctctgcaataaaggtttgtaagaggcttggtactttggcactttttaatgtttcaagtaaactcaaggcactgctatagctttctgccaacattacgcctacgccttgagagcctgacagtgttttaataaccgctggcaagcctgattgacttaaaccttcagcaacgctgtaaagctctcccattaatagcgtatcaggtactggaatgccacaggcggcaagtcgctgtaggctttgccatttgtcacgggcaagagcaaaggcagaagacgcatttaaaacaggtacatgtttttgttcaaaatgccgtaatacattacagcctatttctgtgctagttgtaccaaatcgaggcaagatacctgcatattccccgattttttcgggttttgctcgagttttatcgtagctttcccctgtttgataataaagctcaaaccgcccttgctgcagttgtagcaagaagcggtttggatcgagaatatccagttggtagcctttatgttctgccgcttgtttaagtctttgacaaccatataaacgaggctcacggcagagcattaataattttttagcattcattatgcgtaaggctgtaactcagggttaattggtgtatctgcgaggttgtttgcatagttacataagctggctaggctgacaccaagtaccacatctagagcattttgttgggtgtaacctacggcaaaaaattcattgagtagggtttcacccactttgcctttagttttgataacagcgagtgtaaagcgtgcaagggtatctaatttgttatcttgaattggcgtagctttgcgtaatgcttgcagcaattcgtcaggcattttgatctgtttaatggaaattgcggtatgccctgctacgcagaaaccacaaccatttgcgaccgctacggtaatttgtacgacttctctctctgttggcgttaagctgttacgttggttaattgccccgacggtgcgataggtttctaaggcggtaggtgcattggctaatacgccgattaagttaggaataaagccgttattgtttttaaccgcttgtaacgtttcttttgctgcttcaggtgcagtgtcgatagtatgaatttgaaatttagacatagtgaacctctataataaaaaaataaaatctgtcaaaaatctgcgattaattcaccgcttgtaaaatggtttttaattgtaacacacttggggtaacgactggcaagaatgccccttctcgccaacggcgaataaagctagtgccgccattggtaagatagcctctcccaccagaagcctgtaattcaagtgttaaactttgtacaacaatatcgacaatttcaatccgaatttggaagagtgctttagggtgttgcacaaaatagctcggatcagctaatccctcggctagtcgttgctgtaaagcggtcagttgttgcgttaaattttcccagtctgtttgtaaaatggaacgattggaattgagtgtctgtttgacttcgttaagagaacgttgagccaaaccaaatgccattgcacattgtaaccctaagaacgcagggcgaacattaactaagtaagaagaggcatcttctgcaataatccaatttgggtctaattcgacattttcaaaatgaagggcaacggtgttgcttccttgcaaaccaatcagagataactcttttgttctggttagccccgttgctatggaaggtaatgcaatgataatcggggctttgctattgtcggcatacgatgcgacaaagatagtaataaaacccgattggcgtaagttagtaacccaaggcaagcgtccgttgaggtaatatttgccgttttcgtgagtaatggtcacttgtaattcttcaatgcccgacagaaacttgacggcattcgataaccctgttccccctgcacgtttgccactaagtaaatcggctaaccattgttccttcggataactatttgaacttgcaagtaaattttcaattaaggtgcggtgtccccaagagataaaacctgcagttaaagagatttgcgaaaccgattggatagcgtgaatggcatcttgaatggtgccaccgcttccacctagttgcgaaggcactccgattttgaaaatcccttcattggcaagacgagtaagtaattcgtctgcatattgattagactgatcaagatcatctgcgtgctgtgacagccattgaataaattcaacggaaagatatgacatagcgtactcctgtaaaatgaaatttttcacatcttaggtaaaaataatatgacaaaaaaatacatttttaagatgttttatgctttttagttatatttaagactagaataaatttatctttcttataactggatattctttccttcccgtttgcttttcctctatgttgtattccacgtcttatttcaatgtgtaaaaaatggtgttaaacgtaaacaatgtcgcaataggctatccttcttcaacggggataaccccaattttgcagaatacttcatttaatgtggaacaggggcaactcacctcaattttaggtgcgagtggtgtgggaaagtcgtcgttattacgcgtgttggctgggttagataagtccattgaggggaatgtaacgctttttggacaacccgttaaacaaccacttgccgagatcggttatgtgtttcaatcgccaacattactaccttggctgaccgtcgcagaaaatgtggctttcgggctggattttgtctgtcagggacagttggcaaagaatgaaattaaacggcgagtagcagaggctctagccgatgtagcgttgagtgatgttgccaatgttcgtccaaatgcattatcaggtggaatggctcaacgggttaatttggctcgtgctttagctcgaaaccccaagttgattttgttagatgagcctttttccgcacttgatcctattactcgtagccaaatgcaacaaatactacatcatatcgttaaacagcgacaagctacggcggtgatgattactcacgatattgatgaggctctgactgtatctgaccatattttattattgagcggtaaaccagccacaattaagggaaaatggcatttaccttacgcctttccgagaacggatttgctggctttaaaccattatcgtgtggatattttgcaacaaatgcaagctacaccacaaaacaatatcgaatatcttatttaggaggttgtatgaacaatgaacgtcgagattttctgaaactattaagtttatttacccttgcaggaagtagcccctttttgcaggctcaagagcaacagcgaaaaattaatcataacgcaccgcttaaaattggctatttgcctataacagatgcgacaccattgctggttgctcacgctcaagggctctttgaaaaatataatgttgaagtcaaaaaaccgattatgtttcgtagttgggctcaacttattgaagcctttttaagtggcaatgtaaatttaattcacgttctttcgccaatgagtttatggacaaaatatggctcaaaagcaccagtgaaagtcgtgatgtggaaccatctcgctggttccgctttaactgttcgccctgatattcaaagtattgcagatttagcaggtaaaactatcgctattccattttggtactctattcataatattgtgttacaacagctactcaaagcacatcaattgacggtaacagaacaagagcctaaagcaaatgaggtcaaactgacggtgcttccaccttctgatatggtcgctgcgttggcaagtaacgcgattgctggttttatcgttgccgagccgtttaatgcgatagcggaagcaaaaggtgtcggaaaaattcttcgttttagcggtgatgtttggcgagatcacgcctgttgtttaaatctaatgcacgaacaagatgtgaacgaacgtccagaatgggtacaaaatatagtgaatgcggttactgaagcccaagttttcattttggataatcgtcaagcgacagcacagattttggcaagaggaaagggttatacccctcacgatcaaaaagtgttagaagcggtgttagatccaactgaggcacaatggcaacactacattcaaactggggctattcgccacccacactggcatcaagaacgcattggttttcaaccctatccttatgatagttatatggaaaaattagtagagctacttaaagaaacccatatcgcaggtaatagtgatttcttagcctcacttgatccaacacaggtagcaagagagcttaatgcccctcagtttgtacgcaaagcgattgaaaatggcggttggagcgacaaattcaaattgcaaaatggctggacaagaacagaagaaattgcggtgtaataatgaaaagaaactatctatatggatttacaggcttaatatcgcttgttctcttttggcaggctggcaccctgttgcttgctcaacatattcaaattgcgactgatctttcgcccttgcaaacgctcaacagtttatatgctctgagtatttcaggggaaatttttccgcatatttgggcaagtgtgcaacgtattattgtgggtttaacggtagccttgctttgcggtattccgctgggtttagctttggggctatctaaaaccttagaaatgtgttgtacgccagcttttcaatttttacgaatgatctcaccgctttcttggatgcctattgtggtgatgtttctaggggtaggggatctgccagtttactttttgattgcatttgctgcaatttggtcgttgatcctttctactgcatcgggggtaaaaagtattgatccgcaatggtttttacttagccgttccctagcagcttccaagcgtgaaaccttatgccatattattgtgccagcgattacagggcatattttaacagggttaagagtttctttaggcattgcgtgggtagtgcttgtgccttgtgaaatgttaggggttaatgagggtttagggtattttattctggatactcgagatcgattagcctattcagaattgatggctgcggtgatcgttattggcttgattggctggggattagatagtctattacgccttgggattagaacaaaatagccctgagtgtcagggctaatagctacaatttttctaaataatttattccgccaagattattaacctgtcgaataatccactgttgccgagctcgcattgtttggcttggcattttaacccgataaatcatcggatttggcaaagaggctgctaataaggaagcctcgtgtaaactaagctggcttgctgatttcttaaaataatgtttagctgccgcttctacaccaaagatgccatcgccaaattcagcaatattgagatagacttctaacactcgctgtttatcccaaagtaattccactaaaaaggtcaaaggcacttcgatcccttttcttagccaacttgttccgtgccataagtaaaggttctttaccgtttgctgagaaatagtggaagcaccgcgaggtttcttttgagatttactatttcgcttaattgctgcttcaatcgcatcaaaatcaatcccaaaatgaattggaaatttttgatcttccccagcaataaccgacatttgcatttgccacgaaatacgatcaagactaacccactgatattgaattttatataagtccccttgtattaggtgttccacttttttctgtagcatataagctgaaaaaggcacgggaattactgaaaatatcaatgttaaagaaacatagaaagttgtgactgccacaccaatacgactaacgccaaaccaaagccaactttttaaagatagcatctgtttgggaataaaaaagcggaaaatagattgtagcaaggatttttgcttaggttttggtgccattcagttttgtatctatccactttaaaatatctggctcaacagtttttaacatatttgaaccccgtgtaatagtcgccgcactagtattcaattgctgttggatttcacgctgagaaatttgattttcgagcaatgcgcgtacaatttgcactcgcaatcccaacgaagttcgttcgtctgttgtcaataacatcgacaataatgcatctgttttatcttctgctaccgcttgttttaaaaggtcaacaaattgttgccattcttttggatcacgttgttgataaagggttctcatacttacttatcctgttagtacaatagtacggtaagatctgcaaatcttaccgctttactctttgttatgcttattttttaccacgttgatcgtctaattcagccccttttggcatactaaaactaaacagactttcagataaatgagccgttgaaatgttacgtaatacatagagattactttgcccgtcacgttcaatagtgctaaaacctttgactaagccacttgcatcaatacgaatatcaaattgtttgatcgcactttttttcgattttggttttaatacaaaattatctacattttgtgtgacatcatattgatcccaatggcttttatcattgcttgttaaaagtacaaatggtgtgttgctcaccgcatctttaacccaatttgccgttacctgagatacaaaaggatcgtaaaaccacaaagttttgccatcagatacaattaaattttcttgaggactttgggtgtccatacgaaataagttcggacgtttaacttgaaacttcccttgccctttttgaatttcctttcctttacttgaacgaacggtctgttcaaaatctgcactgtattgcattgctttatctaaacgttgttgtaactctgcgacagcttgagcatcagcaaaagcaaagccatttaatgagagaaatgctaaacctagcaacgatttttttaacaaatttttcattgatttccctttaaatatctatagaaaagtgtctatttgacagcaaagccataaaaagttcttagaaacggatacccgtaccgattcctaagccaataccgactccattagaaccaccacctgcattcactcttccaccaaaagtacaacctgcgagcattaaaatagaggcaatcacgaatatttttttcatatttatcccttgtattaaaaactattataaactttcagcttcaaaagatgcgcattctactctgttttaacactttaaaccaattccaaaggagattttatgaaacttttacataaactaagcttactctttttgataatttttcctatgactactcaagcgagtccgttgagtatttcagagcaagaaatcaatcaatatttggctacgcgtttagcagaaaaagtgcctttgcaagatagtttaggtgtaccaagactatttcaactagactataaattatctgatttatatacaaaggtgggacaaacagatgaaaaggttgttgatatttcaggcatcatcgacagtctattacagataaagggtaaagaatatcaagttaaacttaatataaatatggatactcttcctttctatgatatggaaaaaggtgcactatttctaaaaaatgttcgtttaaaaaattggaacgctacccctgaaaaatatcaaaatgaacttcaggtgtttttaccaataattgctaatagtcttacaaatatcttaaatagccaccctgtttatacattagatgaacgtaaaacaaaagaatcccttgtaaaaaaatttggaaaacatattattgttgaaaaaggacatattcatttagaaacaaatattttttgataaagatccctcttattttaaataagagggattttgcattctattcctttaaaaaaaccttccaacaattcatttaaaaataatttgccgtgctgtgtaatctgccaagatgcattgttttctgtgataaaatttctgctcaatgcccagtccattgtggcttgaacctgcgtccgatctagccccgtatatgcctcaaattctgtttttggggttgcttcaagtaagcgaaaacggttcataaaaaattcaaaagggcgatcatcattttcaatcatctcttgatgataacgatactctcctcgcatatagcctttggggtgcttcgttttgctaaagcggtaaatttcccctgttggataacttattttcccgtgagccccacaaccaatcgctaagtaatcaccaaatcgccaataattcaaattatgctgacattgatacccctttttcgcatacgcagaagtttcatactgttcataacctgcgtcagttaaaagctgatgcccttgttcaaaaatatcccaaagctcatcatcgtcaggtaatgtgggctgtcgatagtaaaacatcgtattcggctcaatcgtcaattgataccacgaaagatgtggtggatttaacgcaataccttgccgtaaatcatcaagagcctgagcaacagattgatttggcaatccgtgcattaaatctatgttgaaacttctcaagcctactcttgctgaattttgagcaaatctaaccgcttgttttgcttcattgctatcgtgaatacgccctaatttcaataatttctctggttcaaaactttgaatacccattgaaatacggttcacgccaccttgtacatacccgataaaacgttctgcctcagcagtccccggattagcctctagggtaatttcgcattcgtgagaaaaatctatccgcttgcgaatttctgcaagtaaataatgaataccttcagcggaaaaaagactaggcgtaccgccaccaataaaaattgagtggatcttgcgatcagcgattgctgttttatagcttatgagatcttgctcaagatcattgagcaaatgctgaatatattcttgctcaggaataatgcccttttgtgcgtgggaattgaaatcacaataggggcatttttgtacacaccaagggatatggatgtataggcttaaggggggctgcattaaattcaccatatcttccagtatataaaatccaaataaaaattcttacatatagtactagtataacacctaagatatcacaaagctttccttatcaatataaaatcagtctccttaaaaaattaggatgattgttcacatatacaattatgcctacctatttttaaaataacctattaatttgatttactctccagataatctcaaacacccaactctttaaacaaccgtctgcaagctgtaccgtcttctttgaataagtggcaacggtttgggttgataccaattgacatttcatcaccttcttcaactaatacgatgtcgttttggcgataaacaaggctttgtttgattggtggcatttcaaggtaaatttgggtttcgtttccaagttgttccactacttttactgttcctttaatgcacacttcactctgatcacaaggcagtaaatgctctgggcggatacctaaagagagattgtcgccgatattcacacctgtgttatctactgggatccagaagttgagatgggtggagtcaggtaattcaatttttacgccaccttctcttacatcaatcacttttacaggtaagaagttcatttttggtgagccgataaagccagcaacaaagcggttggctgggtagtgataaagttctaatggtttgccaacttgagcaacgttagtggtaatttgtgtattgtttccgagcgcttgtaacaccacgattttatcggcaagggtcattgcttccacttggtcgtgggtgacataaatcattgttctacctaattttttatgcagtttggaaatttccacacgcatttgtacacgaagggctgcatcaaggtttgagagcggttcgtctaataaaaacacttcaggttgagaaacaagcgtacgaccaatcgcaacacgctgacgctgaccgccggagagttctttcggtttacgttgtagtaagtgagcaagttgtagaatttctgcgacttggtttacacgttgctcgatttctgctttcgctttacctgccagttttaagccgaaggacatattttcagccacattcagatgtggataaagtgcgtaagactggaaaaccattccgatattacgttgagcaggtggcacatcattcattcgggtatcaccaataaagagatcgcctgatgtaatatcttccaagcctgcaatcatacgcaatagggtggatttaccacagccagatgggcctacaaatacgacaaattccccttctttaatatcaaggttaatattgcgtgagatatgcacatcgccgtatgatttatttacaccaataatttttacatctgccattgtcttatcctttgccttagggttactactttttgacgggtgccaagattacttatttcctcttgtcttgaaatcatactttgtgaaaaaatttttcactaccttgtaaaaaattttttagcagaaaagcagattttttgtgacttagatcacaaattcatacgctttttttgtgatccatttcacacttattttaaaaacaatcaaaaatgtgatacagatcactaaaaggataaggggggaggataagggggtatgatgaagtatgagaagaaatcctccactattcgactgtcaaaatttcatttcactaaactgagggaaaaacaatgaaaaaattaaccaaagcagcattagcggtattagcaggattatgtatcgcacaaggtgtaaatgcaaaattagttgaaggacaactcaacatctggatcaatgccgataaaggttataacggcttagcagaagtgggtaaaaaatttgaagcagaaacaggggtaaaagttgttgttgaacacccaagcaaattagaagaattattcccacaggttgcggcaactggtgatggccctgatattgtgatctttgctcacgaccgttttggtggctatgctcaatcaggcttattagcagaagttcacccaagtgcagaattcaaagcaaaattatctgatatcggttgggaagctacaaaatataatggtaaacagatcgcttacccgattgccgttgagtcgctctcattgatttataataaagatttagtaccaaatccaccaaaaacttgggaagaagtggagaaattagataaagatctcaaagcgaaaggcaaaaatgcgattatgtggaacttagcagaaccgtatttcacttggccaatcatctcttctcaaggtgcttatgcgtttaaagtgaccgcaaacggctatgatgcaaaagacatcggtgtaaataatgaagctgcacaaaaaggcttacaatttgtggttgatttagtgaagaaaaaagtgattaacgcagacactgactactctgtggctgaagcttctttcaataaaggcgacacagcaatgacgattaacggcccttgggcgtgggcaaacattgagaaaagcggtattaactatggcgtagccgtactaccaaccttaaacggtaaagcaggtaaaccgttcgttggcgtattaagtgcagcggtaaatgcatctagcccgaaccaagacttagcgaaagagttcttagaaaaccacttattaacggatgctggtttagaaaccgtgaataaagatacgccgttaggtgcagtagcacttaagagctaccaagcaaaattagcggcagatccacgtatcgcagcaacaatggcgaatgcggaaaatggtgagattatgccaaacattcctcaaatgagccgtttctggtattcagaaaaagcagcgattgacagtgcaatcaacggtcgccaatctgtcaaagctgcattagatgaagcacaagcgaagattgaaaaagagtaatttttaataaataaaaaatgtagggacacactgcgtgtgtccgttaaataatccaaattagacggacacaagcagactagtggacacacgcagtgtgtccctacgagtatcaagcggtcacattcttctcattttttgcaatttcctcttcgcagtactaaaacaaggaaaataaaatgctaacttcaactcattcctcgatttcgtctgctcaactttggggcaaaagggcttttgtcggattactttacctacttgctttttacttggtttttacaatttatctgcaaggtgaaattttatttgcattactaaccttagtcgtagtggcttcaggtatttttgtgtttagttcagaacgggcttatcgctggcgttatctattcccaggtgtatccgcaatcggtattttcgtggtctttccacttgtctgtactgttgttatcgcttttactaattacagcggttcaaaccagctcgcctttgaacgtgtagttaatcaattgcaaagccaacgctatttttcgggcgaacgttacgatttcaaattacttgaaacaacggataatcaatatcagcttgcccttgaaaataaaaatgtgcaaaaaacttacctttctgcaccgcttgcactagccgatttcaaaggggaaatcaaattagaagaagtgacaacattgccagaaagcaaagttgcaccgcttaaaaccattacccaaaatcgccaacaacttcaaacggtgaatgcgattttaccaagcgaagaaatgctcacgatgagttcacttcgtcaattttctcaacaaagtcaccgctttagttttgacacacaaagccaaattctaaccaaccacgaaaccaatgaacgctataaacccaatgatgatgtcggtttctttgagcaaattgatgaacaaggtaactttacgggtaaacgtgttgagccgggctatacggtaacaatcggttggcaaaactttgtgaaaatcttaacggacgaaggtatacaaaaaccctttgttcaaatctttatttggacagttacctttgcattcttaactgtcgtgtttaccacattactcggtatgattttcgcctctctagtacaatgggaagcgttaaaaggcaaagcggtttatcgtttactgttaatcctgccttatgcggtaccgggctttatctctatccttgtatttaaaggcttgtttaaccaaagtttcggtgaaattaacgtcattttgaataacctattcggcattcgtccggaatggtttaacgatccgttcttagctaaagtgatgattttaattgtgaacacttggttaggttatccatatatgatgatcgtttgtatgggcttacttaaagcaattccgcacgatttatacgaagcctcggcgattgatggtgcatcggtatggcaaaacttcaccaaaatcacaatgccgttgttaattaagccgttaatgccattgatgattgcgacctttgccttcaacttcaataacttcgtgttaatccaattattaacccaaggtcggccgtcaatgatcggaaccagcacaccagcaggacataccgacttgttagtcagctatacctaccgtatcgcctttgaaggtagcggtacgcaagacttcggtttagcggcggcaatcgcagtaatcatcttcttactcgtcagcggattagcgttgttccaaattcgtttgactaaattacaacaggattaagggggataaaatggctatcgttcaacctaaatcaatgaaagcacgcttatttgcaacgcatttctttcttattgtgttctgtgcgttgattatgttccctttactgatgattttagggatctcacttcgcccaggtaacttggcattaggggaaattatcccaagccaaatttcccttgaacactggaaactggcactcggttttagcgtcaccaatgcggacggcactgttaccctgccgccattccctgtactactttggttatggaactcggtgaaagtcgcaggtgtcacggcaattattaccctagcactttccactacggcagcttacgctttcgcacgtttacgctttgcagggaaatcaatgctgttacaaagtatgttgattttccaaatgttcccagcggtactttcacttgtggcgttatatgcattatttgaccgcttaggaacctatgtgccattcttgggcttaaatacccacggcggcgtgatcttcgcttatcttggcggtatcgcaatgcatgtttggacgatcaaaggctattttgaaaccattgataaatcgctcgaagaagcagccgcacttgacggtgcaaccccgtggcagacattccgtttgattttattaccattatctgtgccaattttagctgtggtgttcattcttgcctttatctcggcaattatcgaagtgcctgttgcctctctcttattgcgtgatgtggaaaactacacccttgcggtcggaatgcaacaatatctacacccacaaaactacctatggggagatttcgcagcggcagcgattttatccgctattccaattaccttagtctttatcatcgcacagcgttggttagtcggcggattaacggcaggtggggtaaaaggataaaataaaattgtagggacacactgcgtgtgtccgctattcaaacgaaaaataatcaaatggacacacgcagtgtgtccctacaaaaaataataccattcgggaaacaataacaatgaaacaaaatcacccatttttaaatcgttacttcgtggatgaacacggtcgccgtgtttatgcccaaccgtccgtttatggcaaagtggcaaaattgctcggttcgccaaaaagtcgcaaaatcctaccgcttgtcaaagttgtcaaacagggcgagcaagtttttattccgctttttgtagcggacaaaacccaaaccgttcacgcaaactggacgctgacccttgaaagcggtgagattttaaagggaaaatgcaaacgcaatagtattgacctgcctcgtgatttaccccttggttatcatcaattaagtctgaacggtacaaccgcagaatgtcgtattatcgttacgcctgaacgtgcttaccaaccgcaagagttggcagagcataaaaaattatggggagcaattttacagctttacaccctacgttcagagcaaaactgggggatcggcgatttcggcgatttagcggagtttttaacgaaattagcggaaaaagacggtgattttgtcggcttaaacccaattcattcattattcccagctaatcctgaaggggcaagcccttacagcccatcttctcgtttatggcaaaacattgcttatatcaacgttggggcgattgaggctttccaacaaagcagtgaggcacaagcgtggtttaactcggcggatattcaacgccaattaaacgaagctcgccaaaaagattatgtcgattattcacaagtgatgtggctgaaattgcaaggcttacgcttagcctatgagcaatttaaacagcaagatcaaaccgcttttgagcaatttattactgaaaacggcgaagccttgaaagtgcaaggcacgtttgatgctctacatcaatggctctcttctcaattcagcgaacaatggggctggaactgctgggacgcaaaatatcaagattatcacaccgctgcggtgcaacaattccaacaagaacagagcgatttagtccgtttctatatgtggttgcaatttgtggcacaacaacagctcaaagcctgtaacgaactggcaaaacagctcggtatgccgatcggtttctaccgtgatttagccgttggcgtggcggataacggggcagaaacctgggcggataaagatctgttcgtgttaggtgcatctgtgggcgcaccaccggatattatggcaccgcaagggcaaaactggggcttatcgccaatgcaccctgaagtgttacaagagcgaggctatcagccgtttatcgacctactgcgtgccaatatgaaagattgcggagcattgcgtatcgaccatattctcggctttgcccgtttatggtgggtgtcgaaaggcgactcggcgaaaaacggtgcttatgtgaaatatccgttggaagatttactttcaatcttagcccttgaaagccaacgccaccaatgtttaatcattgccgaagccttgggaactgtaccgaaaggaatgttagaagccttagaggaaaaaggtattttagcctacaacattttctattttgagtacgaccatcaaggaagcaaaccattggctaactatccatatcaagcaatgaccaccctaagtacccacgatttaccgacggtacaaggctactggaaaggctatgatttcgagttagggcaaaaatatggcgtttacccgaatgagaaagtgcttaacattctgaaaaacactcgccatacaaacaaagaagcgatccgccgtgccgttgaagcggtacaaccgctagaagcggatagtgcaggcgttactcagacctttaaccaccagctacaaagctatgtggcagataccaacagcgtactattcggctcacaaccggaagactggctaaatatgctagagccggtaaatatccctggaacaagcaccgaatatccaaactggcgcagaaaattgagtaaaaccacacaagagatttttgcgaatcagacgattgtgcagttgttagaaaagattgaggcgaaacggagaggaatattaaattaaacttagactctattgtttttgaaaaatcataaccttcttatatacttgccattgcaatagctatataggaaaactagtacaatctgaatgttttccccctcaattttgcaaatttaatttgccaaatgcagagagttctgttatttatacgcgctttcaaaacaccctaaatagagcggtaaaattagggaagaaaaattccaaaaacaggagtgaaatatgacagtggcaaaatccacttctttaagtttattagtccttgcgggcgtgtcgccttaccaattaggtaaagacgaagagtatatgaatgaagctcaaattgagcatttccgcaaaattttaaaagcgtggcacgcacaaattatggaggaagcggaacgtaccaaaagtcaaatgcaagatgaagtgactaacttcgctgatcctgctgaccgtgcaacgcaagaagaagaatttagccttgaattacgcaaccgtgaccgtgaacgtaaattgcttaaacgtattgagcaaaccttaatcaagttagatgaaggtgactacggttactgcgatacttgtggtattgaaatcggcttaaaacgtttagaagctcgcccaacggcagaactttgcgtagattgcaaaacccttgcagaactgcgtgaaaaacagatgggcggttaattaagtagggtgggttttaacccaccacttccgcatataaattgaaacggtgggtcaagacccaccctacaattttatataattgaggtgatctattttaaattacatcaaatctttttttagtcgtaaaaaaaaggatacaaactcaccgcttgttgaaacagatcaagcgaagaaagttgctcgcccaatgcgttcagccccagaattgactgaaccgcaccgacacacatctaagaagaaatcgaaccataagcaacaagccgtaccgtcccatattctgcataaaaaatttacccaacctgcagggcattacggtatttctccaaaagattttccaagtaacaccattgccattatcaataaacttcaaaaaaatggctatgaagcctatatggttggcggttgtattcgagatttattactaggtcaaaaagccaaagattttgatattgcgaccaatgctcgcccagaagaaattcaaaaaatctttggtcgccagtgtcgcttaatcggacgacgcttccgcttagcccatatcgtctttgggcgtgagatttacgaagttgccacattccgagccgatcatcacagcaatgcgacggaaaaaatgtcgaaaaccagcgaagctggaatgctgttgcgagataatgtttatggcacacttcgggaagatgcagagcgtcgtgattttagcgttaatgccttttactatgatgttagccataatttgatctacgattttttcaatggcatagacgatctgaaagcaggaaaactcgccttgatcggcgatcctgttactcgttatcaagaagatcctgtacgaatgttgcgtgcaattcgctttatggcaaaactggatatgttcctagataaagcgagtgatgaacctattcgcaaaatggcagtattactgaaaaatattcctgccgcacgcctatttgatgagtcgttgaaattactgcaatcaggttacggtcacaaaacctacgagttattacgcaaatatggtttatttgaacaacttttccctgtattaagcccattttttaccgaatatggcgacagcaacagcgaaagaatgatcagcaaggctctcaattccactgatgaacgtattcgtgacgatttacgagttaatcctgcctttttatttgcagcgctactttggtatccgctacgcgagaaaattgacgaattgaaaaaccaaggtggtttaaacagccacgatgcaatgatgttggctgccaatgaaattttggcagagagtgtcaaagcggtcgcattacatcgtcgttatacgaccgttattcgtgatatttggtcattacagttccaatttccaaaacgtacgggaaaacgtccacagcaaactctcgaacatattaaattccgtgcaggctttgatttactcgtgatgcgagctgaaattgaaggtggtgatttagttgaattaagtgcgtggtggcacgaataccaatttagcaatgaagcacagcgtgcggaaatgttaaaaacagtcaaacagctaccgactttccgtgacgaagaatcaaagaaaaaacgtcacccacgccgtaaattcaaccgtaaaaagaaaatcgtaaaaagggaagaatagtgacaaccgtttatgtggctcttggctctaacttagaagatccgcttgctcaacttaagcaagcggttgtttcgttgcaaacctttgcaaaaaatctaaaagttagctctttttacggcagtaaaccactcggcccacaggatcaacctgactatgtgaatgccgtggtaaaattcgacacggatctcaccgctatcgagctacttgataaattgcaaagtattgagaatgaacaagggcgagttcgtttacgtcgttggggagaacgcactctcgatcttgatattttgctctatggcaatgaacaaattcaaagcgaacgtctaactgttcctcactacgatatgcacaaccgagagtttgtgattgtaccgttatatgaaatcagtcctgaattggttttgccgagtgggaaatctttagcacaactttatccgcaatttgcagagcatcagatgaatataatagttttataatgccgattattatgtaaaactattaataaaattgataaataggtagcataataagtggcatagtagacaaacatattctgagttttgtatgttagtgagaaactttatttaatttatagttataccaactttttaacacattccccttctcatcacaaaactcaacaaagttttcacggactttaaatttaaaatcattacttaaatgaagcacatcatctttatcctgatcccaaacataactccctttttctgtaaaaggatattgctctttattcttaaaataaaccgtgttgtattgataggttttatcactatttaaaattaattgtgcttcgattttttcgcaatctgcacaaggtagtgtgccttgataagtgccagaaacagttttttgaggccatatcgaacaggcatttaacattgcgataatactggcaaatgcaatttttttcatagtcatatcctcttaggttaagcagatttaaaattaggatttaccttaaagtctaaggcggttacttcaggaaaatctgcctgaattaagtgtaatagaacggtttgctgcaacaatagcccttgacgaacagtgccattttgtacttcaaatctaagtaaattatcggataaattcaaaattcggtaaagtccacggtattgttcgggcagtaattgctgaatttttcgatttaattcattgagttcattggctcgttggacaattttcgtcaagctagagttctgcaaaatctcattgatattttttattgttgaatttttcatctttcctgctgtgctttaacttgtttttggtgagattgcccttatattctgcctattctacaaaaattgtcgtataatcaacattatttttttattgagtgctaaatgaattttttacgtcactttcataagccagcattgatttcgcaattcctattagggatcgttgcgatttttgcgttacctacggctcagccgttagcgaatgaaagtgaaacattgcctacaaatcaacttgtattacgcttaagtgatttttcttcaattcaaaaagttgagttagaggcggcacatttactacatttagaacaacaacctctcgttattccaactaaacaagctgtggttttttgcgagttttttgcaaaatcataccgcttgtatcaagtatcaaatccgccgattagggctggaccaacagcgtaattcttctatctccctcccccgcaagcagggggagcgtaaactcgttactaatacttattaccttatattttattggaaaaaattgatatgtttacaaaattaatgactgctatttttggtagtagcaatgatcgtactttacgccgtttaaacaagcgtgtcgcacaaattaaccgtttagaagctgaatttgaaaaattaaccgatgaacaattacaagcgaaaaccgctgaatttaaacaacgtttagcagaaggggcaacgctagacagcttattacacgaagcctttgccactgtgcgtgaagcgagtaagcgtgtgctaggtatgcgtcacttcgatgtacagttaatcggcggtatggtgctgaccgaacgtaacattgcagagatgcgtacgggtgaaggtaaaactttaactgcaaccttaccttgttacttaaatgccttgacgggtaaaggggttcacgttgtgacggtgaatgattacttagctcgtcgtgatgcggaaactaaccgtccgttatttgaatttttaggaatgaccgttgcggtgaatatcccagggctaccgtccgatgttaaacgtcaagcctatttagcggacattacttatgcaacgaacagtgagcttggctttgactatctgcgtgataacttggctcattcgaaagaagagcgcttccaacgtccgttacactatgcgttagtggacgaagtggactcgattttaattgatgaagcgcgtacaccgttgattatttcaggtcctgccgaagatgcgacacaaatttatcaagcgattgataaagttattccgcatttaattgctcaagataaagaagatactgaagagtacacaggcgacggcgatttcacccttgatctgaaaagcaaacaagcccacttgactgagcgtggtcaagtgaaagtcgaaaatattttgacgaaaatgggcttaatgcacgaaggagaaagcctttatcacccagctcgcattagcttattacaccacgtttatgcagcattacgcgcccacaaactgtttgaagtgaatgttgattatatcgtgaaagatggcgagattgtgatcattgacgaacatactggtcgtacaatggctggtcgtcgttggtcagatggtttacaccaagcgattgaagcaaaagaaggggtaaatattcagggcgaaaaccaaactgttgcctctatcacttatcaaaactacttccgtctgtatgaaaaattagccggtatgacgggaactgcggacaccgaagcctttgagttccaacaaatctacggcttggatactgtggtgatcccaactaaccgtccgatgatccgtgacgataaaaccgatttaatgtttaagagcgaaccagagaaattccaagcggtaattaaggatattcaagattgtatcgctcgcaaacagcctgtgttagtcggtacaatttcaattgaaaaatcagaagcgctatcagaagcactaaaacaggcaggtattccgcataaagtattgaatgccaaattccacgcacaagaagcggaaatcgttgctgacgcaggttacccaggggctgttactattgccacgaatatggctggtcgtggtacggatattgtgcttggcggtaactggaaagctgaaattgcaaaattagaaaacccaacccaagagcaaattgacgagatcaaagctaaatggcaagaacgtcacgacattgtaatgcaagcgggtggtttacacattattggtacagaacgccacgaatctcgccgtatcgacaaccagttgcgtggtcgttcaggccgtcaaggtgaccctggttcatcacgtttctacctgtcattagatgatgccttaatgagaatttacctcaatgaaggtaagctcaatatgatgcgtaaagcctttaccgaagaaggcgaagcaatggaatcgaaattgctgactaaagtgattgcttcagctcaagcaaaagtagaagcatacaactttgacggacgtaaacagcttctacaatacgatgatgtcgcaaacgaacaacgtaaagcaatttacgagcaacgtaactacttacttgaaacggacgatatttcagtgatgatcaacactgtgcgtgaagatgtgtttaatgcggtcattgaccagtatattccaccacaatcgatcgaagaaatgtgggacgttccagcattagaaaaccgcttgaaacaagagtttggtatggaactgccgattgtaaaatggcttgaagcagaagatgatttacacgaagaaaccttgcgtgaacgtatcatcaacattgctaaagagcagtatcaagcgaaggaaacgatggtgggagcagaaataatgcgtagttttgaaaaaggtgtgatgctacagaaccttgatgaactttggaaagagcatttatctgcaatggactacttacgcaaagggattcacttacgcggttatgcccaaaaagatccgaagcaagagtataaaaaagagtcctttgcaatgtttaccgatatgctcgaccacttaaaatcaaacgtgatcagcgtattaagccgtatccaagtgcgtagccaagaagaagtagaacaagcagaacgtgaacgacaagctcacgctgaacaagagtcatctcactaccacgcagaaggtgaagagcaggatttcagcaatcttcatatcggacgcaacgagccttgcccttgtggttcaggtaagaaatataagcattgtcacggtagcaaagcgaaatatgcataattagcaagcggtcagataagtaaattattttacagatctgaccgcttggttttatacaaggaattattatgtctaaacctcttattcaagtttcagctggaattatccgcaatgaatttgggcaaatttacttaacacaacgtttagaaggacaagattttgctcagtcgctagaatttcctggcggtaaggtgtcgcaaggtgaaacacctgaggaagcactacgtcgcgaattagaagaagaaatcggtatttatgtgttaagtgcttttccgtatgaacatttcagtttcgagtatccaactaaagtgattgagttttttttctatttggtggaagagtgggtaggtgaaccttttggtcgggaagggcaagagggattttggattgctcaacaagatttagaagaaggacaatttccgcctgcaaataatacattgattaataggctgaaatttgaagccagctactcattagaaaaataataaaaactaacgatgtttttccatatgcttaaaatagcgacaagaaatagtagcattgtcgctattttattgttctatgccatgcaaaatatcgacctaggacaaaataactttaacatccttacctcagaatcgcagaagctatccgataaacccgatcaaattgttccaacccatttaggcgatgggtaatcatcagcaaggtttttcctttagtatgggataaaatctgttttagtatctgttgctctgtatctcgatctaatccttccgttgcttcatcaagtaagagaatatcggcagagctgagtaataggcgtgctaatcctaatcggcgttgttcgccaccagagagtgggcgcccgccttcgcctaaccataaatctaaaccttgttcttcgagaaggtagcttaaattgacttttgccagcgcttcagataaagcttcgtctgtggcttgtgggttgccaaagcgtaggttttcacgcagggtattgctgaaaatgtggacgcgttggctaagtacggcaatttgttggcgtaatgttttttcagggtaatctttaatattgcaaccatttaagaggatctcgccgcttgtgggatcgtaattgcgggtgagtagttggaaaattgttgattttccgctacccgttttacctaatatggcaatgcgttcacctttttttatctcaaatgaaatgtggttgagtacttgctcgtgctctggtgaataggaaaaacttacctgattaaagctaataagcggttggttagcctcggtttgtttccattgagctgtgccattaaattggactgtcggttgctgtgcggtaatttcactgatccgttctgccgcttcaatcacttgtcctagatgtaagaatgccattccgatcggcattaagatttcaagggaagcaagcacgcaaaagacaactaaggcgataagggcttcggggttgtctgcctgtggtacattaatggcggtcgctgataagtaaatcacggcagtgactaaaattccgttaataaacattaagagggcatttgacaaaccgcctaactggctttcgtggctttgtgccttgagccattgctgttctgtctgttttagtctgtctgtggcttttgacaatacaccaaatagtaaaaattcgccgttgagttggatccactcgataaactgtgagcggtaggtggctctggattgtatcgcgattttgcctaattttctgcctaaatggtaaaaaagtgtcgggaaaatcagtaataatgcaactaaagtgccacaaattacccacgctaatagaggcgaaacaaaagacaagcctatccccataaacagaataaccataatggcactgataaaaggggaaagtaggtttaaatagagtgtatcaagggtatcaacatctgcaacaaggcggttaagcaactcactgtggcgataacgatttaaccctgctgggctaaggggaataagtttgctaaacaccgcaatacgtaaattagccagtacacgaaatgtggcatcgtgcgtgactaggcgttcaaaataacgagaaatagtgcgaccgatagcaagtcctcttacccctgatgatggataaaagaaattaaaaagtaggcttgagccaactaaagcggacgctgctaaaaaccaccccgataaactgagcaagccgatactagccgtcaagctggtgatagccaaaatgatacctaatgttaaacgcccaaaatgagttttatacagggcaagaaaagggaaaagtgaacgcatagcttattgatttcctaataattctgcaaaaaagccttgtaaggcaagctcggtaaagtttccacgttggataatttgcccttgtttcattacccaaatttcatcagcttcttttaaatcttcaatacgatgggtaatcatcaatgtggtttgttctcggctgagattgtgcaatgcacttagcacctgttgttccgattgcatatcaaggctagcggtaggttcatcaagtaatagcagttgagatcggcgtaataaggctcgagcaatggcaatacgttgagcctgtccgcctgaaagcccgatattgccatcttggatttctcgatctaatcccaaacgatagacaaattcatcagcctttgacaaggcaagagcatttgttaaatcggtttcgttggcgtgttcattacctaatagaatattttctcgtagtgagcctcgcactagctgtggattttgtcctacccacgccaaagtcgcacgccattgagccatatcgagttctcttaactcaatgtcattaattttcacgctaccttgataagataagaaacctagcaacatattcatcaatgaactttttccagcaccactttgccccactaaggcaatatgttgatgagcctgtagttggaaatttagcggttctgttaatgctttgccctgtggcgagaggattacacaatcttgggcgtgaatttcaagcggttggtttggcacttttttttgcccggtggtttgagctaaaaccgtttcacttaaaaaatgctctaggctatccgctgccccgattgcagcggctttatcgtgataataaacccctaattcacgcaatggttgataaaattcaggggctaacatcaaacaaaaaaagccgataaagagggtaacagaagtattgtaagcaccaaaattgagttcacctaaataggtaaaaccaaaatagaccgccattaccgcaatagaaatggcggtaaaaaactctaataccgaagaagaaagaaatgccattttcagcacgtccattgtactttggcgaaattcttcggtacgttggtaaatttgctctgtctgtttgtcggcttgcccaaacaggcggatcgtttctagcccttttaagctatctaaaaactgtccactcaaacgagagagaataccgatatttctttgattagcttcggcagctttaataccagctaacgccataaacaacggcaacagcggcaaggtagcaaatagaattaagccagccgcccagttcaacggaaaaacagccgccaaaatagcaagcggtacgattaaggatagatattgctgtggcaagtagcgagcgtagaaattatggatattttctacttgttctaacattaacgttgcccagcttcctgcagggcgttgttggatcgacattggaccgatgtgagacaacttagccattacttgctcacgcaaatgaatacgcaacatttgcccagctttaaaaccagtccgctctcttaaccaaagcaatatcgctctgcctgcaaagcaagtcagtaataatccaagttgtgacagaaattctgtcggcgaacgatgctcgacaatcatctgatgtaacattgtggcgagtaaacccatttgtgcgattaataacattgcactgaatgagccgaataagacatttaaataaagccacttttttacaattttttgctgttggcgtagccatttttgtaattgtttttgacgttgtttttccacgagtgtccacttatatgtgcgtaaatgatgaaatttcaattaaattactgagatttttcaaaaccctgataatattcttcaagcaatttaaaattacaacaatattgttcaaagttatcttttttattaattgcttttgaataaactttagttgctttctcctttatttttctttgatttattgggttattgataaaaagcatttctttcatcaacaatgaagcatatttatgctcttcttcaaattctttagtaagatctatgtcttcaataacagtatctaaaacaggaaacatattgtttagtttaatacccgcaatagtttttttattatcgaaacccgttgtgattttaataacaaaacgcttatcaaatggtttcttattatttttagtattgggggctgatgataatggagcaaaataagaaatatggttaattgttaatacaacgccaacaaaaatacgtcttttatttttatccaattctttttcgggagaaatacgagtatcaatagagtgtaaaaattttgtatattcaggattaattctgcacaatttgagttgaagttcttgtttcatattgatattcctttataaacacaaaaaggcactaccgtgcctttttgttttatatcgcactttaatggtagcgttcaccacatatacatcgcactttaatggtagcgttcaccacatatacatcgcactttaatggtagcgttcaccaaatcaggatattaatcctatcgcctttgatggtataaattttctatataaaagtcaatctttatttggcgtgctaatttccattaaaaactaatcaaattcataccgatacatcaaatctaccgcttgattgatacttgacacccattgcaaatagaggcttggggcaaggcggtagcgtaaggttaattcggtaagaggggcgaaaagtcctacgccatattttactttgaatttcggtgttaaactaccactgacgacgacttttgtgttgtctccaatccctgcggtagtgacattgagatcgttgataccaaaggcactgcccacggtgccaacggttttactgctttttgataaactcattccaattaaggcggcagcaacggaattgcttgaatctgcatcgctaccgccgtctaatcctcgtccagttaaaatgtaggataatgcctgatcctgtgacattgacggggttgagaagattttgacttcgggggcatcagcaattcctgtgactttaacccctgcagttacattagcatcttccattgcttctggattgcggatcgcttcaatgtctagggttggctgggaagacaatccagtaaaggatataagccctttacgaattacgagatcttgtccaaaagaggcaaaggtgccgttttttaaatgaacttgtccatataaacctaatcctcgatttccttgttggactttgataatgccgtttagatctgttttaagaccataggcatctaattttacgtcgttaccaatgttaatagcgacatcagctttgattgccattccgttgttattttgaggcaagtttttattcagtaaagcggtagctttgttcttgttttttgctgatccgtccataatcacttcgtcgctactgatggtgacagcacttttaggtagttcttctacggcaattcttgcccaaggaatatcaatatttccgccaaggattaactcttttggcgtagcttttacttcaatatgtgggctgagatcaactttggcgatattaggaatatcaacacggaagcggttggcctgtgcttttattcgtgtatgccaagcctctagtttttgccaatttgcatcgccttcaagtaatagttggctttctttcgtttgaatattgccttttaaggttgaacttgcacctttaaagtttaaggcaagcattccacctgttacatcaaatggcattgatttagaatgcacttgtagccctgttaagtttaaattgcctagcagttgtggagatagagctgttccacccagtgttaaacgagcgttaatatccccattaactttttcatctgtgctaagtagcggttcgattaaacgtaaatttagctgatctatattgatgttgccagacagtcctcgctgtttggtaagttctttcatcagtagcttgctggttaaacgcccgttattttctatgcgaatatcgctatccaagctcaaattgttttctgcgattttgccatttaatttcaatgatgaaagggacagagggaaactgcgtccgttcagtttttgtgtaaatttaaggctatttgaaagtagctctacattaacttcgggatctttttggctaaaccaagccacatcacctttagcattgacgatacccgttaatatactctctttcggcaagtattcttgtagcatttcaaggttaaattgtttgatttcaaacgacactttcccctctttacccgcactaaatgtttgtgacaagcagagcgctgcttttggatttcgccaacaatgtgcggaaacatctgctttaagttcttgattgtgatagctaacttgtagatttttatcatttttccattcgccaacaggggtatggatattgagattacttagttcaccttgccattgttgtttgctacgatcaaactgccctgctaagtgaagctggatacccacaggctttcctttagcggtcagtttcaggctatgatttgcttcactagcatttgctgtaagattagcattctctagcgttatttcgccgtaagttaattgacgcaagcctatttcgagatcaccttgcacttgttgtgcggtgcttactttccctttggcattgagatgttgtagctgaaattgatcataggctacatgattagcgataagatcgagatctaaactaggttcattgatatttccctgtagcttaatttgtccgttgatattggcttttaagtgtgggattaaaccttgtaaattcggggctttaatggtggcattgaaatcagatttttcgcctaaaacaccttgcattacaatgcggttttcgccataaattaaacttgcttcagggatattgagtaaggtgttatgatctgctgtcaaggtgccttttaactgtaaatgcttttgctgtaagttgccgtgcaaatccatattgtctagcacaaccgcccattcattgcctgtttcacctcgcccaacaaagccttgagaacgaaattcccccgatagtaacgcaacccattcaggaaaaatggatttggtattgacattctgtaaggcaaggttggattgccattctaagccgtttgtccaatcgactttgccactgaatttggtttgcccttgtagtgcgttgagcaatgcttcattgactgcaaaataggttaattccccctgcccttttaggcttaaatctgcagggggaatgttcatacctttggcggataagctaccgtttaagtagtaattgagtagatcgccttttaaagcgaggtcgattttttcaaagacaagcggatctttacctttccctgcgataaaaggatagctgaatttcggacttttaatactgagatcaagcggtgttttaggttccgaaaattgcaaagtactgtgaatatttgcttcaaaagcaccgcttgttttgagatctaattttgcgatgccaaagagttccccagataaaatgagatctgcctgacttgcaggaattgcaagctcttttaaatgtggaatttgagcattgagtttccaatctaaaggataattacctgacaaggtgagtttgccaatccctgaaatagtgcctttgtcgctttgcaggttgagtttttgcaattccactgattgttcgtcagatttcgcttgcaactcaagcaaactgatttttaatagcgatttttcgcttatacctttagcggtcttaactttctgactcaactgcaattgttttgcttgaaattccagcacagagagattaacaggtaattgaataggatctaatttggttaagatcggctgtgcaagctgttgttttaaggcttcccaatctatcggctgagagggagtttcagcgactttttgaggcttttccgtagtttgctgtggtgcaagggaaacagttaaaccttgtaattgagttggggataatgaaaggctcttcccttttccttgaatgcccgattggaaatgctgtaagccaatattaagttcatcaacttgaaccttcacattgtctatgcttatctgttttaacgatacgccaattggaagattaaactcaccgcttgtttgtttggttggtgtggaagggggaagtttgctggtatcaagcgccacttgtgtgtctttgattgcaattttttccacgcaggcggaatatgccaataagcaactcaaatctaaatgtaattccgcttgtccaacttgaacattgaccccgttgagctgatacgcagtatccgtaagcgttaagccattttgtaggcttccctccactttgccaatcgaaagcggatctaaccatttatctgcaagggttaaagcggttctttgccccattcctgttgcaagaaaagctaaaggcaataaaagcaaaatcagtagcacacataaaccacgccataaccaacgccattttgtgttgtggggttttactgctgtatcattgggtgattgtgctaaagattgctctttttccataacattatctcactaaagttctgtgcctaagccaatgtagaattgtagcccttttttattatctggtgagcgtactggcattgccaggtcaaatttaactgccccgataggcgaagcccaacgtacaccaattcctgcccctgaatgtagggttttgctactgaattttttatcggataagcccgtatcgtaaaaggtcgctgcccaccaatctgggtacacttggtactgatactcaacggaacctgttgctaaatgcgatccccctgttagtttaccttggttatttttaggggaaatctttttgtaaccaaaacctcttacgctcatatccccccctgcaaaataacgtaaggaaggtggaatacgttcaaattccgctgattttaaatagccgacctctgctcttgcaacgatacgatgattatcaaaataggttcttacccacgccgttgaagccttaaaactgtaaaaactcacatctgatatgaaagctttatccccaaaattgatggtaactttctggctatccccccataaaggaaaacgtctgccatcagaacgagtgcgatttagagaggctgttgggtagagcaaaaaggtcttaaatttatcactgccctgcctaaaagcatcataacgggttttaaccccgaaggagaacgcccagcctgtttcgtggttccagaaacgctgaaaagcagaatatgcccctgtaaattgggtatcgttttgattttctcgatcaagcccacctgacacctgatagtagtaatgaagtggctgtgcttttacaggcattttgtaaccaaactccactctctgtttaggcttagataaatagctatttagctctaaactatgccctcgcccgtttatccaaggctttttccagttaaattgcaaacgaggaccaacatctgtggcatagccaatccccacttcaatatcatttttctttttaggtattaataatatgtctaaatccacctcttttgagggctgctttacacttggttcaactaaaacagatgaaaaccagctacttgaagaaaaatcgttcgatagtatcgataaatcgttcaaataataatagtcaccagacttaatacgcaatatattcgtgagatattcctctcgaatttgattgcctttaaaccctattttgccatagcggtaacgtttcccactatcatagcccaatcgccaatcggcaagatattccttcggatggacttctaaacggtgatacaaccactgcccatcaaaatagccgtttgtttgagagagtttttctatactgcttttaaaattgtcgtaggtttcgtgattaagcacggttcccattggcggaacctctttggctaataaccgtttaaaatcatcgtcttgctcggcttgtcctgtgagcttaatttcacgctcatctaatttaactggctgatccaattgtacatatagcgttaagagatctttgttagaagaagtacgaggggttagttcaaagcgatattgagtattgtaatatccctttgctcgtaaggctttatcgacagtttcttgtacaagctgttggtaacgttctgagctgtccgcatcatcgttgcttaactgcgagaggtaaatacgcacattttgatagagatctttatctttgatcccatcaacttcaagtaacactgtttgctctgcattcgctataccaattaaaactaataacgaacaaaaagataatcttgttttcatcgtgttattctacttaaattaacataaacctattcctgaggtatccctcttaataacggtactgcccgataaggtgctttagaggttaaagcaggttcaatctcaaacaacataataaatggtttaaccggttcgacattttccgttttccataaactactcaaactcgccagctgaatatccgcaggtaaatttgcaatccccagttcaagcacggcgatactgtgcttacgaggatgtccaatcataatcgcaataccgtgtttgcgagcatattgaacggcgtgttgaaattgccgttgtacatcagcaaacacatcactattatctaaaaaaatgtggcgttctaatgcatttaacccataagcttttgctgtttgataagccacactatcccctgcggttttactgtctaaaaaccccaacccttgctgtgataaggctttcatcaagtgttgcattgtcgttttatccgcagtcgctttactacccatatgattattcaaggcaatggcgtaaggtacttgctgttgagcctgatgaattaactcactcacctcgctttcccccattcccaccaataatgccccagcttcaataggctgtttcactttgggttgcataggtaaatggattaagatctctcgtccttgttctttcgctttatttgctcgggctgtggcataaggtgcagaaggaataatggcaacattgacctctttgggtaaggtataaatggcattatcttcttttattcgatagccaatatcatcaataacgatcaccaatttattcgcataagcaagcggtgcaaaaagcccgaaaatttgcaaaagcaacaaaataatagaccgcttgtttatccatttgttcattttactgtacccatttcaaaggattgatcgccacacctttacggcgaatttcaaaatagagagctgaacgactttgaccgccagagtttcctacactcgcaatcacctgccctgcttgaactcgctcacctttacgcacattgactgattgattatagccatacaacgacatatcgcctttaccgtgttcaatcacgactacctccccataaccttgcaaccaagttgctaaaatcactcgtccaccagctattgctctgactggtgtgcctgcacttgcttgaattaccacgccgttccatttaatttcacccatctgtgttgagccaaagcgattgatgattttcccagaaacaggcatacgatatttcccagataagccattacctgcccgaacttgctgtttttcagattccgttgcgctacgacgttcttccttattctttttctgttcaagtttcgcaatatcttgtttttcttgctgttcagactcattgcttgcttgtaccaactgatttcgcaacgcctcttcattcgctttcagattttctaaatgaccttgatcttgagctaaacttttatcaatagaacgcaatgtactttcacgttcatttttgactttctgcaaatctttctcttgcttcttctgtttattaagttgcgtctgttgccctttttgttgctcttttaactcatctcggcgagctttaagatccgcttgtgtgtgacgtaactcatagatcgcatcaatcctcacttgattgatatgctcataataagcccccattcgatctgcatttttggcttcttcggataacaatctctctaagactgaaggatgaatacccgaacgataggcagaatccaattgttccttaagcttctctttttgtaccgcttcctgcttttctaaccgcttgatctcttgttctgtacgtttaatcgatgcccttgtttcagacaaagtcatttctgtttgttttaaactattaaggactttccccatttcaatttcttgattttttaatgtcgattgcaaactatcacgttttttcttttgctcatcaattttgttttttaatgcctgacttttctgctgaattttagacaaatcaccagccatcgtttctgtaaacagcgttggaacagcatacactaaaacaatcagagcaaaatatttaattaatttcaaaagagatccttaattcagattaatataatgactagtggtatatctcaaccgcagatataccacttattctcactacaattttccttccatctgtgatttcactcgagcaacttcctcatctcgcaacacacggcgtaaaatcttacctacattgcttttcggtagctcatcacggaattcaatctctcgaggaattttatagcctgttaaatgttggcgacagtgattacgcagttcctcacgagttaggctttcatcttttttagtcacaaagaccttaatactttcacccgatacttcacttggaataccaaccacaaccacttcattcactttcggatgtaatgctacgacatcttcgatctcattaggatacacattaaaaccagatacaataatcatatcttttttacgatcaacaatgcgtaaattgaggtcttgtcccagctcaacaatatcacctgttgccatccagccatcttttagcacttctgcggtatcttcagggcattgccaataaccttgcattacttgagggccttttacccataactcgccacgctcacctatcggtaaatcattaccagcatcatcaacaatacgaatgtcggtatttggtactggcacaccaatagagcctgaatactccgtagaatcgttacgtgttgccgcaatcaatggggaacattcggtcataccataaccttcaataatgtggcaccccgttgtcttatgccaacgatccgccaccgcacgctgaattgctgcaccaccgcctacagagagcttcaagttagaaaaatcaacttctttcagttgaggattattcagtaacgcattaaacaaagtatttacccctgtaatcgccatcacaggatacttcttcaactctttcacaaaagctggaatatcacgagggttagtaattaacaaccccgttacaccgagttcgataaataataaacaattcactgtcaaagcaaaaacgtgatagagcggcagagcaattaccccaatctgctcttggcttcgttggattaaaggataggctacccattttgcttgaagaatattggcaatcacattgctatgacttagcattgcacctttagccactcctgttgttccgcctgtatattgaagaaacgccagatcatttttatagagcgttggtcttacatattgacgctgtttcccaatacttaacgcttcacgaaaactcactgcgtgtggcaatttatatttaggcaccaattttttcacatacttcacaacaaagttgaccagcgtacgcttaccaaaagagagctgatcgcccatacgggtcaaaataacgtgcttcacctgcgtattgaacaccactttttctaaggttgccgcaaagtttgacacgacgacaatcgccttagctccactatcattcaattgatgctctaattcacgcggtgtataaagcggattgacattcaccaccactaaccctgcacgcaacgcaccaaacaacgcaatcggatattgcaacaaattcggcatcatcaacgcaatgcgttcacctttctcaaggcgtaattcattttgcaaatatgcagcaaaagcacggctacgctcttccaatttacgaaatgtaagtacctgacccatattaatataagcaggaatatcagggtggcgttgtaccgccttttcaaacatctccaccaacgactcgtaaggctccacatctaaggtacgttcagcctctgctggataattatcaaaccaaattttttccattacatctcctttaaactttacccaaaaatacaggaataaactgagcctgagatttttgagcaatagctcttttaatcataaaaaaagtcactgctgtagtacacaacaccccagcagccacccataattcattgtaaagccattgcgataaaaccaatgttgataacacaatcacaaataatggcaccgcatataaccaaaaaacaccttctaacaaacttctctcggctaacccaattttcactttatcaccgacttgcaaaggcattgcaaccactaaatcaaattgcggtgcaaatttttcccccgccaatgcagaaagggcttttgaaccacaatggctttgagctacacaaccgccacaactagattttgcttggcattgcactctagcaattccattttgatactgaataacagtggcttgttcaatcatcattgttcttcaccttgtgaactaaactcaatctcttgcacaatatggcgtgccgatgccaacggaatttcgcccacaataatcacatctttatccccgattgtctggctgtaaacactggtttttccctcacgccaaaactgatcttgaaatgaaatccccttattttgcacaagatataccgtaaaagagaacagaccatcactatataatcgactttcgatctgctcatcttgagccaacacctcagacaaattttgttgtcctgaagccacctgcttaaatccattaggcacccattttagctgccattctaaaggttttagttccgaatgtactttagtttgcagtaacgttggtagaattaatgtacgaattggctctacaatgtacaataactgctcatctaccacagattgaattgtcctaaattgctctaacacattattatctcgatccaacaagtggctttgcagcaacagatgattttcctcatcgatccacaacatatattgataacggaaatcatcccttggcacaatccgaattacccttgcaatacgatctgccacacgacttttcccattatctaaaaacgcatagccctcaagctgagaaaaattactataaacaacggttgggaaatcatctaaaatatggggtgtttttaaactgaacggctgataatcaccaaaatacccaaccacatcttcccttaaaatcatctcttctcttgtggcatcaagatgtagtagttgagcgtactcttgtccgttatcataggcgtgtcgatagcgtaaagaggttacatcatcgcctttttgaaaaatgtaaagctgttcataatttaaggtttgatgagctttattcattgcagtcaaataagctaatggtgtggataatggctgagcaaatcctgttatggataaaaataaactaacaaataaggtaatatactttttcataaaacacctacaccatttctcacaagcggtaatattctgcggctttttagcattattacatttgcggaaaagtgcgaaatatattaccaaatataatactaaaattataatagtatgattactactataaaccccatgtcccaacattctcaacgctcatatcaatgaagattaaaacagcatagattcttgacacatcatatccctgcatcttgcaagcagagttttacggcacagagctgataaaaaatcctcttttacaccaaaagaggattttcctagtacaatgaattatttcttcgtcggacgttgccaaccttgaatatggcgttgtggcacacgggtaataaccagttcatcagccgccacatctttagtgatggttgaaccagccccaatggttgcaccgcttgcgacagtcacaggggcaactaactgagtatcagatccgacaaacacattatcaccaatgatagttttaaatttattagctccatcatagttacaagtaatagtgccagcgccaatattcacatttgcaccaatttcactgtcgccaatataggttaaatgccccacttttgaaccttcgccaatggtagattttttgatttccacaaagttaccaacgtgagcttttgctgccagctctgtacctggacgcaaacgtgcgaatgggccaacatcagcactttcgccgatcacactatcttctaagacagaataaggcttaatctcaacattatcacctagcacaacatttttcagcacactgccagccccaattttaacgttattgcctaactggatagagccttctaaaatcacattcacatcaataaccacatctttaccgtgcgttaccgtacctcgcaaatcaaaacgagcaggatcaatgatcgtcacaccagccaataacaatttttccgcttgtattttttggtaataacgctccagagcagcaagttgcaagcggttatttgccccttcaacttccattaaatttgttgcttgaacagcttcaactttgtaaccatcacgatttgccattgcaatcacatcagtaatgtaatactcgccttgagcattgttattatctaattgcgataaccattttttgaaactagcgccacttgcaaccattacccctgtattaatctcttggatctttaattgctcagggttagcatctttttgttccacaatcgcaactacggaaccattttcacggataatacgaccgtagcccgttgggttatccaataccactgttaataacgcaatcccattttcaggtttagctgcaatcaatttctctaaagttgtcgcagtaatcaaaggggcatcgccataaagcattaaaatgttttcatcatcggcaaaaaatggagcagcctgttgcattgcgtgtcctgtgcctaattgctccgcttgtaaaacccaatttactggctctacagataagcgttgttgtaataaatcaccgccgtgaccataaattaagtgaatttgttttgccgacagctgttttgctgtatcaatcacgtgttttatcatcggttttcctgcaatcgggtgcaagacttttggtaaatctgaatacatacgagtgcctttacctgctgctaaaatcacaacgcttagttgagtcatattaactccttaattaaaataactagaggatactgaaaacttttacattactaaaaccattctctttcaaataaagagcttgcaatttgctcatcacaccacgctggcaatagagcagataggttttcgattgatctaagttgccgaaatgattagagagtttatagaacggtagctctttgacttcaactccttcaaggctgaacggtttttcgtccacttcttcagggctacgaatatccaaaatcacatcgttttcgcctaattccgaagtggtttcgacagataccacctctttttccgtctgttgagcaatttcacgaatatctaaataatgggcgttttgtaccgcttgttcgagaacgtcaaagttgaagttgccttcttcttcgataattttactttcaatcgcttttactgttggattttttgaaatcacgccacaaaattccggcatcgatttggcaatatcatctgtgccaatctcttttgccattgcgatgatttgctctttatcgtgggtaatcagtggccgtaacactaaagtatcggaagccttgtcgatcaaacgtaagttggtcaaggtttggctagatacttgccctaatgcttcgcctgtgacaatagcttgaatatcaaaacgttcagcaattttgctggcagcacgcaccatcattcgttttaacaccacgcccatctgcccgttatcaactttttctaaaatctcgccgaccacattctcaaagttgatcgccacaaaacgcactttatgggacgagctgtaacggctccaaatatggtacgccatctgtttcacaccgattccgtgcgccgcaccgccaagattgaagaagcaataatgcacacgagaaccacggcgaattagcatataacttgatacgcctgagtcaaaaccgccagaaatcagcgatagcacatcttcctgtgtaccaatcggataaccgcctaaaccttcgtggcgagctttgattaacaacatcttatcctggtcaatatcaatacgcaccgttacatcagggttagtcaatttcacacttgccgactcgatatgctgatttaagccgccgcccacataacgttccacatcaagcgagcggaaatcgtgcttacctttacggcgaacacgcacgcagaaggttttaccctctaattccccttttactttcgcaagggtatgctcaaaaatatcatgcattgtggtaaacggcatttcttctacttcaagaatatgatgaatacctggggtgcgtttgagtaaatccaatacgagaggagcttcttcagcgacttttgctcgcacttcaataaaatcccagttgcgaattactgccacattttctgtttcacgcagtaaaacattacggatattggaggttaaaattttgataaagcgtttacgcacggaatcgcttttaatcataatttcagggaaaagtttgataataaatttcataacttacaatatttgtacctactttaaataatacttgcctattaattatttcagcattactacctctacctaatcacacatcacataagatgatcgaggaaagtaatgttatattccatagacataattaagcactataccaaacacttatttgttaattaacgataagaactctttgcgagtatctctgtcttgcaagaacacaccgccgaatgcagacgtcattgtttgactatgcgtatctttaacaccacgacatttcacacagaaatgggttgctttcacataaaccgccacatcttctgtttctaaaatggtttgaaatgccgttaaaatctgttcggtaaaacgttcttgaacctgtggacgttgcgcaaaaaactgcacaacacggttaatttttgataatccaataacccaatcttttgggtaatacgccacggccactttaccatcaattgtcacaaagtggtgttcacaggtgctggttaaggtaatatcatccactaaaaccatctcgctcactttcatctggtttttgattttggtgatttttggaaaggtttcataatctaaaccgctaaagatttcgtccacatacattttcgctaaacgatgcggcgtttcttctaaactgtcgtcgcgtaaatccaaacctaataattcaaggacagcacgcatatgttgctggatttcattacgacgagaatctttatctttctgatggcaaaccgttggggtttcaatcccttttgcaagaagtgcatcacgcacactttgggcttctggagagatgttgctcattgatgttcctctaaaaatttaggcgaaagattctaccaaattgccttaaaaatacaacgcaatccacaaaaatcgtgtagaatcgcaattacatcaaaaagagaataataaaatatgtattaccattttaatactcaacttgtcgccgatgaaaaacaatcttttgtgcagcaattactagattgcaaagatttcagccaatccgaccgcttgttaggttcatcaaaagggcgtggtacaacttggtttctcaacaccgaaaaaggactcggtgtaaatagcgtgcttcgtcattattatcgtggtgggttatttggcaagtttgtcaaagatcgttatttttttcaaagctatgaaaaaacacgagcaatgcaagaatttcgtttgcttgcccagctctctcaatggcaaattccagtgcctcggccgattgcaattagagtgaaacgtcaatgttgtttctatcaagcggatattttgttagaaaaaattgcagatacccaagatctgagccaatatctacaaacaaagagcttaacaccagcacaatatcagcagattgggcaactgattcgcctgctacacgatcatcaagttcatcactcagatctcaacattcataatattttgatcgacaatcaaggaatattttggctgattgattttgataaatgccaaatccagcaagggaatgaatggaagcaaggcaatttggatcggctattgcgatcttttaataaagagaaaggaagattatctatccatttttacccacaagactgggaaatcctataccagagctatatgaacaactaaaacactcactttgacgtcccccatacccaaaaggacagggacgtcaacatagttctcccaaataagacttccccttgcaaacgctagacgttttccatacttaaaaaccaaaataatattgaaaaattgcgtaaaactcaccgcttgtaaatcacttttatgctactattcccaccaattttattttttaagatgtaactccaatggcaaccaaatcaaaatatcaagataaacaaattgaagcactattaaacgatcttattgtaacccttgaaaaacacaaagccccagtcgatctctcgttaatggctttggggaatatggtaacgaacattttagtcaccaacgtgcaaagcccacagcaacgtgaagtgcttgctgaggcatttagctctgccttaaaaaactcattaaaatcggcgaaataatatgttaaatcaacttcgccaccttcttcctgaaaattctcggcaatatcgagaagagatctcacaacgtattagttggggtcactggtttgcgttatttaatatcgttgtgacgttgctgatttcctctcgctatgcctttaatgccgactggccaaacacccttttcggcaagctctatttttttattagcttatttgggcattttagctttgtcgtctttgcactatatctgctgttgctctttcctctgagctttctgattaaaaataaccgtgctttccgtagtatttcagtgatatttgcgactatcggaatgacgatcctattagttgataccgaagtctttaagcgtttttacctccatttgtcaccgcttgtttgggagctgttagtcaatcctaacgacgacggcgaactgacacgccaatggcaattgctttttgtgccaatgccactcattttattagcagaaatgctttactctcgttggtgttggaataagctccgtagtttcaaccgccagaagtggggaaaatatgttgcaatgctgtttctagcttgcttcacagctacccatttactctatgcgtgggcggatatgaccctatatcgcccgattaccgcccaaaaagcaaactatccgctttcctacccaatgacggcacgcagtttccttgaaaaacacggacttatcgaccgtgcagtattagaacagcagatcgaagaaagcggtcggttagacaccttttatctcaactacccgcgcaaagccttgcaatttgttgaaccacagcataagcctaatgtacttttcattaatctctctggcttaaaaaatgaagcgattaccgcagaaacaatgccatcgctttaccaagtcagccaaaatgctcgccgttttacccaacattacaacagcagtgatagcctaagcggtagcatcgttggactattttacggattaagtggacgctatttagacgcaattttgaacgaaaaagccccttcgctactgatcgctcgtttacaacagctaaactaccaatttgggctattttcacacaacggctttgcagaaccgatttaccacagagccttatttgcccatttcaaattacctaaaacaaaaagcaatcttgaagccattgagaaatggaaaaactggatcggcaaacgtagcgacaaagcattttttagctatctagatctacaacttccttcaggcatagactatgcccaacaaagcaaaaatttagattggcagttcaatgatatttggcaaacccttgaacaacaaggcttaacccaaagtactttaattgtgattacctctgatattgctgaacaagcggtcactagcgacaacagttttgcacaagctcggatccaagtaccaatgcttatctactggcaaggtgataaccgcacctatagcttaccttctagccatttagacatagctccaacactgttaagccagttcttcggggtaacatcgccaattagcgattatgcacaaggtattgatttaacgaaagaaaatagccgaaaatggcttctagcctcaaactataaatggaatgtagcgataatgccaaatggtgagcaatttcatatcaaccgtaaaggcgattttgaacattttgatctacaaggcgaaaaacagactagccgtccgccactcgccctgtttttacaacttattcaacaaagtaatctatttattgaaaaataaatcaaagggctaagtatcgtattccaccagacttagccctctacctttatctatgtctttctatccacttgccatcaaggtaatccacaatccatttggttgccttgccgtttttctcagaggtcacatactgacgcttttctttacggctaaaacggataatggcttcattgccttcagggtcttgttgtggtgcgtctgcaaggtattgcagtttttcaggcaaacgatcacggtataaggctaattctgccactttcggggcacgtgtttcacgggatttcgggaagttgtgagccgacataaacacaccgcttgccccatctcgtagcacaaaataagcgtccgatttttcgcattttaactctgggaatgccactggttcttctcgtgggggggcgacttcgccatttttgagaattttgcgagtgttgtcacagttggtacagcccatatatttgccgaaacgtccaagttttaagtgcatatccgaaccgcatttgtcacattcgacaatcgggccgtcataccctttaattttgaaagagccttcttcaatcacatagccgtcgcagttcgggttatttccgcaaatatgaattttacgttgtggatcgatcacatagctatccattgccgtatcacatttcgggcaacgtttgcgtttcattaatgcgttcgtttccgaatcttcgtctaacacattcagcaattccgcctctggaattaagttgatagtagttttgcaacgctctttgggtgacaaagcatagcctgtacagcctaagaacacaccagtacttgcggtgcggatcgccatttggcgttggcaagtcgggcagtgaatgtctgttgccactagattattcgaacgcattccgccttccagttcatcaagctctgcagtggttaatttttctgagaaatcggcaaagaagcggtttaattcgactttccagttgctattgcccgacgcaatttggtcaagggtatcttccatatttgccgtaaaatcgtagttcattaaatcgctaaaggcttcgtttaagcgatctgtcacgatttcacccattttctctgcatagaaacggcggttttctactcgcacatagccacgctcttgaatggtcgaaataatggcggcataggttgatggacgaccgatcccacgtttttccaactctttcaccaacgccgcttcgctataacgtgctggcggtttggtaaagtgttggctaggttcaacggcgttcagtttcaaggtttcattcaaactaacttctggcaaggcttgatcttccgctgttttgccttgaattggcagtacttttgtccaaccgtcaaaacgtaatacacgccctttggttttgagttcgtaatcccctgctgttaccgttaaactagttgagtcatattccgttggagtcatttggcaagcaaggaattgtcgccaaatcaagtcatataggcgttctgcatctttttccataccgcttagatcttgcattttcaccatcacatcagacggacgaatggcttcgtgagcctcttgcgctttctctttgctggcataaaaattcggtttttcaggtaaataacgctcaccaaattgtttttcgatatagctacgagccatcgtcaatgcatcttggctcaagttagttgagtcggtacgcatataggtgatgtagcctgcttcatatagacgctgtgccaacatcatcgttttcttcacgctaaagcctaaacgggtacttgccgtctgttgtaaggtggaagtgataaacggggcttttgctctcgatgaagtcggctttttatcaatttcagtgacgataaatgcagaattttgcaaagattttaccgcttgttctgcttctttttggtttttcgctgagaattttttgcctttatgctgtacaagttctaaagcgagatcgccttttttcgcagacgttttagctaaaatatcccaaaactcttcaggctggaacgctttgatttcacgttcacgctcaaccaataatttcaccgccacagactgcacacgcccagccgataagccacgagccacttttttccagagcaacggcgacaccataaagcccaccacacgatctaagaaacgacgtgtttgttgagcatttactctatccatattgagctgttcaggcttttcaaaggcttgtttgatcgcatttttagtaatttcattgaatacgacacggctaaaacgctcgttctcaccgccaatcacctcacgcaaatgccacgcaatcgcctccccttctctatccaagtcggtggcgagatagatatgatcggctttcttagcaagggatttcagctctgaaaccactttttctttacctggtaaaatttggtaagttgcattccagtcgtgataaggatccacgcccatacgcttcactaaagcggtacgttctttctctgattttactaaggctttttgttctgccgtcatacctttagtcgaaaccgctttggccttttcggttttttcttctttttccgcaccgcttgttggtaaatcacggatatgcccgacacttgatttcaccacaaagtcactgcctagatatttattaattgttttagctttagctggcgactcgacaattactaatgattttcccattgagaatacctaaattaaataataatataaataatattgaaattatttcttaaaagtaaatattaaaattgaattgcatcaaaatttttgtaacaatagcaagcatttccctaaaagacaatatcaagctaacatctatggataaactcaaggcaataaacctattttgtaaagtcattgaaacccaaagttttacccaagcggcacagcaagaacagatttctcttgcgatggcgagtaaactggttgctcaattagaagaacacctcaacgttcgcttattacaacgtaccacacgccgtatcagcccaacggaagcaggtttgcttttttatcaacgctgccagcccattttaaacgaactcaaagacgctgaagcctgtgtaacgaacattacctcaacactacaagggaagctcacaatgtcgttgccgatggattttggctctcgttttgttgctccacatttacaccgttttaccgaaacctatccacatctgcaactgaatttggaatttagcgaccgtcgtgttgatgtcgtggctgagggttatgatcttgttttgcgtatcggtaagctcgaagatagttctatcgtggcaaaacggatcgcacaagcacaacatctgatcgtggcttcccctcgctattttgaaaaatttggcacgccacaaaccgctttggaattacagcaacatcaatgtttgctctatgaaagccaaactttatggcaatttaatgaaaacggtcatcaaattaaattaaaaccccaaagccaagtttatagcaacaatggctatgcgttggtgcaaatggcaagagcaggacacgggatcattaatatccctaaatttttacttaaagatgagcttgcctctggtgaactgataccgattttgccccatcttgagcaagagttattagatattagtttactctacccaaatcgccgttatctttcccctaaagttaaggtgacgattgaattttttagtcagcttatgcaagagcagaaaatacacctctaacagacttaaccagcaccatcctattaaaaatcacacaaagaatcaaaggctgccatcaatacacttgaaggcagcctttattattaatatttactcagatatttaatatcttaccactgtaatgcaatacctgcaccagcattgtatttgccttgcgaagttgcacctgcagaaactttaagaatcacacgaccattatcagacattcttgagaatccaacagcaactgcattttgtccctcgaaagtaccaataccagcacccaatgtgcttttacctggtaaagtcacttgtggaatattgctcatagccgttgttgcagcaatacccgcacgaagttgacgcccttctctctctaacttcgcacccaatctatgtgcaacattatacaactggctaccattaatcgcatcggtactttgctcagagattaaaccaggtgcaacgttttgaatacgacgagtttccattttgccatcactgtctacattacccacgctcaccacgcctacaacttcagttgctttaccgccggcataagcgttatacacaccacctattacttggtattctaaagcacccgctcccgcagtggttgcacctgctgccacatagcctgagtttgttcccaagaataccgagttgttggttgtattggtaatcttgttacccaatgcaaagacattttcgttctcaatcgtattattgttacccacagaataagagttatcagcattaatcacacttgggtcaccaaatgcaccggagttattgccgttcactacgttacccgtaccgatagagatagattggttgcccacagccttagcattatcaccaatagctatcgatttttcgcctgaagcaattgcaacgttaccaatagccaccgattgtatgccagctaatgtactgttaccaaatgcgaccgctctatcccctttcgcgtgagctttgtaaccaactgcagtagagtatgaacctgttgcacgagactccactgtattcgacttatggttaatttgctcctctgcattatgaccatcattggtgtggaagaacctgatacgattggttaaaacataaacttggcgaccattcactgcatcagtactatttggtgaaatatcaccatcagcaataccactcagtttcacacgaggatcaactttctctttatatttctggagattgccattctcatcaagaataggttgtttagtcactgggtcccatttaacaaactcttcctcgactttctctcctgcaccagtaaggttgattgtattcttatcaccagtcattgtcgcagtgtctaaagtcacagaatttaagttcgttaaatccttgttcattttcacaacaagtttgttatctgcctcttgtgcttccacataaaggttattagccgctgagtccttaccattccatttgccttcaccctcaacggttaacttcgtacccaatggacgatgtacagtggtatcggcgttgttacccgtcaagtctaagcccgcttgtgcaatggcttgtaagtcttttactgtcgctacattatttaacgcattacccgtttgagccaataagccgcctttaccgtctttgttatcaccagcaatagctttttgtgcatctgtaggggtaagtgccgttttatttgattcagcatcatctttcaaacctaaaccacttcccacattttctccttttggaccagctggccccattggacccgcaggtccttgtggtcctgctggaccctgcggtccttgtggtcctgctggacccgcaggtccttgtggtcccgttggacccgcaggccccgttggacccgtaggtccttgtggtcctgctggacccgttggacccgcaggtccttgtgatcccgttggactcgcagggccttgtgatcccgttggactcgcaggtccttgtggtcccgttggccccgtaggtccttgtggtcccgttggacccgcagggcctggtggtcctgctggacccgtatcacctttgtcacccttagcccctgctggacccgcaggtcctggaagaccttgttcacctttaggacccggttcacccttaggtcccgctggacccgcagggccagtttcacctttctctcccctagcacctggagctccatcatttccttttggaccttgtatgccctgagcacccgctggacctgccggacccctcggacctgttggaccagcttcgccttttggtcctggatcaccattatcgcccttaggtccttttggaccttgtggtcctgttgctccagctggacctgcaggaccagttttaccttgtggtccagctggacctactggacctgctggacctgcagggccagtttcgccacgatctcctttttcacctttctcgataatgctatgcgaattatctgtataggtaatttttagattgccatctggtcctttttccgcactttgaattaacttacccatagcggcaatcttatcaattttatctttgaggtctttatctaatttaaccgtaatcgtaccgccattaacatcggaagtaataccattttgtccttttacagtgagcttaccttcccaaatgcctaccttgccactgctgttgttatcgccttctatttgcatggtgagcgatttaagctgcgccacgtttactgcatcggttaattctttacctgccgcaacgttggtgatttggcgtttgatgagtttattacctgctaaaccgacagaaactgcaccaatcttattaccatcaaccttttctgtggatttaaagccgttagcttcagtgcttgttcccgttgtgacagaatgattttgttttaacccctctacaccgccagctgtacttgcattagaaccataacctaatgccacaccgccacccacggtgacaacggtattattaccaagtgcggttgctctagcagcactaccatttgttttggctctttcacccacagcaacagagctcctaccaccagcagaggccatataacccaaggcagtagcatgattttcagcacttgctaggcttccaactgccactaagttttgacctgtcacattgatatgggcacccacaacaacagaagatgcccctgctgttgtcgcagacttacctatcgcaatggaatctgtcccaacacctttcgagccccaaccaagagcaacggcgtattttccagtagcagttgcactaccaccaaccgcaataccgtactcatcggtagacttactattcgcaccgatagcaatgccttcatctttacttgcagatgctaaagcacctaaaacaatagatccttcgcccttagccaaagaaccacccccaatagcaatagaggctccaccactcgcagttgttatttttgttttttgggattggacttgggttgtatcatcaggttgatatttcgttgtttttaaatcatctccaccgattgatatggagccatacccatccgctttggcatttgccccgataacaatagattttgccttacttgcagtagcagagtgacctattacaactgcgtgattaatcttttccgcactggcttgtctgcctaagacaacagatccctctcccgcttttgaagcactcccgatggcaactgcttccttcccatctattttaatattgttgcctaccgcaacagagttgtcctttgttcctgcatttgaatcataacctatcgcaatattatgcctaccttcagcttttgaatactgaccgatagcaatagcaccatacgaagccttactctctttaccaataccaatagtaccgttgtcatatcctttactcgatttatcagcaccatctacaagatatggtgttgcggtatttgttgcgttagcagcagctgatggactaaaaaatatacctagtaatactagacttaaaagacttaatttaaatttatcttgctgtttatctaaaaaataatctgaggtgcatacttgagctcttttatccgtgtaagcggatgttttggtgtgagactttactaactcagacacaaccacccaagcctgttgagcatgactccaaataactctaaatattttattcataataatcttctctactgtttttcctaataaaaaatcataaacctttatttacattttcaggatgcacaaatacccccatcgccctcgctttcgctcgggcacttcccccgcaagcgggggaagttaactccttgacaaaccatatattagatggattgaatattgtagggtgggttttaacccaccaataaaatcaatatgttacggctacatggtgggtcaagacccaccctacaagctgttttcctaataaaacatcgtaaacctttatttacattttcaggatgcacaaatggtccccgcacgctattgttaaaaaaaaaaaaaaaaaaacaaagagttacacaaaactaaagataaaataacaagaatttttcaacttttatcaataaaagctagaaataataggcggaaatctaataagtgctaaagtcatttagacaatatattgattctgaatggatttttattgatagcagtgtcatcaaagctcaccagcatgcaacaggtgcaagcggtcaaaatccgcaagcgattggcaaaagtgtggcgggtaatagcacaaaaattcatttagcagtagatagttgtggaaatcctattgattttgttctgacgggggggactttgaatttacataaactgacacttttttccactcttaaaggataccagtaatgtcatttatctaaggtaagaagctgtgggtaaattaaaaggcgggtgagctgaataatcgactatttttattcgatcactaaaacgctgataatgcagcacatattcagacgttctatcgccaaaaggtttacttaaatcaaaggcaaggataccaatgtggtaatgccatagatgattttctcgcgcatattttactttttgagcaaagtgcggatcgtttttatgcacgttgtcggaagatttattcctgccttcaaggttggtaaagccaaaattttgaatatgctcaacgaattcaacgatcgcatcttggtcttttactggaaaattggcaaattctttacgaaaaagtgagccatattcaattgtcaagttagccattaagtaaccactccttaattgcttttgcacttgttaagtccgaaggcatttcaatagtttcactttcaacgtgtgctttcattctttctagatcgtagttaaatgcaggctcttccaccttatcggcaatttgtttttctacgttttgaacgtaagaaattagtgcttgtttttccattcctgattgaattgcttgcacaatacacgccatttgttgatgaaagtaatccgattgaatataaatttgagccatattacctccaatgctgaatagggttgcatttattctaacagaaatttttgttggaagaataaaaaataacggcataacgagaaatcattatgccgttaaatttgtaggggcaaatgacatttgccctaatatcaatagattaaatcgaacgtttaatctcaaccacttcgaatacctcgatttggtcgccgacttttacatcattgtagtttttcacgccgataccacattccataccgttacggacttctgaaacgtcgtctttgaaacgacggagagattctaactcgccttcaaaaattacgacgttatcacgtaatacacggattgggttgttacgtttgacgataccttcagtgaccatacaacctgcaattgcaccgaatttcgggtgacggaagacatcacgcacttctgccaagccgatgatttcttgtttaaattcaggttgtaacataccgctcattgctgctttgatttcgtttaatagctcataaatgattgaataataacgtaaatcaatgttttcgctttcgataatgcgacgtgctgaggcatctgcacggacgttaaagccaagtacaatagcgttagacgctgccgctaaggttgcatcggtttccgtaataccacctacgccagagccaaccactttcacttttacttctgccgttgaaagctcgtgtaaagattgaacaatcgcttctacagagccttgtacgtctgctttcacaatcacgttcaattctgcaacatcgccttccgccatattgctaaacatattttcaagtttcgctttttgttggcgagccaatttcacatcacggaatttaccttgacggtataacgccacttcacgcgcttttttctcatcacgcaccactgtcgcttcatcacctgcggctggtacgcctgaaagtcctaatacttccacaggaattgatggaccagctgattcaatgtctttaccattttcatcacgcattgcacgaacacggccatattcaaagccacaaagtacgatgtcgcctttgtttaacgtacctgattgaacaaggatagttgcaactgggccacgacctttatcgaggtaagattcgataaccacaccgcttgccataccctcttttaccgcacttaattctaatacttccgattgaagaagaatggcttcaagtaagtcgtcaatccccattccttttttcgctgagacaggaacaaattgaacatcaccaccgaatttctcagaaatcacttcgtgttgtaataactcttgctctacacgctctgggtttgcttctggtttatcaattttgtttaccgcaaccacgatcggcgcaccagctgctttcgcgtgttggattgcttcaatggtttgtggcattacgccatcgtcagctgctactacaagaacaacgatatccgttgctttcgcaccacgtgcacgcattgaggtaaatgccgcgtgtcctggtgtatctaagaaggtaatcatcttaccgtcgtcggtttcaacgtgatatgcaccgatatgctgagtaataccaccagcttcacctgctgctactttcgctttacggatatagtctaataatgaggttttaccgtggtcaacgtgtcccataatggtcacaactggcgctcgggttactttttctgcgtgtaagtcacgatcttctaagatcgcttcttctaactcattttctttacgcagaataactttgtgtcccatttcctctgcaacaagctgtgcagtttcttggtcaatcacttggttaatggtcaccatttcgcccattttcatcattgttttgatgatttcggtcgcttttactgccattttgttcgcaagttctgccacagtaatagtttcaccgatcaccacatcacgcgtaactgcttgagctggcttagtgaaggcttgttgtaatgcactgcctttcttcgcgtgtttacccttgcctttggtatctttttggttacggcggtcagattgacgttcatttttactgccgttttcatcatcacgtccgccttttttggttttcgctacaccgcctttgccacgtccacgattgccttcactacgacgctcagagtcacgttctgcttctaacgcatatttagaagtaaagcggtcatcttcatagtcttcgccattttcaatcgcttcttcacgggcaatttctgctaaacgacgagcattttctgctaaacggcgagcattttctgctgcacgttttgcgtccatttccgctttttggcgagccacttcttcttgcttacgacgcaattcagcttcttctttacgttttgcctctttttcaggatcaaccgctttttcttgttttggttgagcttctgcttttggttgcgctggttttggttgtttatttggcattacaggcacttgatgtaccgctttttttgcttcttcggctttggcagcttctgcttttttagcctcttctttcgctttagcttccgcttcttgtttcgatttcagtgcttcttcttgggcttttttagctgcttcagtatccactttgcgagatttacgcacttccacttgcacttcttttgctttaccgcctgcagtcgtaccgctcacggttgttttagtacgacgctgtaaacttaatttcttcggtgcgtctgttttgatttcattttcactcattctttctctccctgtttttagctaaaccagcaaatttgacgagcagccataattaattctgcggctttttctgcggttaattcttcaatatcagctaaatcatcaacactttgctctgcaaggtcttcaagagtggtaatctgtttttctgctaatttgaatgcgatatggcgatccataccttcaagatttaacaatttatcttcaatatgtgcctgttttaatgcttcttcttccgctaacgctttagctgtgatcgcatttttagcacgcacttgaagttcttcaactagatcttcatcttctaagccatcaattgctgtcagttccttaactggtacataagcaatttcttctaatgaggtaaagccttcttcaattaaaagatgagcaaattcttcatcaatttctaaagcgtccataaagagattaatcactttattgtcttctgcttgatgttttttttctaactcatcggttgtcatcacatttaatgtccaacctgttaattgggtggctaaacgtacattttgaccattacgaccgatagcttgtgcaagcgcgtttgcttcaacagcaatatccattgagtgattgtcttcatcaacaacgattgagctaacatcagcaggtgccattgcgttaatcaaaaattgtgctgggttgtcgtcccacaacacgatatctacacgctcaccgccaagttcgttagtaattgcctgtacacgcgcaccacgcataccgacgcaagcacctactggatcgatacgtttatcattgcttttcacggcaattttggcgcgagagcctggatcacgagaagcccctttgatttcaatcacttcttcaccgatttcaggtacttcaagtttgaataactcttgtaacatcactggttttgcacgagtaacgaatagttgaggaccttttgactcgggcttaattgcataaagtacaccacgcactcggtcacctgggcggaagttttcacgcggtaacatatcttcacgcataatcaccgcttcagctttagtggtatcgtcctttttacctgcaagctcaagaataatactttcacgacttactttttttacagtaccgataacaattttgccttcttctgaacggaattgttcaatcactttgttacgttccgcttcacgaattttcgtggtgatcacttggcgagcggtttgcattgttatacggtcgaatgcgatagactcaatctcatcttcaacatagtcacctaattgaatgttcgggtcttcaaattgagccgcttctaaggtaatttcacgtgtgtggtagtgcactttttcaaccactaaccaacgacggtaggtggtaaattcaccggttttacgatcaatcacaacacgcacatcgatatcaatgccgttgcccgttttacgatcttcacgttctgcagccgctttctttttcgttgaaatggctaatgctgtttcaagtgcctcaaaaatggcatcttttggtaataatttttcattggataccgcttctgcggctaataaaatctctttactcattggttttgatttccttagaaattaaaaacggggattaaatttgctttttgaatgttgccaaaggcaaaagcctgtaaattaccatcaacttttaaggtaattaaatcaccttcaacactcactaattcaccttgccatttacggcgatctaacattggaatgcgtaaatgaacaacaatttcacgcccaacaaagcgttgatagtgggctaatgtaaataatggacgatctaacccaggggaagatacttctaggttatatttatccgcaatcggatcttccacatcaaaaatcgcactcacttgacggctaacatcgctacaatcatcaaccgtaacaccgccttctttatcaatatataagcgtacagttaaaaaacgacctgcacgttggcactcaacgccgacaagttcaaatcccattgcatcaatgggatcggcgacaagctcttgtaatttttgttctaatgttgccaaggaaacctccatttgacagatataaaaaaaggacttgaaaaagtccctttaacacaacaaagctgactatgtagccacaaaaaagcctcaaactacaacagttgaggcttcaagcggtttgttttatctaacattttacaatttcaaatgcctagatagaacaaaactcatcgtcttaaccaaaacaatgagccttaaaactggttgcgggagccggatttgaaccgacgaccttcgggttatgagcccgacgagctaccaagctgctccaccccgcgtctgatgtggtgcattataggggataaaaaaatccgtgcaactcttttttttagaaattaagaatgaatgctagatttttagtcaaaatatgcttaagcattatctttcaacaaaaacacccctttattttttatttctatataacaatttctttgggattcatcataatcttctgggttaaggttaatcattaatgttttcccttgccaaagtgcggtaatttcccaatggtttcccatatagacagcctgcttaatttcacaatattgagctgcagttccatcacttaataagcggatactttctggtcgtaatccgacaagacaatccccatcaggtacttgaaaacgtgctgcattttcaagggtaaaagaaaactcaccgatattaatttgattgccttgtcgttttcctgaaaaaatggttgattcccccataaaatgagcaacaaagagagagtttggctgtaaatagaggtttttagccgtatctttttgcataatgctaccctgatccatcacaatcacttcatcagacactgcaaaagcttcactttgatcgtgagtaacatagagtgaagtaatattgagccgttgttgtaactcgcggattttttctcgcattgaacggcgtaaattcgcatctagactacttagaggttcatcaaataagagaactttaggcttgagaattaatgctcttgctaatgccactcgttgttgctgtccgcctgaaatttgatcgacatagcgatcttcaaaccctatcagatcgactaactctaatgcttcttttactcgctgttttcgctcttctttggataccccctgcatttttagcccatattccacattttcaccaatcgacatatgtgggaaaagtgcgtaagactgaaatacgatacaaatatctcgctgttgcgttgcgttgtgggtaacatcttcgccgtcaataaaaatttgtcctgctgtggggctttctaaacctgcaactaaacgtaacacagtggttttgccacagccagaagggccgagtaacgtgaccattgtgccttgtttaattgaaaagtttaagttatctataaccctatgtttaccaaaagatttgctgatatttttcaacacgagaaaatcatttttttgttccatttttctctccaaattcatctttttgctttgaacgggctatctgcgtatcgccaacaagccaatcaaataagaaaatcattgccagcataactacaatcaacattgagccataggcaatcgccattccatattccccatcctctactcgatttaaaatatatgaggttgcgacgcgtgtgtctgctgtaactaaaaagatgatcgcactgactgttgtcattgatctaacaaaactagtaactaaggcagaaagtaacgccggttttaaaagcggtaaagcgacaaagcagattgtttttaatgttccagctttcagtgagagcgaggcttcatctaaggctttatctaactgtcttaatccagcaatagccgccctcattcctactggcatattccgcatcaccatagacaaaataataataagctctgttcctgtcaggtaaataggttgatggttaaaagccagaatataggataccccagccactgttcctggtacggcaaaacaaagtaacgtcagaaattctaaggtttttttccctttaaaatcacggcgaacggtaatgtaagcgatcaacaaaccaaaaatagccgtaatcggggcggcactagcagcaaaaataaccgtttggattaaagatggccacgctccactattaaacccttgtccaaaaagattgaggtagttattgaatgtcagtgtgtggtctattccccaacttacggtaaagctaccgtaaaaaatactaccgtatagtacaaagttaaacagaacccaaaaacctaaagtgcaaataattgcccatttcataccgcttggtaatgcttgtacatcacctcgataagatttacctgatacggtgatataagatcgattgccaatccagagatattgcaccacaaaaatcgtaagggaaaagagtaacaagatcacacctaaggtgcttgccgaagcataatctaactgtgaaccagcaatatagaaatagatttgagtggcaataacgtcaaaacttccacctaaaactaaaggggtgctaaagtctgcaagcgattggatcaccacaactaaaaacgagttggctaacgctggcttgagtaatggaaaaataatatagaagaaggcttgatagcggttagatcgtaaagtataagcggcttcctcaacagatgggtgaatagattttaatgcaccgtctaaaatcataaaagacattggggtcagtgcgagggtatgggcaatcactatccctgtaaaaccataaagccagttattactaaagccaagatgatcgactaaaaaagcagtcacatagcccgaacgtcctaacataagggtgacacctaagccaacaacaaatggcggtgttacaatgggtaagatagagaaaatttttccaataaacgccgtgcgttttgcaatccgtgtggtataaagagcaaaggctaaaccaaacaacgtagatacaatcccaacggttgtcgcaacacttaatgaattaccaatcactcttaatacataaggctgttgtaagatagacaacacttgacttggtacaaattcactgccgtcgtaaaacattgagatgaaaattgccagtgttggatagaccataaagaaaaagatcaacaaaataatgctaatcaatgaggcaataataaatctgtcaccctgcattatttttaattcagcaagggcatttgtcgctaacgcaatcaacgcaacaattaagaaaaaaaccgcataacctaagctgatttttgctaaaattgcagaaagaaagataaagagaaacagcccaactgccccgaataactcacatttacttcgtaatgttgaaggtgttttgttcggatacagataaagcagtaggggaaaaaaccatatccaagtaaggttaatatcattccaccccatagcctgttgaaattcggctgaagttgcttcaaacagtccatattgcaatgcttttactgggaaaaagcaaaagcctaaaaaagcaaaaataacccaagtcaatgaatgacgaaaaaaaaatgtttgcataaccctctataacatctattccacaatctttcatcattctactattaaacaaaatgatagaatagttaaattataattcagcgccaactaaagaataatcaacccgatcttcaaaaaaagatcgggtttgagtgtcatactttaagaacgcccagcaaaaaaagcgaatcgttctaaaatagaaccattctagctcaaaaaaaacaatcaagtttccaaataaaaaaatattagctgagaaatagtagaccagctaaaaagataacaaggaatttacccccccaaactcttccgtcaatttttctgtaaacagacgtaattcttccgtcattaacagaaaatccgcatcgaaacgttgggctttgtcttctttcaaaatatcatcgttcttttcacgcacttcatcggcaaatttgacacgggcaagagtggcatcttcgttcaacacaaaagaaaaatgattttcccaatctaacgcaagttttgtgacaaatttacccgcttgtaaatgttggctaatttcgtcgctttctaaatcttggcgtttacaacggattacgctgtcggtatcaaaagattttaattctgcttcttccagaagtgtcagccagcttggtgtatgcccttttgccacccaatttgtcatcacttcgctcggctgtagcgtgaaggaaatcggcacaacaggcagagagccaagggatttgcgtaataaagcaagggtgtcttcggcacgttttaccgagccactatctacataaacgagctgtttatctaagtctaaccaaatcgccgtaaattggtgtttactaaacgcacgaggcaacaacattaccacaacatcatctttgatcgcctgcttttccgtttttttcagcttacgttgctctttttgttctaaggcttcaatgcgattttccgtttcttttttgacgacgtgagctggcaataatttttcttctttatgagaaaccagtaggaactgctgaccctgtgcaaagtgcaacagttcacttcctgcaagcggtgacgaccagccaaatttttgcatatcgctttgttggcaaggggtgaattttgtttgctgtaattgtgcgtctaattcactactggtgaagcgtaattcactggttaaacggtaaatcattacatttttgaaccaatatgtcataacatctctctttatctaaaattcattatcaatcaataagttactgaaagttcatcattcattactttgattatatcaccataactcaaaatgatagtaaccattttgagcacgaatacaacaatcacttattcgtggtatagaagtatagtaggaaactttccaagcccaaattactataaacgtgacaaaacattttcttgcttaaaacaccaaatgtaaattttgtgatctttatctcattttcgaatattttcgattgtttttgtttttaaggggtataaacttactttcgaaagcaatcgtagtatgcagtggttgttttgatgtaggagagaaaatgaaaagtagcgtagaaagacgttctgatattttggcgttattgcaaaaaacaggcagtcatcgagttgaagcattgtctcagcatttcggggtttcgacggttactatccgttcggatcttaatgtgttagagcaacaaggctatattacaagatcgcacggttttgcagtgttaaactccagattaatagcggaactttctattgcggataaaagtaataattatcccgaactcaaacaacagattggtcatcttgccgcttctttgttaaaagagggtgagaaggtgattttggactctggaacgacaacgaaagcaatcgtaaatgctatcggcgatcttaacttgacagtattgacaaatggacttgatgtcgcaatggcattggtttcttgtccaaatgttgaagtaagaatgacgggtggggttttacggaaaaatgcgatgtcgttttcgggagtaatggcggataataatttgcaacattatcgctttgataaagtctttttgggtgttgatggttttgacttacaaaaaggggtcacaacctttaacgagcaagaggctcagctaaatcgcttaatgtgcgatgcggcggatcaggtgattgtggtgacggattcgagcaaatttggtcaatatagccattttgttatttgccaagccaatcaaatagatgtgttagtcacggataataaaattcctctaagttatcgagagtatctcgaaaatgtcggggtgcaagtgttaattgcgtagtttcattctctttccttataaataaatccatttatttgtgagggaaatgcaatgatcctcaatatagctaaccaaacattagaaaaacagaacgctttttggacggcaaaggaaattgcccaacagccagcgacctggcgtgaaacggtttctattgtgaaatcgtcacttgttattccatttcttcagcctcttgttgaatatgcaaaacaaggcgaacttcgtgttatttttacgggggcaggtacttccgcttttattggtgaggttgttgcaccgatattaagccagcatttaggctgtgctgtcgaagcgattgcaagtactgatcttgtatccaatccttatcaatatcttttttcagataaaccaacacttttagtttcttttgctcgttcaggcaatagccctgaaagtattggggcagtagagcttgtcgatgatattgtcgaggaagcgtaccatttaaccataacgaataatgtcaatggggcattatttaaaaaatgtcagcaagatccgaccgcttatccattagcattaccagaatcaacccacgataaaggctttgcaatgacctccagtgccagcaatatgatgttagccgcattagtagcgtttttacctgatgtgtttgatgataactgggttgaaggtgctatatcggtaacagagcagttattagaacaggatcttctcgaaatccaacgtttagcccatctgccattaaaacggattgtctatttaggcagtgggcatttccaagggcttgcccgtgaaacttctttaaaactacttgaactcaccgctggtgaacgtcttggcttctttgagtcgtcaatgggcttccgccacggaccaaaatcccttgttcaagatgaaacgctcatttttatcttcttatctcagcaaccttataccgcacaatatgaccgtgacctgtatcaagagttaatcagagataaaaaagccagagaagtggtgttactaggcgatacaagcggttcgatccgagctgaaattcacaaattagatgacgcagcacggattttcccattcttagtgattgggcaactttactcgttttatagctcgctctatctcggctacaccacggataacccttgtccgacaggcgaggttaatcgtgtggtgcaaggtgtaacgatttatccatattgatatataggaggcaaaaatggcaattttaaatgtacgcattgatggacgtttaatccacggtcaagtggcaaacttatggacgtcttatctcaatatcactcgcattatggtcgtcgatgaagtcgcggcaaataatgacattgataaagcaggcttacgcttggcttgcccagcaggggtgaatttaagtgttttacctgtggaaaaagcagctgccaacattaacgaagggcgttatgactctcaacgtgtgttgttggtgacaagaaccccacaaacgatcttacagcttgtggaggcaggcgtaaatctgccagaagtaaatgcagggaatatgcctaaaacggatctaacacgtcctatccgaaaaacagtacacgttactgaagatgatgtggaagtgtttagaaaactttctgaaaaaggcgtgaagcttactgctcagttagtgcctaatgaagaaaaagtcgatttaatgaaacttttatagaggagtaacgattatgatcgaatggtggcaaatacttttgataacgctctatgcgttctatcaaatcctagatgaaatcacgattgtatctagtgctggttcacctgtgtttgcaggctttatcacaggtttaattatgggcgatttgacaactggattgttaatcggtggttcaatgcaattaaccattttaggtgtaggtaccttcggtggtgcatctcgtattgatgcaaactcaggtactgttatcgcaactgcattctctgttgcagctggaatggatccacaattagccttaacaaccttagctgtaccaatcgcagcgttaatggtttataccgatattttagcgagaatgtctaacgtattcttcgctcaccgtatcgacaaaaatatccaagaccacgcttacagtgcaatcacggtaaactatctctgcggtgcaatcgcttggggtctatctcgtgcattaccaatcttcttagcgttagtgtttggtggtccatttgtggcaagcctagcagaagcaatgcaaacaggcttcttaaaagttatcgcagatggtttaacccttgcaggtggcgtattaccagcgttaggtttcgcaatcttacttcgttacttaccaacaaaacgtcacattgcatacttaatccttgcattctcactcacagcaatcttcattactctcttcggtaacatcaatgctgtaggtgcatcaacaggtgtaagcaactcaatcagcagcgtaccaatgcttgcaatggcagcaatcggatttgcattcgcctacattgtttaccaacgtagcgtagaaggtggctcagccccagttgcaaaacaaaataccacttctgacaaaggagaaattgaagatgacgaactctaatcaacaagtcggaaatccaaaaggctataaattaacagatgcggacttccgccaaatcaatatccgtaacttattcttcaaccaagttggttggaactacgaacgtatgcaaggttcaggttatttatggattatgttgccacagctacgcaaaatgtacggcgacaatacacctgaactacaaaaaatgatggtgatgcacaaccaattcttcaacaccagcccattctttaacactattgttaaaggtatcgacttggcacttgaagaaaaacaaggggtgaaatcacttgaagccgttgcaggtatcaaatcaggtttaatgggaccatttgccgctatcggtgatgccctattcggctcacttgtcccagcaattatgggggcgattgccgcaacaatggcagtaaacggcaatccgctaggtgttggcttatgggttgcggtagcgattgccacaatggtattccgttgggtgcaactcaaaatcgcttatcgtgaaggggtaaacttagtcaccaacctaagtcaccgtttgaatgcactaaccaacgccgcaacagtgcttggggtattcgttgtgggggtaatgtgtgccacgatggtgaatgtcaaagtaccgtttgttgctactatcggtgagaaagtcgtttccgcccaagcgaacttagaccttatcttaccaagattagtccctgcgttagtggtgttcttcatctactggttactcggcagaccgaaaatgaactctaacaaagcgattatgatcatcatcgcactctgtatcttgctctcttgggctggattgttggcgaaagggtaatttaaaagggacacgaggcgtcgtgtccctacaataccatcgaatgtagcgacgccacgcttggcgtcctaaaacaagcggtcaaattcattcaaaatgttacaaataaccaagatctaaaacccaatcgctcttctctagatttattcggttttatatcttttaagcgaggtgaactatgcctttccaaatcggtgaaaaggatttcctactcaacggaaaaccgttcaaaatcctgtcaggtgcagtacattattttcgtatcgtgccggaatactggtacaaaacgctctataacttaaaggcaatggggtgtaacacggtggaaacctatgtgccgtggaacttacatcagccacagcctgatcaatttaacttcagcaagcgggcggatttagtcaaatttttgcaaacagcaaaagatctagggttgtacgttattcttcgcccaacaccttatatctgtgcggaatgggagtttggcggattgcctgcgtggttgctcaatattccaaatatccgcttacgccaaaacgatccgctgtttatcgctgaaatcgaccgctattttcaagaactgcttccacgcattgccccttatcaaatcacccaaggcggtaatatcctaatgatgcaaatcgagaacgaatacggctcgttcggcaatgataaaaactacctaagagctattcgggcgttgatgttaattcacggggtgaacgtaccgcttttcacgtcagacggtgcgtggcagaacgccttagaagcaggggcgttgatcgaagatgatattttgccgacggggaacttcggctctcgttccaatgaaaatttagatgagttgcaacgttatattgataagcacggcaaatcttacccgttgatgtgtatggaattttgggacggttggtttaaccgttggaaagagcctgtgatccgccgtgatgctcaagatttagcggactgcaccaaagagttactcgaacgggcaagtatcaatttttatatgttccaaggcggaacgaattttggcttttggaacggctgttccgcacggttagacaccgatttaccgcaagtaaccagctatgactatgatgcccctgttcacgaatggggcgagccgtcagagaaattctacctgctacaaaaagtgctagggcagtatcccgatgccagcccgattgtcgatccgattttgccaaatatcaccgcttacccaccgcttgcagtgcaaaatgaagtctcgttgtttggtaccttagacacaatcagtgaatgctatgaaagcccgttcactcaaacaatggaacagctagggtattactacggctatctgctttatcgagccaaaccgacagcatatagcggtgagatcaagctgagaatttaccaaggcagagatcgcattcagattttcaacgataaacaaaaagttgccacccagtatcaacacgagatcggcaatgaagtgatgttacagacgccaaatggcgagttccaacttgatctattagtggaaaatatgggacgagtgaattacggcggtaagctacttgcagcgacacaacataaaggtatcggtgcaggggctgtgcttgatctgcatttccacacaggctggcaacattatgcgattgattttgaccgcttggaagagattgattttgatggcgaaaaagacagccaaacgccttcgttctatcaatttaagttacacctagaccaagaaccgcaagatacctttattgatacccgtgagttcggcaagggggtaattgtggtaaatggtgagaatttaggacgttactggaatgaaggtccaacttgttatctctatctgcctgcaccgttactgcacaaaggcgagaatgagattatcgtctttgaaacggaaggggtgaagatcgatagcttaacatttagcgataagccgatttataaagagttgaatacgaagaatttataaggacaacacaccccgaatatcgtcaaacttccccctttgaaaaaggggggataaaaaattcaaaactaccaaaaggagcaactatgagcttaattttaatcagtcacggagagtttgcggaaggcttactggatactgccgaaatgattttaggcaaaatcgacaatgctcaaaccgtctgcttatatccacacgaaggcagtgaagatttccaagtgaaatttgagcaagcactggcgaatgcaagcggtgagattgtggttttttgcgacattatgggcggcacgccgtgtaatgtggcaatgcgttacttgccgaaattatcagggttatatagcggaatgaatttaccgatggtgattagctatgtgagtgaagatggcacggatggcttactggaaaatgccaaagaacaaattcacgatgtggctcaacaacttaaaaacttagcgttaggcgatgatgaataggagtagtagtatgtctaaacaagatttaatgaaaaaactttgcaccaaagagggcattattgctgctcttgcgattgaccaacgtggtgcgttacgccgaatgatgggcgatgatattaccgctcagcaggtcagcgaatttaaaactttgatttctcaagaattaaccccctatgcgtcgtcgatcttgcttgatccagaatttggctgggcggcttcagagaaacgtgatgcaaattgcggattaattatggcgtacgaaaaaactggctatgataaaaccgctgtgggtcgtttccctgatttgattgatgatgtgtccgtctatcgcttaaaagaaaaaggggcggaagcggttaaattgttgatctattttgacattgatgaaccacacgaaattaacgaccgcaaagccgcttttgttgaacgtgtggcttctgagtgtaatgcagaacaaattccgctgttcttagagatcttgacctacgacggttcaaacgaagataaagtctataacgccaaagtcaaaccttgcaaagtaatcgaagcgatgaagttctttgcggataaacgttttggggtagatgtcttgaaagtggaagtgcctgtggtgatgagttatgtggaaggctttactgacggtgaggtgctttacagtcaagcggaagccgctgcattcttcaaagcacaaagcgaagcaacagatctgccgtttattttcctaagtgcaggcgtttcagccaaactgttccaacaaacccttgaatttgctcaccaagcaggcagccggtttaacggcgtactgtgcggacgtgcgacttgggctggtggcgcggaagcctacaaagccgaaggtgttgaagccgctcgccagtggcttaaaacacaaggtaaacagaatatcagtgagttgctcgaagtgttagaacgcacggcaacgccgattaagtaaaaaagtaaattgccccttttcagtatagaaaggggcaatctattttaaacgtgaggtttacattcaggtagtgtaccttcaatttcaaagagtacatcaccatctttaaagaagacatagcccccatttttcatttttgtccagttctcattttttgtgagaggctgggttgtaataatggtgactttatcactttcttccgtatattcacggaaatcaatcattacatcatcatcacgcaatgctgtgccgaatggggctttgcgacagatataatgtaagtttgatgagcaacgtgcgatcatccagtgcccattggaaagaataaaattaaatacgccgtgtttagcgatttcactggcaatatctacaattgcgtcaaaaatctctttttcacttggtttttgtggaaaacgttgttttaggctggcaactatacagcaaaatgcggcttcagagtccgttgagcctataggctgatagtgattattcgggcaaactttgacatcaaccgtgccgttgtgggcgaatacccagttttcaccccaaatttcgcggataaatgggtgggtattttctaaattgacatcgccacaggttgctttacggatatgggcgataacgttaaaggatttaattagatattgactgacgagatctgccattggtgatgaggcacctgggcgattgtctctaaaaatacgcacacctttgccttcaaaaaaggcaatgccgaagccgtcggtatggtggtcggttaagcctgcacgccgtcgaaatccttcaaacgagaaagtaatatcggtcggcgtattacaattcattcctaataattgacacataatttacttctttatttacttcaaaaaaatataaaaatcccaccgcttgttatcattaacaagcggtgggatttaagcgaaatttgacaaaaaattcaataggaaaattatattttattgatcttaattcgcctcttttttaattaatgagagtaaaaagagtgttcctgcacaaacaaccactgaaggtcctgctggtgtatctttgagggcggagagtaatagtccgccactgaccgataatatgcttaatccgatggcgtaaataaccattgtttcaggtgttttggcaaagcgtcttgcggttgcagaggggataatcagtagtgaggtgatgattaaagccccgacaaatttcatacttaatgcaatgcttaatgcggtaagcaacattaataagaggcgtaggcgtgcgacatttaggccttcaatttgagctaattcagggctgactgtgatggcgagtagctttttccaatacagagccagtagtgtcgcaatgccgataaccccaatgccgataaagagtacgtcgttaaaaccaattgcaagaagatcaccaaataggtaggacattaaatcaacacgaacattgtctaataggctgatggtgataacgcctaaggataaactgcaatgggcgataatgcctaatagggtatcgactgagtgagtagagcgctgttctaaccagacgaggcaaagagcgagtatgacggtcattagaataacagcaatatagggatcgatttgtaggaaaattcctaatgcaaccccaagtaatgcggagtgagagagggtatcaccaaaatatgccatttttcgccagacgacaaaagccccaagcggtgcggtgatgaaggttaaaaatacgcctgctaaccacgcaggaaataaaatctcaaacatattgcctcaattagtgatgtccgttacaacgacatacattgccttgtaagtcgtggtggtgattatggtgatgagaataaaatgccacgtttttcgcaaattgatcgccaaagaagtagataaaacttgggtcacttgaaattttttcaggtgtaccagcacagcagatatggcgattaacgcatagcacttcgtccgtatttgccattacaatgtttaaatcgtgagaaaccattaaaatagcacagtttaaccattcacgagttttatttaatagttgatagagttccgtttgccctgtaatatccaccccttgcattggttcatctaagacaagcagttgtggacgatctaaaattgcacgggcaagcagtactcgttgtaactcaccgccagataatttttgcatactatgcttagcaaggtgagtgattgcaaatagggacaatgcttcatctatcaagggtttagtgctgttaggcttgagatatagaaatttttcaacggtaataggaatagagtgatccagatgcaatttttgtggcacatagccaatttttagctgtggttggtgaataacctgccctgatgttgctggctgtaatttcagcaatacttttaatagggtagatttaccccccccattaggaccaacgatagttgtgatagaattggggtagatgtttaaatgaatattttcaagggcaacttgtgtaccaaaattcacattaatcgctttcagttgcacaaggggcttcgttaaattgtggatcggcttaatttgcttgatctgcataacattaataaatttaaggatttaaggaattaaaattagcggatttttttcagttttacaagaaatctatgggaattttttgcctattcctttgtctataacaagttcgcactagaagaaaattatttaggatagaattttgcaacacgttatttttgctagagatcgccgtcgtaagaagaatagagtaaaggcatttgtgtttttggtgattatattatctatctttatcggtatcgctttaaccttaaaaagaccgagttcaaattcttcagaggctcaagaaatcccgattacgttggctactcagtcgttgcctgaagtttcaacaggattatctcatggtgagcctaagtatatcagcattgattttactgcctctgctaaagaggaacaggaacaagtaaatgctgagcctgttgatgaaaatgcaacctcttatgaagatgaattgagtgatgttgatgatgaaatagaagggcaacctaaagcagctgttcctgaaagtgaaaaattatcggaagaagcagaaaatgtattagaagatgtgttagatattgcagatcaagcattacgtatccaaaatcagtttagttataccgtaactcaaggcgatcagctaaaagatgtactagaacagtcaggattaacacatgccacagcaaaagccttagaaaaaacctttccacagttagccgatcttaaagtaggacaacaattctactggattttagacaataacggtgagctagaatatatgaactggctcatctcagaaaaagaagagaaaatttttgagcgtaaagctcaagatcaatttgcggtacaaacaattcagaaaaaaggcgtttggcaacaagatgtgattaaaggcaccattaatggcagttttagtgcaagtttaaaagcggtaggtttatctcaacgtcaaatcaatcagttagctaacggtctgcaatggcagattgccaccaataaattgaaaaaaggcgataaatttgcaattttagtaaagcgtgagtatatcaatggcaaggtcacggatttaggaaatgtcgaagccattcatattatcagtggcaagaaaagctattatgctattcaagcagataatggacgttattataaccgtcacggtgaaacgttaggtaaaggctttgctcgccacccattgccattcacaccaagagtttcatcacattttaatcctcgtcgcttacatccggtaacaagacgagttgcccctcataaaggggtggattttgctgttcgatctggaacaccgattattgcccctgcagatggtgtggttgaacatatcgcttatcaagcaaacggtgctggtcgttatattaaactacgccatggggggcaatatactacggtgtatatgcacttaagccgttcgttagttaaagttgggcaaagtgttaaaaaaggacaacgcattgcgttgtctggaaatacagggcgttcaacaggtgcacatctgcattatgaatttcatatcaatgggcgaccggttaatccaatgacagtaaaattgccgggtataggatctggtatgcccgataaagaacgtaaagcattcttagtgaaagcacggaatattgaaacaaaacttaaactctagaaggatttataatgaaaaaaagtctattgaccctaattagccttgcaatcttaggtacggcacaggcgaatgataaaaacttacagcaacagcttgagaaaattggggcaaccaatgtgaagttgtcagaatctgccttgccaggttttaaaacagcgatttctgatcaaggtgttgtgcaaattagcaatgatggacgctatgtaatacacgggcagatttttgaattaaaagatggcaaagttactgatattactaatcgtgcattactcgcagaacttaatagtctagcaaaagagatgattgtttatcctgcgaaaaatgaaaaacacgttgtcactgtttttatggatattacttgccattattgtcatttattgcactcaaagatcaaagaatataatgatttaggcattactattcgttatttagccttccctcgtggtggtatgaatactgaaactgcaaaacagatggaagcgatttggacagaaaaagatccagcctttgcattaaacgaagcggagaaaggtaacttaccaaaacaggtgaaaacaccaaacattgtgaaaaaacattatgaacttgggattaaatttggggttacgggtacgccaaatattgtcacaaaagaaggtgagttaatcgctggctatgttgagccaaaagagttgctcaaaatgttaagtcactaatccttaatttaaactacaagcggataggttttattctgatatcctccccgcctcaagaggcgggaattcctaagtgtaaattttaaacgtatttaaagacctataatttcatcgtttgaatactgataaaaattgaccatgcattagcttcttgaaagctgccctcccccaatagatttcataattttgtgatctctttcacattttctcttgaaatccccttgacaatcccaatttatagtttcgtcaagcgagagtaatctcgaagtcagaacatttaataacagaatttagaggaaactatgaatattgataaatttaccagcaagtttcaatcagcaattgccgatgcacaatctttagccgttggcaaagataatccctatattgaaccggcccatttaatgcttgccttgttaaagcaaaatgatggatcaatcacaccgcttgtcaccagtttaaatgtgcaacctaaccgtttaagcagtgaacttgatggcatcatcagccgtttgccacaggtgcaagggggcaatacacagccgtcacaacaacttttccgtttgttaaatcaatgcgataagttgtcgcaacagtttggcgatagctttatttcatcagagctgtttgtacttgcggcacttgaagataacggtgatttaggcaagttattgaaaaacttaggtttaaccaaagagaaggtgacagccgccattcaacaaattcgtggaggggagagcgtgaataatcaaaatgcagaagaaacgagacaagcgttacaaaaatataccattgatttaactgaacgggctaaagcaggcaaacttgatcctgtgatcgggcgtgatgaagagatccgccgtacggtgcaagtattgcaacgccgtactaaaaataacccagtgcttatcggtgaacctggtgtggggaaaacggcgattgtcgaaggtttagcacaacgtattgtcaatggcgaagtgcctgagggtttgaagaacaaacgggtattgtcgttggatatgggagcgttaattgcaggagcaaaataccgcggtgagtttgaagaacgtttgaaagcggtattaaatgaacttgccaaagaagaagggcaagtgatcctgtttattgatgaaattcatacgatggttggggcaggtaaaaccgatggagcgatggacgctggtaacttgttgaaaccgtcccttgcccgtggtgagttgcactgtgtcggggcgacaaccttagatgaataccgtcagtatattgaaaaagatgcggctctggagcgtcgtttccaaaaagtgttggttgatgaaccaacggtggaagacaccattgcgattttgcgtggtttgaaagaacgttacgaaattcaccatcacgttcaaattaccgaccctgcgattgtggcggcggcaactctttcgcaccgctatatttcagatcgccagttacccgataaagcgattgatttaattgatgaagcggcttccagcttgcgtatggaaatcgactctaaaccagagccgttagataaacttgaacgccgtatcattcagttgaaattagagcgtcaagcgttacagaaagaagaagatgaagccagccgtcagcgtcttgcaaaattagacgaggatctgaccgctcgtgaacgtgaatatgcggagctggaagaagtatggaaagcagaaaaatccgctctattaggcacgcaacacattaaaaccgagttggaaaatgcccgaattgaaatggatcaggctcgccgtgagaataactttgaaaaaatgtcagagttgcaatacggcaaaattccggcccttgagaagcagttgcaagaagcggtaaaacgtgaagaagagggcggtgaaaatcatctgttacgcaccaaagtgactgatgaagaaattgccgaagtgctgtctaaagctacgggtatccctgtatccaaaatgatggagggggaaaaagagaaactattgcgaatggaagaagtgctacacaaacgagtaatcggtcaaagtgaagccgttgatgcggtagcaaatgcgatccgacgtagtcgagcaggcttgtctgatccaaatcgccctatcggttcattcctattcttaggaccgacaggcgtagggaaaacagagctttgcaaaacattagccaacttcctatttgacgatcaagatgcgatggtgcggatcgatatgtccgaatttatggaaaaacatagcgtatctcgcttagtcggtgcaccaccaggatatgtcggctatgaagaaggcggatatttgactgaagcggttcgccgtcgtccatattcggttgtgttgctcgatgaagtagaaaaagcacacccagatgtattcaacattttattgcaggtgcttgatgatggtcgtttaactgacggacaaggtcgtacggtggatttccgtaatacggtcgtcattatgacatcaaacttaggttcgcacttaattcaagagaatgcggaaaatatgagttacgatgaaatgaaaactatcgtgatgaatgtggttgggcaacatttccgccctgaatttatcaaccgtattgatgaaactgtggtattccacccattagataaagaaaatatccgtgcgattgcaagaatacagcttgaacgtctaattaaacgtatggcggagcgtggctatgaagtgacggtgaccgatgcggcagttgatcatatcggcgaagcaggctttgatccactctttggggcaagaccgcttaaacgtgcaattcagcaagagcttgaaaacaccttggcacagcaaattctctctggcaaattgttgccgaatagtcctgtgacagtggattatcaagaaggaagggttgtggcagttcagtaaaagagtaagagcgtagagatacgccctttgttttgtgaaatacattgacttttctatgatttctcgctaatttgtgggcgtttttaacacaaaaactatttatttacaggagattctatgcaagatcgtttagtcacttccacaagaagtgaatcccttcttagcacacataaagtattacgtaatacttatttcttacttgcgttaacgcttgtattttcggcagtggttgcatctgtcacaatgacacttaatttaccacgtttaccttggtggggaatgttagtcggtttttatggcttacttttcttaaccaatgcaacggcaaatagtgcagcagggttagcaagtgtttttgcgttaacgggtttcttaggttatagcttgggtccaattttaaatgcttatatcagcaatggcttaggcgatgtggttgcattggctttaggggcgactgcgttggtattctttagctgttctgcttatgtattaactactaaacgtgatatgtctttcttatcgggtatgatgattgcgttgttcgtggtgttattagtgggtattgtggcaaatatcttcttagcaatgcccgcgttaagtttagcgatcagtgcattatttgtagtgttctcaacggctgcaattttatattcaactagcaacattatccacggcggtgaaacaaactatatccgtgcaaccgttgatttatatgtgtctatctacaacctatttgtgagcttattacagcttttaggagtatttagtagtgatgactaaataaatttagctcattggattcattaaaaatagttataaggggacgctaatttagtcccctttattatcaatgcgcctcatcccaattgcttccaactccaacttccgcactcaatggtactttaagctcaattgctttttccatttcggctttaatcagttgggtgtaatgctctactctgtcggctttaacttcaaagactaattcatcgtgtacttgcataatcattgcaatatcttcgcagtttcgcaccgcttgatcgatcccgatcattgccactttgataatatctgccgccgtgccttgcattggggcgttgatggcaacacgttctgccgctttgcgtcgcatttggttgcttgagttaatttcaggcaaatataaacggcgaccaaatagggtttcaacatagcctttttcagcggctttttcacgaatgtctaacataaactgttgcacggctggataacgctggaagtaaagttccatatattttttcgcatcggtacgagaaatgcccagttgatttgccaagccaaattcagacattccgtaaatcaagccgaagttaatcgccttggcactacggcgttgttcactggtcaccgcttccaacggcacgccaaaaatttccgccgccgtagaacggtgaatgtctttaccttcggcaaaggctttgatcatattcgcatcattagcaagatgtgccattatgcgtaactcaatttgcgaatagtccgccgccaaaatcacatagccatcacgggcaataaaggcttgacggatacgtctgccctgctcgttgcggatcggaatattttgtaaattcggatcgcttgatgaaagtcgccctgttgccgtgaccgcttgatgatatgaagtatgcacacgtcctgtttgtgcattaatcatctgcggtagtttatcggtataggtcgatttcagcttgctcaagccacgatgttccatcaacagcacaggcacttggtgtcccatttgagccagttcttccaacacttcttcgttggttgatggcgcacctttcggggttttctttaaaatcggtaagccgagtttgttaaataaaatctcttgcagttgcttagtggaagcaaggttaaacacttctcctgcttcttgatgtacaagggtttcaagctcttttaaacgctgttcaatctctaccgaatgtgccaacagtttggcaggatcgattaatacgccgtttcgttccacacgggaaagtacgctcaccaacggcatttcgatttgctcaaacagtttcaccaattcaggcgttttttgtagttcagaccataagagttgatgtaatttcattgtaatttcggcatcttcccctgcatattctgttgctttatccagttcaatttgatcgaatgtaagctgatgtttgcccttacctgccaactcttcaaaaggaatagtttgatgtcccaaataacgctctgccaaattgtccatattgtgacgacctgtgctgtctagggtgtaagattgcaacatcgtatcaaaggcaaccccttgtagctcaatgccgttgcgagcaaaaattgttaaatcgtatttgatattctgcccgattttgcggatattttggttctctaaaatcggttttaactgtaccaaacagtccgccttgttcaactggttaggcagtaacgcttcgacttcatcgagttctgcttcactttcaccaaacagatccacttgggtcgactgtgtaattttgcctttatgcgccaacggaatgtagcacgcttcgccattttccaagccaaatgaaatcccgactaaatttgcttgcattgcatctaaattatccgtttcggtatccaccgccacaagctgtgccatttgcaattttgccagccatttggtaaacagctcagggctgttcacgcaatcgtaagcggtgcgatctatcgaaatttttacaaaaggtgcagatttttgttctgaactgaccgcttgtgtggcttgataattgttcgggattttctctgctgacgtttgtgtcacagggttagcgtcattcatcacttcgttcagccaacgtttaaattcataacgaccaaagagttctaccagttgatctcgctgttgtggttgagtaacaagctgatcgtaagtgacatcaagggcaacatcggttttgattgtcgctaacagataagagagatcggctgtttctttttctgcttccaatttcggtgcaaaggtttttgccccacgaaatgataactctgcaattttgtctaaatttgcataaatcgcttgcattgagccaataccttgcaacaacgcaatcgccgttttctcaccaacaccttttacccctggaatattatcggacgagtcgcccaataaggctaaatagtcgataatcaactcaggcggaatgccatatttttcaatcaccccttcacgatctaacaaggtattgttcatcgtgttaatcagcataatatgatcgttcaccaattgagccatatccttatcgcccgtactgattaaaacgtgcttacctgcttgtgaagcctgcactgcaagcgttccaattacatcatcagcttccaccccttcaatcgacaacagcggaatacccaatgccttaattattgcgtgtaacggttggatctgcgaacgaagttcatcgggcatcggcggacggtgagacttatactgttcaaacagctcatcacggaaggttttccctttcgcatcaaacacgacggcaatatggcttggctcaacctgtgcaatcaggctttttaacatattcagcaccccatacatcgcccctgttggctcaccttgtttgttagttaaagggggaaatgcgtggaatgcacgatataaataggacgaaccgtccactaaaacgagcggattttgtgcgattgttgccatttgaactctctttgatctaaataatttgggctattatagcgaaagtagtgggattaaagaaaaggttttgggaaattatgtctatccatatttttccccaaaacgcccccatacaataggggactttacgatttacatcaaaccattacgattctattaacatcggtaattctgacatactcactaatttataatcagccaatgcccagcgagggtcgtcccattccgattttgcaggaataacaacggttttcatactcgccgctttacctgaaatcatacctaaaaccgaatcttctacggcaaaacaggcagatgttggaacgccaagttgttttgctgcgtgtaaatatacagctgggtgtggcttgttgtactccaattcctcagcagaagctaaataatcaaaatattcagctatgccacagctatcaacaatgccttgtagcatatttcttggcgaagccgaagcaactgcgattttaatcccccgttgttttaatgtagataaaacctctttcacatttggcattaatggcttcgcttcaagcacctttccaactacatatgccatcaactcttctattaactgagtacgactcttttctttttcaccatatttttgtagcacataatcaaccagcgtaccaataggcgaccctgtaagagtcatcatttcagctaaggttacaggaaattgatttttctgaaaaaattcagtacttgcttgataccaaataggtcgggaatcaattaacgtaccgtccatatcaaaaattacagcttcgatcattttacattcttccgttattaattattacaagtgcttcccctaaaacaaagcaatcactgtatcctacatgcttttcacctttgaaatataattggcaattcattcctattcagataaatagatagaaactaagttatatccccaatttttccttataatgcaaacggcatacagaaagatagctatcgtttccaccgatttgaatttgatctccatcttttaccgcttcacctttctcattcatacgaataacaaagcctgctttacgcccacaataacagatggttttgagttcttcgagctgatcagcccaagcgagtagatagcgacttccctcaaataattcagactggaaatcggtgcgtaagccgtaacaaagcacagggatttttaatttatcgaccacttcagtcagttgataaacctgttgcttggtaagaaattgtgcttcatcaatcagaatacagtgcaatttttcatcggcaatgtaagcggtgatttcatcaaataaattgctatcgtttttgaataaacgagcatcttgtgaaataccaattcgagaggagactttccctacgccataacgatcatctatcgccgcagtataaacaagggtattcattcctcgttcttgatagttataagatgattgaagcaaagttgtggatttccctgcattcatcgcagagtaataaaaatagagtttagccataataaatgaagtaataaaaaacggctaatcaagatattagccgtttattcaaacaaagattaaacgttgtcgatttgacctaacagagagcgtaaacgatcttggaagttttgatgttcagtttttaattgctcgtgttcttgacgcagagtttcatttgcacgattagcttcctcgtttttaccttttaactcttcaacttctaattgaagtaattgaatggtttcaacagcctgtttaattttttcttcaagttggtctaaaattgcgactgacataatatgttcctctagtgagtagtaatgaaagtgtaaagattttaccttacttagaagaaattttcattataaagttcggagttatagataaaaaagcacactgttagacataaactttttgtaactttctcaattaggggtagtatatgtctatcaaaaattagatgttagattagtggtaaagtagcttgtagggtgggtcttgacccaccatataatcgtaacatattgattttattgatggattaaaacctaccctacaatatttaacctattaatatatggtttgttagcggtctagtacctagtacggagatgagatgaaatgaaaattgagaagaaaagtaatgaggcaattattgagccaattgaagataattggaattggttagatgaattgggagagccagatcctacgtttaattatcaacatatcaaagaatttaaacgtgtaccattattaaattacgaagattggctagctgaagataaaaaaatcccctaacaagttgtcaggggattgagggattattttacacgagaaacatattcgcctgaacgggtatccacacggatcacttcgccgatttgaacgaaaagtggaacacgaacaactgcacctgtgcttaatgtcgcaggtttaccacctgtaccagcggtatcaccttttaagcctggatcagtttcgataacttctaattcaacaaagtttggtggagtaacgccgattgcagagccattccataatgtaatgatacattctgcttgatcaactaaccatttatcgttgtcgcctaatgcttttgcatctacagaaatttgttcgaacgtttccgggtgcataaagtaccagaaatcttcatctttataagagtaagtgtagttgtaatctacaacatcagccgcttcaacagttgagcctgatttgaagttgatctctaatactttaccagagattaatttacggatttttgtacgggtaaatgcttgacctttacctggttttacaaattcattttcaacgataacgcaaggttcgccatcttggataaattttaaacctggtttgaaatcattagtgctgtaactagccattgtgatcctcagaatttagataaaaagtaacgcccaaagggctaaataaaaagacgtatataatacactaaaaacggcaggcaaaaaattaaaatttttctgaagtatggcagataaagtcgtttcaggtataatctgttttttcaatcaatgaggaaataaaatgaaaaaagcagtgttaatgggattagttcttgcccttaccgtttcaaccgttcaagcgaaaaaagcaggtggaatgaaattttcttcaagtaaaaaaacaccagcaacggttcagcagtccacaacacaacaaaaagccgatgcggactttaataatacgccaaatcaaacaatgccaaatgcaggggcggctcaacaagctcaaggcaaccgtttaggcaattttgtgacaggggcggcggcaggttacttattaagtgaagctctttccccgacggaagcacaggctcaaacaccagcaaccaatccaacggaacaattaaccaaacaggtacaacaggcaccagccgtgccaacctttaaagcaatcgatccgcaaaacgacccttaccttattgagaaaacaccgggttatttgcgttactgcttaaatggtgtgcaatatatggtaggaaccaacaatagccaattaccaccaacattgatggtagataaaaccaacgcaccaatgcagtgtgtgattagccagtaatttcatcagcaaaaggggcaaatttgaacatctcattttacgacgcaccaacgaaagctcaatggctacaagatctggctgaagcctttaatcgaccagaagatttattgaattaccttgagctaaacattgcagattttgagcaagatcttaccgctcgtaaactgtttgcgttaagagtgccacgcccctttgccgaaaaaatgaaaaagggggatcgggcagatcccctttttttacaagcgatcacattacaagaagaatttaccaatgttgatggctttgtccaagacccactggaagaacagcattcgccagcccctaacattttgcataaatatcataaccgcttgttatttatggtaaaaaatagctgtgcgattaactgtcgctactgtttccgtcgccactttccctatgatgaagtcaaaagtggcaaagcaacgtggcagaaaagcctcgactatataaaagcacattccgaagtggaagaagtgatcttatcaggaggcgatcccttgatggcaaaagaccacgaaattgactggattttcacccaactagaacagatttcccatatcaacaccgtgcgtattcacagccgtttacctgtggttattcccaaccgtattacagacgaattatgtgaacggctattacaaagtcgtttgaaggtcgtgttagtgacgcacatcaatcacgccaacgaaatagatgacatttttgcggaaaaaatgcagaagctaaagcaaagcaatgttgtgttgctcaaccaatctgtcttgctcaaagggatcaacgacaacgcccaaacactcaaagccttgagtgataaattatttcgcaatggcattttaccctattatttgcacctactagacaaagtggcaggggcgagccatttttatattgaagacagcagagcctttgaaatttatcgtgaattgcaacgcattacatcgggttacttagtgccgaaattagcacgagaaatggcgaaagagccgaataagacattgatgggtatctctgcttaattgatattcagttccttaatcgctcaatctctttactaaattcttctatatcatcaaaacttaaataaactgacgcaaatcgaatataagcgactttatctaaggactttaattcacctaacaccaagtctccgacaaatttactagcaacttccctttcccctgtggcttgaagttgtaacacaatgcagtggatcgcttgctcaacatcatcggtactcacggggcgtttttctaatgcacgagataaactggttcttaatttacgttcatcaaaaggttctcggctaccattatttttaacaatatgcggaatgagtaattcagcactttcaaaggttgtaaaacgttctttacagacagggcattctcgtctgcgacgaatttggtagccatctgcggttaaacgtgaatctacaactttggtatcatcagtagcacaaaacggacaacgcattattttaacccttcttgtcttgctacaaattcagcgtataaattttcagggggtggaggcatttgcaaatagaacccttcattttggattttttgcaaaacttcttgattatctacccgcttgagctgcttttcacctgctaaattaaacagcattacaaactcaggtttaccaaaaatttggcgaagttctagaggtacggcctcaaatttatcccgtttttccacataaagatacattccttcttttttggggcttttataaattgcacataacatcttattcgtcctctagtctgtagctaccttcgtaattggtgaaacgtgaatattgtccttggaaacctaacggcactcgtccgattggaccattacgctgtttaccaatgatgatctccgccattccttttgtatctggattatcgtgataaacctcatcacgataaataaacataattaagtctgcatcttgttcaatcgatcccgattcgcgcaaatccgagtttacagggcgtttatctgaacgttgttctaaactacggttgagctgagaaagtgccactaccggtacttgtaactctttagctaaggctttcagtgagcgagaaatttccgcaatttcaagggttcggttatcggcaaatccaggagcgcgcattaattgtagatagtccaccataattaaacttaatccaccgttttccttgtacacacgtctcgcgcgtgaacgtaattccgttggggttaaacctgaactatcatcaatataaatattacctctggattgcaacactcccactgtactaccaaccctagacatttcctcatcatctagttgccctgtacgaatacgcgtttgatcgaccgttgaaagcgaagcaaacatacgcatcataatttgatctgctggcatctcaaggctgaaaatcagcacaggcttattcggttgcttaactttattgccattctcatcttcgacctcaacatctcccattgctgcattttcacacaaattcatcgcaaatgttgtttttcccattgatggacgggcagcgacaatgattaaatctgaaggttgaagtcctgctgtttttcggtctaaggcggcaaaacccgttgatacacctgttacaccgctattattttgagaacgagagagtaattctatgcgagctaaggtttccatcaaaatatcatcaatttttttcggcccttcgtcagttgcagttcgcatttctgcaatatgaaaaacggatctctccgcttcatctaatacttctttaactgtcaatcccttagggttatagctgatttctgcgattttattacccgccgcaatcaattcacgacgaatagcccgttcactgacaatctccgcataaactaaaatattcgccgcacttggggtatttttagacagttcagcaagataggcaaaaccacccacatcttgcaatatgcctttattcttaagcacctgatcaagcgtgataatatcaataggctgattattgcgagatagtgaaaccatttcttcaaaaatcagacgatgagcgtgattgtaaaaatcggtactctgaacacgctcagcaacgctgtcccagtactcgttactcagcattatcccacccaataccgcttgctctgcttcaattgagtgaggggcaatgtttatctgttcaatctgtttatctttttgaggatctttatttttttgatattcagccattgatgaaactcttttcagggaaatgataaaaggtagtttaccgaatttgccaaaaattttcagctggtttaccccgtacaaaaatagcgagacacaaaatttgttgataatctgcttcaactacactaatttcattatttaatagtaatcatagaaccaaagttaaagcactgaaaccacagatctacttgtgaaaaacctgcttcttttaggcgtgctttatgtgtatcaatactatctgtccgcatcacattctcaagggctgtacgcttttggcttacttcaagctcactatagccatttgcacgtttaaacgtgtggtgcaaatcaataagaagttcatttattgtgttatcttcaaaagtaaatttttccgataacaccaacacaccatttggatttaacccctgataaattttacgtaaaagagcaagcctgtcttctcttggcaaaaattgcaacgtgaaatttaggacaaccattgatgcatttttaatctcaacgtgacgaatatcatcacataaaatttccacaggaatatccgaatgataggcttccaaatggcgacgaccgcgttctaccataggttcagaattatccacaccaataattcttactcctgctttttccacattacgccgaatcgataaaatcccagccccacgagaacaacctaaatcatagacatttgactgatcagtcacaaaacgagaagcaagcataccaatcgctgtaatgatattagaatagcctggcacagaacgttgaatcatatctggaaaaacttccgcaacagattcatcaaaagtgaaatcccctaatttctcaataggggctgaaaatagagtatctttagacataaacaatattattgatagtaaatggtgtattctactcgcaatttataaagattgtagaaaataatttatttagcaacattcctaatttagtgaatacgtataagtacgatataaaaatgcgcaaatcaggacaaataacatcacaataatttgaattaatctctttttagtcaatttctctgccgccattttcactccaaatctaaataaaccttgttcattattccctaaaaaaatgttaaaatttgccttaaatcaaattttaggatggtttcgtatgaaaattgtatctgattttaaagcaaatggaagaacagcctgcacaattcactgtcaaaattgcagtattagtcaattatgtttaccttttactctcaatgaacatgaattaactcaattagataatatcattgaacgtaagaaacctgtgcaaaaatcacaaatcatctttcagtcaggtgatgaactcaagtctatctacgcaatccgttcaggcacaattaaaagctataccatcagtgaaaatggtgaagagcaaatcaccgctttccatttaccgggcgatttagttggctttgatgcgattatggatatgaaacatatcggttttgctcaggctcttgaaacgtcgatgatctgcgaaattccttttgatattttagatgatttagctggcaaaatgccaaaaatccgctatcagattatgcgtttgatgagtcatgaaatcaaaagcgatcaagaaatgattttattgctttctaaaatgagtgcggaagagaaacttgcggcgtttatttacaatctttcacaacgttatgccgcacgcggtttttcagcaagagaatttcgcttaacaatgacccgtggtgatattggaaattacttaggtttaaccattgaaactatcagtcgcttgcttggtcgattccagaaaaatggcatcataacggtacaaggtaaatatattaccattaatcatatggatgaattaagtgaaatggctggtgttacaaaacctaaactgtcccattgcaatccaaacttataattctttacatactacttatcttgacgttctccccgtaccttacggacagggctgaaaaaatactcttctatcttaaaaagataatttatgccctagtctccgatctatgagaatgaatactagggctcatctctaatgaaaatatcccttccttctataaagaagatcaattcgataatttgatattaaagagccatttgtctaccaaacgcttcccttcctcgcttgaaccaaaacgggcataatccacatcaaccaatttcaccccatctattttaggtgattgtggggcaacttctgctttcacattggttggtgtttgataaagtccgtggtcacgccaaggaatttcttgaacctctttagacagaacccaatccataaacaatttcgcattatcaaggtttctcgcacctttaataatacttgcagcccctaaagcataacctaccccatctttaggtaacacataatcaaccggtgcacctttctctttttctgaagcatagccgtgagcaaagccaactgtcacagcactctctccacgagaaaggttagaggtcactaaggtacttttcacatattgagaaatgttgccatctaattttttcaagtactcaaaggctttttcctcgcccattaactgaataagcgtaatcatcgtcgtgtacattgttcctgaagtgcgaggatcagctaattgcacttcgccttttaagcgaggatcaagcaaatctgcccattttttcggagcttcaacgcctaactgttttaatttttcggtattaataccaaaaccaagcaccatcaaatacgcaatcgaggtatatttacctgcttcgctctcttgcaatgctttaaattgaggtaaaacctccgcttgcaaaggtgaacgataggcttctaatagccccatctgccctgcttggaaatgtggctcaatagtgccgccataccaaatatccgcttgcggattatctttttccgctttcagcttacctaaaattgtccctgttccaccgtgaataaactgagtttccacattatatttttgtgaaaaacgcttcgtcagatcttcacacaccttgttttgcacgccacaataaacggtcagctttccttcagcctgagcattagaagctgcaaagactaatggtgaaaggagaaaaaggcttgaaaagcatttttttaattgcaattttttcatttgttccacattcctaagttaaaaaagaatcttaattgtaacatttacgctacataaagcaagaataagcggtttgattttatgctaaaatggcataacactatcctattatattgatataaaaaatgttacttaatcaaattcaaataatcctgatcgaaacctctcacagcggtaatatcggctcagctgcacgagcaatgaaaacgatgggactaagccggctaaggcttgtcgccccaaaacaagcgattgacgaacaagcaatagcccttgccgcaggggcaaaagatgtattggataatgtacaaatttatccagatttcgacagtgcaatcgcagattgccagcttgttattggcacaagtgccagattacgccatctacaaaattcactggtcgaaccacgtcaatgtggtaaattagctattcaacgtgctgaacagggtaaagtagcgattgtatttggacgagaacgggtgggcttaaccaatgaagaattattaaaatgccattatcacttaaactttccaaccaaccccgactatggctcgttaaatcttgcaatggcggtacaactcgcctgttatgaactccgaatggcttggctagatttgcaagaaaaaaccgatattcaaccgcttgcagaatacccgacatcagaagccttagaacatttctttgcccataccgaacgtttatataaagaacttggctttattcgcaacgaagcagttatgctgaaactacgccgtttatatcaacgagccgaattggaaaccaatgaattgaatttattaagaggaatgctgactgcagtagaaaagtactcgctaaagcagaaaaatgactaataataaagggataagaaattacatctcttatcccttaaatcatagctaattaactatagtacctaactatctagattaccataatacacgtaaaccaacaccaagtgcttggtcagtaacttttttgttattactgtctttgttcttgattaaacgaccttcaacaaaggtaacaacttgtttatgtaatttatagtctgcacctaacatgaattgatgagctgttgctttgtaagctttatctttgtaagtaccataagagtagtttccatacacgccagattttggagtaacatcaaatcttgcgccagttcttacgaagtcaattttctctttaacattacctgttttttcaacaccatgaccaccatcaacagctacagtaaatggagcgttgacatatttaagaccaaagtatacaccatctttgtctttcttattaacagatccagatttatagtcatcatgagtataacctgctgccacagttacagattgactttccgcaatcttagctgtgtatttagcacctaaaccaaagccagatttagtagaacctacatttacttctcccgtcttcttatcacgctcatttgcaacattatagttagcacctaacgtcaaaccttcaatgcctgtataggtatagttaattgctgaatcagaatctgaagtaaggatatcaaaaccttttttgtttgtgttgtttgctgaatatttaattccaccagtaccaacaccgtatactttatcaaaaccagcttgaccaatgctatcaccgattacagcttgtttaccaaaagaaatttcatgaccatagccacctaaaccgacgtaagcatattttgttttaacatcgccccatcctgcagcatttttagaattactgtcaaggcgagtctcataacgaccaaaaccgtagagattctcattgatattatgtttgatagaaataccgaaacgagaaccattattctttaagttagtgtgaccacctgttgaagattgacctttctcttttgtggcttgttcttctaaaagaagacgcaattgaccatcaaaatcaacttttgtaccttcattttcataaactgttacagctgatgctgatgctgcaaatgccgctactgctaatgctactagtgtttttttcataatgttcaccttaagtttttagtttagctaagattactcttattaaggtataagagtaaccgatccatatctgccattaccttcccatgtaagtttggtaaatgccgattgcgtgcgtatgattgcaaatttgtagagtagtgtcaatatcttacataaaaaaaacaaaaaaacattttctttaaaatcaataagttaataaatccccaccccaaaacaagtattcagagataattttttaaaatattgctcctattgcaataaatcacataactatatgatttaaaaataaaaaactcatagcaaataaagatttataaccttttttctaaaaatgtgagtttcatcacatttttagaaaaaaatagaaagattatttttatcaaaaataaatttgaaaagagatgtacatacattaaaatatctatacgcttaatacagagaataaaaaatgggtaattttacagatacaatcattacaaaattaaacgacttttctcccatcttgtctctgcaaatctctatctatagccactgctttaaacttactcatggctccgtcaaagaattcatacaagaaatactagaaacatgttcacatattgagcagtcaacttcccctgaaataactgaagtttatactcaacgtttaattgaacaatatgatgctctacaaaaaagtattcacctcaaggataaaaagtcagattcccctattttctctcaatataaatttactaagagtattcatacattatcaaagaaacagaagttacatgaatactataaagcgttgcgtgcattgaatgaaaaactctcatggctcattgaacaaaattaccattaccctgagtataggcatatgctctcaataaagatacaagaaacagagaatagaaaacaaaaatgtttaaaggcgattgaagaattgagctttaatcaggaatgacgggagaagattgacaatatattgttgctaatcttatcaatctctagtagtgtctaaacataacactatatctatatatgctatgctctaaacagatacatcatactaaaaagagcccatagaaaatatcctctcttaatagagaggatatataaaattgtaatactaacgttttgagtattgtggacgacgacgtgctttgtgtaaacccacttttttacgttcaacacgacgagcatcacgggtaacaaagcccgcagcacgtaacgctggacgtaaagtttcgtcgtattcgatcaatgcacgagtaataccgtgacggattgcacctgcttgaccagaaataccaccacctttaacagtgatgtataagtctaatttatctgttaactcaactaattctaatggttgacgaacgatcatgcgagctgtttcgcgaccgaagtaaacttctaaagaacgttggttaatggtgatgttaccattgcccggtttgataaatacacgagctgaagagcttttgcggcgacctgtgccgtagttttgatttgctgctgtcatttttatgctccgtgattagatatctaaaacttgtggttgttgtgctgcgtggttgtgttcgttacctgcatacacttttaatttacggaacattgcacggcctaatggaccttttggcaacatacctttaaccgcaatttcaatcactgcttctggacgacgagcaatcatttctttgaaggttgcatctttaatgccacctacatagccagtatgccagtaatagattttatcagtttcttttttgcctgttaccgctactttttccgcattgataacgatgatgtaatcacctgtatcaacgtgtggagtgtactcagccttgtgtttaccacgaagacgatgtgctaattcagtagctaaacgacctaaagttttacctgtcgcatctactacataccagtcacgtttaactgtttctggttttgctacaaaagttttcattaattaaataccaaaatttaaagtttaaacccaatatcctaatggatattacctattaatacggtagaatctgaccccttcgagtcttattcagaccaaacttatatggcgggaataccatacaaaaacagggtggcagaattatacagatttccttgagaaaaatctaaccatttttgataaaaaatttatttttgtggatagtttcaaaaaatgaatttcttttccttttcatcctgtaaataacatgataaaaattaatgacatttactcaatccacttaaggagtgcatatggaacaatggtcaggtaacgtgtggactgcaattattgcagcatttattgttggttgtattattagctatgttgttgtgagagcaacaaatagtaatgtcaaaaaacaactcaagcttgaagccgatttaaaagaaactaccaaaaaattggacgagcaaaaacagcaattagagcaacactttgagcaatctgcaacattgcttgcgactcttgctgaagactataagaaactctatacccatttagcaaaaggttcagaatcattattaccatccgattctgcaaaaattgagtttttccaacagcctaaaattgaaaataaacctcaaacagatgaagatcaacctaaagattattcagaaggctcctctggtttactaaaatcctagtattcatatattattgaatttaagaggagggaatcccctcttaaattctctttaactacatttttcttagaacatattgtctttattatcagaaaatttgatcgaaaacattatattaaatttaatttcagattagaatttgaaaaatttttttaacttatcattaacaggaaaatacaatgtcttgtttatttattgcaggcacagatacaaatgtaggaaaaactatcgttacaagggctctattacaaacaatatctaaatatgaaattcccattgtcggttataagcctattgcgtgtggtggtgatgattctttacccacagaacccaatcaagatgattatgcctgtgaagacaatagtgatgtcctcattatacagaacagctgcccttgtcctgtaaaatacagagaaattaatagctattcttttatccattctagtacgccagtatttgcagcgctagacgcagtacgtcatatttctgttaataaactggatcacgatcttcaacgtttacaccgacaatatgcaaatgttcttattgaaggcacttatggctggttaacacctattaataaagacctaagttttgctgattgggttaagaaaaatagaatgccagtcgtacttgttgtgggaataaaagagggttgcgctaaccatgcacttttaacagcggatgcgattcaacaaagtggggttaatcttatcggatggattgcaaatcgagtaaatcctgggctacgtcactacgctgaattaattgaactccttagcaaaaaaatcaatgctccattactaggacaaattccttatattggttatcctagtaaaaaagaactatctgagtatattcagaacccagagcctctattaagttttttccataaataatctaattgctgactcttgaagagctaagctcatactgaaatattcaatattatgtagcagttgcacaaacattaaatgttttcgtagcaactgctacataataccagaaatattaagctggctctttattgataataatagactaacaatcatgactacaaaggttgctatataattttagcaaccactctgatttctatgctattttagctagttaaataattcataaatgctgtaattacacctaagttaaccacatccacaaagaatgcacctacaagcggtatgattaagaatgctttatgtgatggtccaaaagtttctgtgacagattgcatgttcgcgaccgcagttgcagttgcacctaagccaaaaccactgtgacctgctgcgagaatggctgcatcataattacttcccattactctaaaggtcacaaaatatgcataaagtaccataactatggtttgagcaataaggataggtaacattgagccagcaaggtctgctaattcccaaagtttaatgctcattaatgcaattgctaagaataagcttaatgatgcgttaccaaatacgtcaatagcacggtcaaacatatcaaatttaaacactaacgttaatacgtttcttaataccacaccaaaacctaaggcccatacgaactgcggtaaacctgaatcagggaatactttaaccataactgatgagaatgctagacacgctgcaaataatgccattgtttcgatcgttgatgttgctgtgattaagcgtacattgtcagcatcttcaaatgtatcgtcagcatattttgcttctacgctttcaacttttacattgtgtttagatggggtaattttcattttgttgataagacgtcgagctaatggaccaccgactaaacctccagccactaaaccaaatgtagcagatgccattgccatttccattgcacctgcaagcccatgtttctctgcaaaaaccgttgcccaagttgcacctgtgccgtgtccgccagttaaagtaatagaacctataattaaaccaacaagtggatcaataccaagtagcatagctaaaccaacgccaacaccattttgaacaaggataaatatactcacgataacgaggaaaatgacaagtgggattccaccttgtttcaaacggggaaaatctgcggataagccgatagatgagaagaaggctaacatgaaagctgtacgtaaagagctttcaaattcaaaggtaattccagcgaatttatatagacaaaaaatgatacaagcgataaatgtctttttaaacagatatttattgtagtttttttgagttagatctgattttttatatgtaaattttggtaaaattatagcaattttatttttatgtgaggcttttatgagcgaaattgcattaacagtgagcctattatccttagttgctgtcattggactatggatagggcatattaaggtgcggggcgtaagccttggtattggcggtgtgttatttggtgggatactggtttcccattttatgacgcaatatggtgtcaaacttgatggtcataccttgcactttattcaagagtttggtctgattctctttgtctataccattggtattcaagttggtccgggtttctttgcttcattacgccaatcaggattaaagcttaatgcttttgctgtgatgattgttgggataagcggtattttagtgattttattacacaaaatatttgatgttcctcttcctgtgatattgggtattttctctggtgcggtaactaatacaccatcattaggtgctggacaacaaatcctgacggaattaggcggtgagtccattacagctgtgatggggatggggtacgcaattgcctatcctttcgggattatcgggattctattagcaatgtggcttatccgtattattttcaaaattaatgtggataaagaagccgatgagtttgattctgcaaccaacaataaaaaagatggattaagtacgatgaacgttcgtattacaaatccaaatttgaatgggttgatgcttcaagagtttcctgattttgaactgcacgaagtggtttattctcgtattaagcgtaatgatgagttgtttgtgcctaaagtgcatacccaaatccaaataggcgatattctgcatcttgtgggaacaaaaactgcgttgcataaaatgcaactcattcttggtgaagaagtgaatgtttcactttcgacaaaaggcacaatgtaccgcacagaacgtgctgtcgttaccaatgaaaaagtatttgggaaacaaattcgccaattgatgttaaaagggaaatacgatgtagtgatttctcgcttaaaccgtgcgggggttgagttagttcctaatgggcaaatgacattgcaatttggtgacgtgttgaacttggttggtcgccaagaagatattgaggctgtgatggcgattatcggtaacgctcaacaaaaattacaacaagtacaaatgttgcctatcttcattggtgttggtttaggggtgttactaggctctattccaatttatctgccaggtttccccgttgcattaaaattagggttagctggcgggccgttggtagttgcgttaattttagcaagaataggaagtatcaaaaaactctattggtttatgccaccaagtgcaaacttggcattaagagaaattggtatcgtgcttttccttgcggttgtgggttggaaagctggtggaaacttcctgaatactttattaagtaatgatggtctagcgtggattggctatggtgcaataattacttttgttccattaattgttacagggttagttgctcgtatttatggtaaattgaattatctaagcctatgtggattgcttgcaggttcaatgacggatccacccgctttggcatttgcaaatggtattaaagagggtaatggtgcagcagcactctcttatgcgacagtgtatccattggtgatgttctgccgaattatcttgcctcaaattctcgctatattattgtgggtagctggctaatcgtaactaagcaatctagttattgacagttcaatagactagattgctcaatttcaataaaacgcaataagtttccaacaatatttaggatccattcacgccatttttataggattataatttattttctatgataaataataggatgtcttaatcatggatttaacgttataatgagaaataaatctgttttttaatggaaatactactttatgtatcgcttaaccttttttttgatatctactttgctgtttaattcctccctctctgccaaatggctaaagatcaatgatgtagactatatctggggaccatttaaaatctataatatttcattattctctgaaactggcagttatactaatagcacacgcccattaatgctgactctaaaatatcaaaagcccgttgaagggcgtgattttgcaatttctttagctagatcttggtctaatttaggcatcactctgcaaaatcaagataatgtggttgatcgtttgcgtaaaattttacctaatatcaagaaagatgattctctcagttacattgctttagaagataaaggatatttcatattaaataatattgttattcctgaagaatttaacaaagaatttaatgacgctgtagtagcaatatggctagatcctcgtgtagaaattgggcgtaaacttgtcaataaagaagaaaaaaccttcattgcaaacatccctagagttttagagacacaaaaaccacaaaatatagaaaataatataggagtacatgaagaatcaatagatcctgtggtggactcaagcaaagtatctaatgatatcaaacaaaacttagactcttcaataatgcctagagtacaagataagcctttaactcagtcaaatgaagagaatatgaaagaagcagaaaaaccacttgaagattcgagcctctcccacaatttgtgtaaataactgtttctgagataatacattcagacacaggtattttattatgaacgaaaaacaacttcacgccttggcagcggaatttgccaaaaacctaaaaacaccagaagacctcaatcaattttcacggatgctcaagaaaatcaccgtcgaggctgcgttaaatggtgaactgaccgaccatcttggttatgaaaaacatcagcctagaaaaggtaaaaatgcacgtaacggttacacatctaagaccgtcatttgtgatgaaggtgagatagaaattgagacgcctcgtgaccgtgattggattgctgaaaatgaaggtgcgaagttctgggcaaatgtgctgacagagcttcaaaatcgaggcttaaaagacatttttattgcctgtgtagacggtttaaaaggcttcccagaagccatcaatgcagtctatcctaaaacgaagattcagctttgcattgtgcatttagtgcgtaacagctttgaaattcgtttcgtggaaagattacaaagccgtcaccgcagatttaaagcaggtttatcaggcctcgacggaagcacaggctcgcgaaaatctgaccgcactttcgcaaaaatggcaggcaaaatacccgcttgtggcgaaaggctgggaagataactgggcaaatattgccacattttttgattatccgactgatattcgtaaagcaatttataccacgaatgctgtggaatcgcttaatagcgtgattcgtcgcgtgattaaaaaacgaaatgtattcccgacggatgattccgttttcaaagtgatttggcttgcgattaaagatgcatcaaaaaaatggacaatgccgattcagaactggaaactggcgatgaatcgatttatgattgattttggtgatcgcctagacgatcaccattaagttgaaatgggtgtttacacagaatttgggatagggtcgaagattcagaaattgatatttctcctcctttagatcccataccagaaggcaaatatctaaatatatagctgattattaaagtgtttatagcatatataataaactcgacaatgccgattcagaactggaaactggcgatgaatcgatttatgattgattttggtgatcgcctagacgatcaccgttaagttgaaatgggtgtttacacagaatttgggatagggttaagcgctaatacttcaccgtatgcccatagctttcaataatacctttaatatgctctaacgattcttgcgtcggtggcatcacatcttctaattcatattctaaccctaaggttttccatttatgtgcgcctaaacggtgatatggcagaagttcgactttttctatgttgtccataccttgaataaactgacccaataaatgaatatcttcatcggcatccgtataacctggtacaaccacatagcggatccaagtacgttgattacgtttatgcaaataacgagcgaagtctaaggtacgtttattagagacaccgataaaatctttatgaatttcttcgttcagctgttttaaatcaagcataacgagatcggttacatctagcatttcatcgactagctctgaataattccgtacaaaaccatttgtatctaaacaagtatcaataccctcagctttacaagcacgaaaccaatcacgcacaaattccatttgtaacacggcttcgccacctgatgctgttactcccccgcccgttgctctcataaaatgtttatacgtcacaacttccttcattagatcttctacggagatctctttcccaccttcaagatcccaagtgtcacggttgtggcaatatttacaacgcattaaacagccttgtaaaaacaaaataaaacgaatcccaggcccatctactgtgccacaagattcgtaagagtgataacgtgctaaaacagtcattctttttcctttaaataaagtacgattaggacaaatgtccttaaacatttctgctaatcgcaattaatgcgtaagatacaataagcggtcagtttctgcaaaagttttgcaaaatctgaccgcttaattagtttaaactaaattacatcgactgtgtgaaagtacgagtaattacgtccatttgttgctctttagttaaagagttgaaacgcactgcgtaacctgaaacacggattgttaattgtggatacttctctgggttttccatcgcatctaataacatttcacggttcattacgtttacgtttaagtgctggccaccttcgatggttgattcgtggtggaagtaaccgtccattaagcctgcaaggttacgtttttgagattcaagatctttacctaacgcatttggtacgattgagaaggtataagagataccatctttcgcgtaagcaaatggtaatttcgccacagaagtcaatgacgctaccgcacctttttggtcacgtccgtgcattgggtttgcacctggtccgaatggcgcacctgaacgacgaccgtctggggtgttacctgttttcttaccgtaaaccacgtttgaagtaatggttaatacagactgtgttggtgttgcattacggtatgttttgagcttctgaattttcttcataaagcgttcaactaaatcaactgcaatgtcatctacacggttatcgttgttaccgaattgtgggtattcaccttcaatttcaaagtcaagtgctacgtttttcgctacgccaaccacttcgcctgctttatttttgatttcgatgtcgccacggattggttttactttagcatatttgattgcagagagtgagtctgctgcaacagaaaggcctgcgataccacacgccattgtgcggaatacatcacgatcgtgcaacgccattaatgctgcttcataagcatatttgtcgtgcataaagtgaatgatgtttaacgcagtcacatattgtttcgctaaccagtccataaagctgtctaaacgggtcattacatcatcgtaatctaagtattcagacataattggctcagttttcggtccaacttggtcacctgatttctcgtccacaccgccattgattgcgtataataaggttttcgctaagtttgcacgagcaccgaagaactgcatcattttacctacgatcatcgggcttacacagcaggcaatcgcatagtcatcgttttggaaatctggacgcattaagtcgtcgttttcatactgaacagatgaagtttcgatagacactttcgctgcatagcgtttgaaaccgtccggtaaactttcagaccaaaggattgttaagtttggttccggtgatggacccattgtgtaaagggtgtgtaatagacggaagctgtttttggttactaatgtacgaccatctaagcccatacctgcgaaagtttctgttgcccacattgggtcgcctgagaataattgatcgtactctggggtacgtaagaaacgaaccatacggagtttcattactaagtgatccattaattcttgagcttctttttcagtgattttgcctgcttttaggtcacgttcaatataaatatctaagaaggttgaaacacgaccgaaagacattgctgcaccgttttgtgatttcactgctgcaaggtaagcaaagtaaacccattgtaccgcttcttgtgcgttagttgctgggtttgaaatgtcaaagccataagatgctgccatttctttcattttgcctaaagcacggtgttgttctgcaatttcttcgcgtaattggattgtcgcttgaatatcttcgccacgctctaactgctcttgtaaagaggtaaactgttttactttatctttcattaagaagtcagcaccgtaaagagccatacgacgatagtcaccgataatacgaccacgaccgtaagcatcaggaagacctgtaattacgcctgatttacggcaacgtaaaatgtctggagtataaacatcgaatacaccttggttgtgggttttacgatattcagtaaagattttctctacttctggatttaattcacggcgataaactttacaagagcctttcaccatattgataccgccaaacggcataattgcacgttttaatggtgcatctgtttgaagacctactattttctctaaatctttgttgatataacctggtgcgtgtgaagtgatggttgatggaatatcgcaatcaatgtcatacggttcgtgggttttgttttccactttgattttttccatcacatctgcccaaagcgttgtagttgcttcggttgcatctgctaagaaagattcatcaccttcatacggcgtatagtttttttggataaagtcacgcacgtttacatcagtttgccattcacctggtgcaaaaccttcccacgctttcttttgagcttcggttagttgagtcattttaagtcctcgttagttaatgtaataaattggaacgcaagcggtgcgattttgcaaaaacactgcgaaaagtgaccgcttacaagttttgaattaatgtttttttagatgcaaaaaccactgcaccataccgatgaaaaatgcaccaccaacaatgttacctaaggtcgctggaattaaatttttcaccacaaaatttgccattgttaaatcagcgaattgactaggatcaacccctatcgctgtccaaaattcagggcttgcagagccgtgaattaacacgcccattgggatcataaacatattcgccacacagtgttcaaatccagatgccacaaacattgctatcggcaaaatcataatgaacgctttatccgtcaggctcttacctgcatacgccatccataccgcaatacagaccatcagattacagaaaatccccaagctgaatgcttcaatccaagtatgatggatcttatgttggactgtttttaaaatagtcaagccccactgcccatttgcagccataatttcaccgctaaaccacactaacagcacaataaaggtcgcaccgatgaaattaccgccgtaaacaacaaaccagtttttaaacatctgcgcccatgtaattcgcttacttgctttggcaacaatcgtcatggttgttgaagtaaaaagctctgctccaaataccacgcacataataatgcctaaagagaaaacaagaccgccaatgagtttagcgacaccccatggcatatccgcagccccaacttgggtagttgcataaaagacaaaagcaatagaaatgtaagcgccagcagtaattgctgaaatgaaagaataaaattggtttttggttgctttataaactgcgccatcttcggcgatttttgccatctcagcaggtgaaaacattactatccttaaacgaaaatttgaaaaattatagaaattgttgagaattatagacctgttaacctgatgattaaataatttttacgtttaaaataaataaagtagaattctttcttgatccatatcaatctttcaaaaaaagtacaatttttgaaaacttaacttaaacacaaatttaacaaaatagttacaaaatgaccgattatttgactgctttactcggaattttccttagcgaagagaatcaacttctcattatgtttgtcagcagctttttaagcgcaacaatactaccaggcaattccgaagtgatttttaccacttatacaacgcaaacactattacaaaaaaatacggtgtatggattattcgttgtagcgacattaggaaactccctcggtagtatgacaacttattttatcgctcaattttttccacaacctaaatttcatgaccaacaacataaaagcatcaagctcacgcttaaattgagccaaaaatatggtatatggattctattatttagctggcttcctattgttggcgatatcttttgtggtattgcaggttggttacgattcaacttatggaaaagcatattattaattactctaggcaaaggaattcgttatgcattgctactttggagcgtttatttggttgctggttaaggactaacagtctacaatatgaataaattatttttgatgagaaaagctatgtcaaccccccccccctgaaatcaaatctatctcagtaattgccaaaactcgcatttttgaagtgcaatccgtcgatttacgtttttcaaatggcaaagaacgtacttacgaacgcctaaccccacaacgccgttcttccgtaatggtcgtgccgatctaccaagatcaactcatcttggtaaaagaatatgccgtagggcctgaacgctatgaactcaccttccctaaaggcattgtggatagtggggaagatcctgtactgagtgcaaatcgagaattacaagaagaaataggttttggagcaaaaacaatcgaaccactgcgttcattgtatagcggtcctagccatatgtacggcttaatgcacgttttcgtggcacaagatctctatccatcacagctagaaggcgatgaaccagagccatttgaaatcatctattatccattaaacaaaattgacgaactgcttgccgaccctaattttgccgaagcacgcaatttatccgccttatttttattaagagaatacctcaatgcaaaaaactagcctacacattttatggatttatccactacttacccagttactcggctctgccctattacccctttttagcgaatttagccaagggggaatgttggttgtttttgtcttatttaccgtcccagcttttctatttgcattagtcagctacaaacaacagtatcaccaacgaaacatcattcaaattgcctttttctcaggggtaataatgttcatttacagccttttttcattttcactaatgttggcttttgatgaatacaccagccttgaagatcctatccccctatgggaacaatcccttgccgtgatcttatttgctctgacctttgctttagcaaaagtaatgtatgctctattggcgttgagattgtttttgccgaaagtgtaagtcgcttacattaatagaatggagatagacacttcgggtttaataatggcgagagttttttagatcattggttatccttatattcaagttaaggcagggtgagaaacttcctcctaataaatttataggtctctcctagataacgactaaaatccctatttaggttaagataacccaataagcaaaagttatctaagtcagtataaacaaaataaacttattgagctgtttgtagcagatatcactgctcgaacagctgctgagttgataaatgtaaataaagctaccgcagcctattatttccatcgtctgtgattgcttatcaagcaaaacagtctacatcttaagaggttcgatattcaagaacaagtgaagcccggcagtattgtttacaccgatttctaccgaaactatgataagtctgatgtaactgagtttaatcattttcgcatcaatcacagtacctacttcgcagaaaaacaaaaccccaaacgaaaaggactaagtccgatacaatatcgaaatcagtcctttgaatagctgtataacttttgaaggtcagatcattttattcatattttaaaaggtgatttgaagccttttaccataaaacttttggggctgtattagattagctagtataccaacctacatcagtcccctataaataaggttgtaagagcaaattacatttgccccaaaatgattgcaggaatgtcagggcgaatgttattcgcctctgcatttcatctacacaatctcactcggcgtaaagaaataggcaatttcacgttttgctgatgtttcagagtctgagccgtgtactgagttttcacggtagcctaaaccaaacattttgcgaatagtgcctagtttgcgttcttcgggtttggttgcccctattaacaagcggtagttttccacggcattttcgccttctaacaccgcaacaacgataggctcagaaatcataaatgccacgagcggatcaaaaaagtctttgccttgatgttctgcataaaaaccttccgcttgttctttggttaagtgaagcatttttaatgctttgatcgctaaaccatttttttccatataacttaaaatttcaccgataagatgacgtttagtcgcatcgggtttaataatggcgagagtttgttggatcacttgttgtccttattattgggttaagacagggtgagaaatctcaccctgagtaaatttatttcacctgcataccagccgtcacgccgctatcagcagagagcaagtagagatctgcaccgcctgtgccagcagataaaatcattccttccgacataccaaacgacattttgcgtggagcaaggttggcaatcataatcacaaatctgccttcaagctcttcaggttggctgtacgccgctttgataccagagaagacttggcgagtgtgatcgcctaaatcaagttcaaaacgtaacaatttatccgatttcggcacagcttcacatttcaatacttttgccacacgcagatcgagtttggcgaagtcgtcaatggtgatttcaggggcaatcggttcaactttggtttcacaagcggtcatttcttttcctttttttgcagtttctgcttttacgctttcggcgaaaagtgctttggtttcttcaatcacagcgtcaatctgttttttctctaagcgagagaagagcgatttaaacggtgcaatgttgtgggcaaatagcggtgaaccgatattgtcccaacgcagttccgtttgtaaaaaggcttcggcacgttctgcgagttttggtaatactggtttgagatagctcattaatacacggaatagctctaagcccattgaacagaccgcttgtaattcggcatctttgccttcttctttggcaattacccaaggggctttgtcgtcaatgtatttattggctttatccgttaatgccataatttcacggatcgctttgttgtattcacgcgtttcaaaataagtggcgatatgctccgattgtgcaacaaattcatcaaaaagcgcttgattttctagtgttgaagccagtttaccttcaaagcgttttgtgatgaaacctgcggtacgagaagctaaattaactaacttattgacgatgtcgctgtttactcgttgtacaaaatcttctaaattgaaatcgagatcttcaatgcgatcattcaatttcgcggcatagtaataacgcaaacattcaggatcgatatgtttcaaataagtactggcttgaatgaaggtaccacgggatttagacattttctgcccgtccaccgtcacataaccgtgtgcaaagacgtttgttggtttgcggtattcgcttccttctaacatcgcaggccagaatagactgtggaagtaaacaatgtctttaccgataaaatgatataactcggcatcactctcttttttccagaaatcatcaaagttcaagcccgtgcggtcgcaaagatttttaaacgaagccatatagccgataggggcatcaagccaaacatagaagaatttgttttcgctatctggaatttcaaagccaaagtaaggtgcatcacggctgatgtcccattgctgtaaaccgctctcaaaccactcttgcattttattggcaatttcaggttgaagcgagccagaacgtgtccacgctttcagcatttcttcaaagcttggtaggtcaaagaaaaagtgttccgactgttttaccacaggggtagagcctgacactaccgaacgtggattgattaaatccatcgggctataagtagaagcacagacttcacagttatcgccgtactgatcttccgctttacatttcgggcaagtgcctttcacaaagcgatcaggcaagaacatatttttttcaggatcgaacaactgcgagatcaccttgcttttgataaaaccattcgcttttaattttttatagatggcagaagtgtattcacggttttcttcgctgtgggtggaatgatagttatcgaaactgatattaaagccagcaaaatcagcaatgtgatcagctttggctttttcgattaactgtccaggggtaatgccgagtttatccgcattcaacataatcggcgtgccgtgagcgtcatcagcacagacaaagtgaatttcgttgccacgcatacgctgaaaacgcacccaaatatccgcttgaatatgttcaagcatatgccctaaatggatcgctccgttagcataaggcaaagcacaagtgaccagtatttttctttttggatttgacattctaaatctctctaaaatatagcaaaaaatcattgggattgtagcggaaaaggggggaattgtgtagttaagatttggggagatagggatttttcaacgctatttctggtgtttctcttatttctaaaagttataaataactaataacacattatcttttgaaaaatgaatttttcagataaaatagttctgataaggactggtgcaaagtaatcttcactatccgttaatgctcacctacataaaaattaattacgatcttcataaagagtattaaagcgagaaattactccacccaagtttcataaaataaattttttaaataagggatacaaattatgaacatcaaaaaatcaatattatctactatgcttttatcttctgctgtgttgctctcttcttgtaagaaagatggcactggcggaaattctccccaacataataaagaacaaaatccagttaattcgtcgataggtagccattttagtgctgaaagcagtggaactacaaataatggatttaataaactccctgacagacagacagacagacagacagacagacagacagacagacagacagacagacagacagacagacagacagacagacagacagacagacagacaatcataatgcacttacgtctcattcttccaatactaatcatcatttaaatacatctaacgattctgttttatcaaatacttcgataactccaaatctgccagctgctccagataattcaatgcctacagatagttcaaattcagcgacttctgatagtcaaaaaccatctgatgagcctaaggccgacagcccaagttctgctgagagttcaacaacttcaaatgaaccaatcatttcagacaatcaaacaacttcgaacgatccaacaacttcggacagtccaaattctacagataaacctagtacggaaaatactaacaatgaacaagctacagcagagacgacagataagcaagaagtagcaaaagaggatagaaaagaagaagtcgtagaagagccaaaagtagaacatcaagaacaaccacaaacagaaactgaaaaacaaccgcctagagaagaggaaaatccacaaacagaggaaaatccacaaacagaggaaaattcacaagcagaagaagatcctcaagctgatgaattgccgaaagttgaagaacagcctgaagccgaagaaaaggctgaagaggaaaaagaatctcaaagctctgaaattcaaactgctccagaaacccaaactaacagtaatgaaataccaataaataatgaaccgactaataatgaaccgactaataatgaaccgactaataatgaaatatcgagtaataatgatccaacaaataatattactcataatgataattcttctggagaaaatataaatcaagaaaataatgaaaccggcaaagaaaacagttccgaggattcgccttctttcaatcaagatttaactacaacaactccagaaaataataatttatctgctggaaatagtgatgataataaaaatactgatacggaaaataatgtatctggaaataattcggtagaaaataatgatgttactttaaatttaaataataattcagaatctacaactccagaaaataatccttctacgcaatctaattcatcaataaatcctgtggataatcagccttgggttaatcctgaagttgagagattagataaaaataattaccagaaaaccgcccaagaaacaaaatttactaatagaattgggattgttgatatggattttaatacacgtgatgatcttggcaaagcctttaaatttgagaatgggctaagtcgtatagttttaaatgcgggtttatatacgtcagcaaacggacataaaagctctcatggtacgatggttgctggtgttatcgatcagaaaaataaaaatgctacgctttatgcttatactgcaaaatccgcttatatggaagctgtaagtgcatctaatcagcattacaatgaagcatacgatcataaggttagaatatttaataactcttacggtaataatccacatagagatagtgtaaaagaaaaaggatgggaaaagttagcaggcttagacctatataagcaattggctgcaatggcagaaaaagacagtatttttgtatgggcatctggcaatgatggcaaaaaaagaaatacaggacagaatgaatatgcaaccatagaaggacacgttcctttaattagagatggagcaagaaaaggctggattgttgtaacctcggtaaatccacaaaataatgggcttatggattatgcgagccaaataggagataaagcaaaaaactgggggattgctgcacatggtgaatggtatttatttgataaacaagtacgaacagaaggaacttcttttgctacacctgttgttactgctgccgtggctaatgtttgggaaaaatttgattggatggatcatcatttagtgacccaaaccatattatccactgcaaataaattaaattcgtcagatgtgaccgaagaaccgaatgaacgtgttggttggggtattttaaatcaagatagagcattaaacggaccagctagatttgatacaaaacttttaaccgatgataataaaacccatgttgtagcaaaattagattataaacatcataccgaccgcactaaatacacttggtccaataatattcaaggtgatgctggctttaaaaaacaaggtactggaacactttattttactggttcaaattcttatagtggaaatacagttatcgaaaacggaactttggtaattggaaatgaattaaaacaatccacagtagaaatccagtcacagggaacattattaacgaaaaatttaaataactctcaaacagaagttaaaatagtaaaaaatgtagataataaaggttccttggaggtttatggaaaggggttaattattgagggtaattatactacttcaaataataccagaacggttattgatatagataaatctaaattaacagtaaaaggcaatgtcaatttacaaaattctcgtattgtagccgatgttgaaaatattaatgaagtggttaaaagagagcctcaaactaaaaccattattgagtctcaaaatcctatccaaaattataatggagattacaaaatatcggatcgtgctaccccttatattgatttaaaagaaattaaactcaataatgagaataaagaaattattgcaacctataaacgaaatgatacagaatttgtattaaatgcagctaatgaaagttcattaaaaaatgtctatactgcgagaagtttagatcttattttagatagggctagtgattcaggaaatacaaataaaaacctcagaagtgcagcattatcttttattaacgctaaaccacaagcggtagcttccgcagtagattctttaagtggcgaaatatatcccgcagtacatcaggtagcattaaatagtatcaagaccttgaatagacaaatcgctaaacagcaatttttaaatattcaagatattaagccttatcatatttatacccagttagctacacagaatttaaaactttatcagaatgatgattttggatttgccaatttgaaaaatagtgcagattcacaattagttggtatagataaacaatttaatgcctttacatttggtatggggttacaacgagttcatcaaaaattatctcctttatccagccaaaatcaacaggttggcaaggtggatttaaaacaacacagcctcgccttatacggaaaatacgactggaataaatggtattatctcagccaaatcagttttactgatattaaagggaaattagatagaacattgttattgcctaatggcacacagacaattaaagctgatttaaaattacaaaattattctttttataatgaaaccggattaaatctacaatatgaaaaattaagatttaatccatatgttgcgttacatattaaccgtttaaaacaggattccattaatgaaaaagaagatttagcattaagtattgataaatatcataaaacccattatggatatgaattgggcttaagattaaatcaatcattatctgaaaaatttaatataaatctagatgtttcttatctttataataagaacagtatggataatatgttaagtggaaaatatattgtttctagtactgaaacaaaattatatggaataagattgccaaaatatgaatttaaaactagtttaggtatgggctattatcttactgaaaacttcaatatttatgctaacatcgcttattatagattatggaataatccaatgaaatcctattacaaagaaggaaatattagtgcgaagtacaatttctaattgtaatctgataaacaaccacttgaaagcacattcatacccccgtggaacgcccacgggggactttttgcttaatcattgctatattctttattttcagactttggcaaaatgggcagtttttgttcatatttcaaaaagagggcttaaagccttgtactataaggctttaagccactttttagcaacaaatttgtctattacacattttttgccgaatcagaccgcttgttgtatggattatttatcgaatttctccccttccatcacattaatccgatattttatttatcaatacaagcggtgaaaagataatgtaaagaggaatgaaaaccacgcttcctataccccaaacaagaaccattccagtagcttcactatctaaagttattttttctgaatatgctataaattgtgtttgtagtggctgttctaatttggctttgttcagaactgcatcttgattttcaattttgaccaacttcccataaatgtcataaaactgttctgatgatttcttattatgtaaagaagtgagttttaccctagactcaatattaggtgttttcatttgatttctgatataaataatctctgctttagtaacagatttcattttttctgattgaataaaacgagaataaattcggtggttttccgctcttgataatcagcattctccttgttactgctttcaaattgataactatgcaaatctccgacaacatataatttattatcagcaataaaaaatgctcggattgtttctgtcttggcactttcattttgatactctgttttagtacaagcggtcataaaacataaaatcaagtagtaacagaaaaagcgttttaagatctgcatagtttttcccttatatcatctacgagagagttatcacatccggcaatttcaccaactgattaaacaataattctaccgctctttcactctgaacagtgacatttaacgtaatttccgagccattattttctacattgagtgatagcacttcaaacccacggtggcggattactctgagtaaacgctcaagggtttcagggcgtttattagctttgataacgaattgatattgttgcatttttcttctccttaaaccccaatatcttcatctaacatatctgtattgcacgcatttggtggaacgagtggccacacattttcttcatctgggatacaaacgtgcaataaatacgctcctttgctgttgagtaagcggtctaatgcggctgaaacttcccctgctttttcaatgcgttctgctggaatgtcaaaggcgttagctagcatcacaaagtctgggttgtcatctaaaatggtttgactgtggcgaccatggaaaaagagcgattgccattgacgaaccattcctaaacgttggttgtcgagtaacagaattttgacaggtaaattgccacgtttgattgagccgagttcttgaatattcatcataaaagagccatctcccgtaatcacaatggttggatccgttgggcgagctttgaccgcacccgccgctgctggcagaccaaatcccattgtgccgaacccagcagaagtgatgtagttttcaggggcataatgctgcatatgctgtgctgaccacatttggtgctggccaacgtcagtagtaataatcgcattttgaggtttgcgttgcgacagggtgtgtaacaatgcccaaggatcgatttcgccttcgcctgcattttcttgataagtaaaatcaaaatctgctttcattttacgcacatcagctcgccagttttcgatctctagcggttgagtaagtgcggtcactgcctcgattaaatctccctgcaatgccacatctgctttgcgtagcttgttgatttcagccacatcaatatcaatatgaataactttagcgtgcggtgcgaaggtatcaagtttgcctgttacacggtcgtcaaatcttgccccacaagcgatgagtaaatcacattcttgtaccgcatagttcgctgcttttgtgccgtgcataccgatcattcccatatagagtgggtgttgtggcggaattgtgcctaaaccttttaatgtggaaacagagggcacattggcaatttctaggaaagatctgaccgcttgcactccacctgccatacctacaccacctccgacataaagtacagggcgttttgcctgagctaacagggctttggcttgtgtaagtgcggttggattttgtgccttagccgccactttttcatagacgataggggaaagtgatgtcggggcgaattgcacatctttaggaatatcaacaagcacaggaccagggcgaccactttgtgcaatttggaatgctttggcgataatttcaggtagttcatcaatgttttgcacgatgaaactgtgtttggtacaagcaagggataagcctaatacatctgcttcttggaaagcgtccgtgccgataaaggctgaagccacttgccctgtgattgccacgataggaatagaatccattaaggcatcgcctaagcctgtaactaggttggttgcccctgggcctgaagtcgcaatacaaacgcctgtcttgcctgttgctcgagcataaccgatagcagccattgcagcaccttgctcgttgcggcaaagtagatgatctaaacctgaatcgtaaatcgcatcatagacaggcataattgccccacctggatagccaaaaagagaagtgacgccgtgagctttcaaacactcaacgaccaaatttgcaccgttcataaattaccttttaatgttgtgtcgctatttagttaaggcttttatacaataaaaaaaccctcactaaaactagcgagggtttgtggatctcattatacaattctaattgcgagccaacttaacccccgcggtgataataatcaccacgaggttaataataatcaggctaacaagagaacgtaatgtcattttcatttatcaataaaagctgaatggctatataaatagcatattttttgcataaaacaaatgaattttttatctctagatgaaaaaagcaaacgattagctttaaatagattaaatttacttgagttgtggggggctagggttgaaaatgttcaaattatcactatctaatcggcgattaacttctataaggaaatttctatgccattacttctctttttagctgggctatttttatacatctacattgaaatctctctgttagtaagcgtcggctctgctattggggttttacccttgattttattaatgatcactatttctgcggtcggtttgtggttagtgaaattaagaggaataatgaccataatgcagatccgccaagagatcgcacaaggaaagatcccggcacaagcggtcacctcttcgatcttttttgcaatcgcaggggtattgctgattatcccaggttttttgagcgatattttagcgttattgcttctattgccgataactcgccaattgctacaagcaatgtttatgaaactgtttgcaagtcgtgtgaaatttatgtcttttggctcaatgaacagaacttcctctcaaaataatacaacgtttgaagcggaatttgagcataagcaagatgaagataagtggttgaaataatgataaatttcataatgatacatatcaaagattcacgacatataatgagattcaaaaatcaatatctgaggtctatttctcctttcgcaattgcgataaaaaagagtaaaattagcctttattttgacaagagagaaacaaaatggcaaacattcgtttagcaattgcagcagattttttattagccgagaaattattagaagccttagaacaaagtagtttagattttgaacaaatttcagccgttgaattggaaagttttggcgaagaacattctctgcgtttcggtgcaaaagctgttgagcaaatcgctgttgaagatgtcaattggtcgcaatttagtcacgttctctttgcaggcaaaatggcaaatgctgaattgctggctcaagcggtacaagcaggttgtgtgattttagatctctacggcatttctgcattaatcggcaatgtgcctgtgattgtgccaagtgtaaacaatgaaatgatcgccaatgtgcgtgagcgaaatattgttgcgttagcaaatccacaaatcagccaattagcacttgccttaaaaccgttgttggaccagcctattcaacatatttttgttacatcactattgccatcggcctattttggtgatgaaaaagtgcgtgagttagcagggcaaactgctcagttgttaaatggtattccccttgatgatgaaaaaccacgcgtggcgtttgatgctgtgcctgccaatgtgcaaggtgatgaaaaacatctgccgttctctcgtgcctttgagttacaacttgcaaaagttctgccaaatctaaccgctagtgtgactttccattccgtgcaagtgcctgttttctatggtatttcacagatgatcagggtgcaatctgagtatgctttagatgccaccgcattaagtgagcagtggcaacaacaagcgtgggtaaaatttaactctgacaatgtggttactcctgttaaaaatggcgaagatgaagaggtaaatctcttacaaattagccaactactcaataaaaatgaaaacgcactacaattctgggcagtggctgatgaacagcgttttagcttagcgttcttggcggtggagttgttgaaagaagtaatcactagctattaacatagtcggatctaaaaatacaaacatttgatataccatcactcaatcacatagcaatatattctcgtagatatggaacaaaattcttctttaactcagattctggtagctactgctgctattgtaattattttggcgggtattaaattatccgttgagatcgttattcctttcttattatctctttttattgcaattatttgttctcctattatcaaatatctaacctctcataaagtccctttgtggctggcaatcactatactccttattctatttttacttggattcttttttctggcaggactaatcaacagtacagtacaagaatttacagcatcaattccacaatacaaaattcttctatctgaacgtattgctgccgcaatgctccttgttgataactggaatatcccggtttcaatatctcgtgaacagatccaagaacagctagacccaagcattattatgaactttgttagtcgcttattacttagcttctcaggcgtcgtcacaaatatttttgtactcttattagtcgttgtgttcatgttatttgaggctccaaccgctaaacataaacttatcgtggctcttagaggcaataaagatgtggaatcggaagaaagccatatcaaccgagtattacagggagttattagctatcttggtataaaaacgattgtaagcctgcttactgggatatctatttgggtgttgcttgaaatagctgatgtacaatatgctgtattatggggcacattaagcttcctactcaactatattccaaacataggttcaatcattgctggtgtacctattgctgtacaagcatttctattgaatggcttttctgttggattgggagtatccgtcggtatcattgcaatcaatatggtaattggcaatattctagaacctagaatgatggggagaacccttggtctctcaactctcgttgtattcttgtcactacttttctggggatggttactcggtacagtaggaatgctactttctgttccattgacaatggctctcaaaattgcattagaatcaagccctaaaacgatccattatgcaggcttattaggagatattaataaacgctaatgctcttatttttgcgctttaaatacattaaataacctatatgtttcttatagcactcaacctaaatatttttaacatctacgcaaacgattgccttttggtttatctttgtgtacaatcttcgaccctttaatcatactatatatttattgaggtttttccattatgtctcttctttctcgttttcaactggcagaacgtggttctaatgttcgtcaagaggttattgctggtttaactactttccttgcaatggtttactccgttatcgttgtgccaaatatgttaagtgcggctggctttcctgctgattcagtatttattgcaacctgtttggttgctggtttaggttcaatcctcattggcttatgggcaaatgctccaatggcgattggttgtgctatctcattaacagcttttactgcattcagtttagtgctaggtcaaggcattagtattcctgttgcattaggtgcaatcttccttatgggtgttttatttaccattgtttccataacaggtatccgtgcgtggattttgcgtaatctgccatctagtattgctcacggcgctggaattggaatcggcttattccttttattgattgcagcaaatggcgttggtttagttgttagcaaccaagcgggtttacctgtaaaaatgggtgagttcacttcttttcctgtaatgatatctttagttggtttagctgctatcattggtttagagcgtttacaaattaaaggttctattctttgggttatcattgcaattacaatcatcggtttaattttcgatccgaatgtgaaatttggcggtgaagtatttaaattacctacctttggtgaaaactctcaattcttaaatttagatattgtcggtgcattgaatgcagctattttacctgtggtctttgccttagtaatgactgctatttttgatgcaacaggtaccattcgtgctgtagcaggtcaggcaaatttattagataaagatggacaaattatcaacggtgataaagcacttacttcagattcattaagtagcgtactttcaggtttatttggtaccgcgcctgcagcagtatatattgaatcagcagcaggaactgctgttggtggtaaaacaggtttgactgcggtcgttgttggcgtgttgttcttattaatgcttttcttccaaccactcgcatttttagttcccggttatgctactgcccctgcattaatgtacgttggtttattaatgttgagcaatgtatctaaattagactttgatgactttatcggtgcaatgtcaggcttagtttgtgctgtgtttattgttttaactgcaaatatcgtaacaggtattatgttaggttttgcaaccttagtgattggacgtaccatttcaggcgaatttaacaaattgaacgttggtacagtagctattgctattgcattagttgcattctatgcctttggttttgcaatttaagtcctcaataaagatattttcctctttttaagaaaaatatttaacagaaatagctcattgtatgaaagataggatactaaatttatcccaacatcatccttagatactagaatgaaatagaaagtcaaacgcctataaatagaatctattcataggcgtttttatcacactacatttatcaatgtaatttctattattttactttttgtagcttatggtatgcatctagtaatttttgatgagctgacatattcctcaaagtttcatcagaaccaattaaaccatggaacggattttctccctgcactatattccaaacaaaatctacagcatctttcccatacattctgttaaatatcattctatactgctcaggttccctatcctcatccaaaaataattcaattacactaattaaacaacgatagtaattgtttctttctgctgaaaatacggaagcattcatattaactgtccaagttgcccaatctaatgcctcttcaagatttcctaaagccaaatgaagcatagattttaattcaccaatacgtaaagtttgtagtgcgcttcctttttcagctaccactccaataaattcacgtacccgcgtcatatcatcaataccttgctcatccagcacgtccaatagctcttgataaatttctttctcatgatggaaatagggtaaatcaagcaacatttcacgccattccattcccatattattattcgcatagatcaaatcgtcaggaggataaatattagacattccaggagcaattatacggcaagcgtatacacctaaatgttcatagtccataatataaacctcttgcttatactggctgaaaatttccatcaaattagcaaattcctgctctgttgtgcctgaaaaatcccagtgagtaaattcataatctggttctgatttaaaaagatcccatgaaatctgaccacttgaatcaataaaatgagtttccaaattcgcataatctgccacatcatcattattaaatgatggtggagaaaacacatccaaatcttttaaactacgcccctgcaaaagctcagttactgtacgctcaaatgcgacttggaaattaggatgagcaccaaaagaagcaaaacacgtaccattcctaggattaagtaaaactacacagataactggaaattcgccacctaatgaagcatcatagcagagaatcggaaacccttcttgctccaattgctcaatcgaacgtttaatcgtcggataaccatcaataatacactgcggaatttcaggcaagctgattgcctcagtgataatacgatttttgataaagcgttcaaatacttccgatagtccctgcactctggcttcattcttagtgttgccagctgacatcccgttagatacaaataaatttccaataatgctttgtggaatatatacagtatgaccatcagactgacgaatataaggtaatgcaactattcctcgttctgaattgctagactgtagatctaccagaaattctggtgtcaattctccatttggattaaaatagtcgtgtagaaatggatccaatattccttcaggtaattccgtttcattttcaataggaaaccatttttcatttggatagtgaacaaattcaccttcagcaatttcccttcctaaataaaaatcagcccaaaaataattagtcgataaacgctcaaaatactcccccaatgcggaagcaagagctgctttcttacttgctcctttaccatttgaaaaacattgtggacaatcaacatcacgaatatgtactgaccatacatttggtacaggattaagccaagaagcctcctcaatattaaatcctaattctttcaacttagtctggaatctttcgatgctttcttcaagggctgcatctttccccacaataaaggttttttctatcattttttctcttaaaatgaaacggttttactctatttatataggatgtagacattggaaaccaataaagaaattcataacaacatcttaaatctcttctaccagttagaataaattgagcggaaaatttccgcccaattcatatgttaaaaatccattaattctttctctttgtctgctaaaatctcatccacttttttgatataaatatctgtaatcttttggatatcatcttgagctttacgctcatcattctcactaatctgtttttctttctctaaagttttaattttatcatttgcatcacggcgaatatttctaattgaaactttaccttgttctccctcaccttttacaattttaattaaatctcgacgacgttcttccgttaatggaggaagaggaacacgaatagtagttccagccgaagaaggatttaaccctaaatccgaagttaaaatcgccttttctaccgcactaatcaacgaacgatcaaatacagtgactgctaatgtacgagcatcttctgcgacaacattagctaattgacgtaatggtgttgcggacccgtaatattccacttgaatagcatctaataaactaggctgagctctacctgtacggattttagaaatatgtccttttaaggcctcaaggcttttttccattcgttcttgagtatctttcttaatttcattaatcatagtattttcctttgattgaataacataaacctattgattttacccaatttcattctattttcctagtactaagtttatagggtttgtggtagacttatttgacttaactcatcacaagagggaatccttatgtaccaacaacaaattttaatagaattacaagaagcgcaacaagtattaaatgactttattaatgaccaacataatcttaaactaattcaagaagcagctttactgattactgatagttttaagaacgggggaaaaatactttcctgtgggaatggtggctcacactgtgatgctatgcattttgctgaagagttaactggacgttatcgtgaaaataggcctggatatccagccatagcaatctcagatccaagccatttaagctgcgtaagcaatgactttggatatgaatatgtcttttctcgttatgttgaggcaatcggacaaaaaggagatatcttgttttgcttatcaacatcaggaaattctaaaaatgttattaatgcaatcatagctgcaaaagccaaaggaatgaaaattattgcaatgacaggcaaggatggaggaaaaatagcagaactagctgatattgagattcgtgtacctcattttcgttatgctgatcgtattcaagagatacatattaaagtaatccatattctcatgatgttaattgaatttgaaatggcaaagtaaagaataaaaaatccaacttaaataaatagttaagttggattaattcgttgaatagcgttaattaagcaatcgtcgtaccttccgttgtacccgtcacaacttgtttcaacgcaccagctttacccatattaaatacacgaattggcatattatggtcacgggcaagagtgaatgcagctaaatccatcacttgcaattctttttcaataacttcagcatagcttaaatgttgataaagttttgcatctggattttttgcaggatcgcaatcatacacaccatctactttagttgcttttaagacaacatcagcttcaatttcaataccacgcaagcaagctgcagagtctgtagtaaagaacgggctacctgtacctgctgagaaaatcacgacacgtttttcgcgtaacattttgatagcttccgaccagttgtaagtatcacaaataccgtttaactggaatgcagacattaattttgcattgacatcagcacggtgtaaggcgtcacgcattgctaaaccgttcattacggttgcaagcatacccatatggtcgccgacaacacggttcatacccgctttagcaagtttagcaccacggaataagttaccgcccccaagaactacgccgacttcgacacccattgcaagcaattctttgatctctaatgccattctatctaagatagatgggtcaataccaaaaccttcttcaccttgtaatgcttcaccacttaactttaacaaaatacgtttataaataggattgctcattttgacctctgtgtaacggttggggaaaaaaatcgaaatattatagattatcttaagaacagatcaaagtaggcaagcggatagaatttccagagcctctacccacaatttgtagtaaataactgtttctgagataatacattcagacacaggtattttattatgaacgaaaaacaacttcacgccttggcagcggaatttgccaaaaacctaaaaacaccagaagacctcaatcaattttcacggatgctcaagaaaatcaccgtcgaggctgcgttaaatggtgaactgaccgaccatcttggttatgaaaaacatcagcctagaaaaggtaaaaatgcacgtgagataatacattcagacacaggtattttattatgaacgaaaaacaacttcacgccttggcagcggaatttgccaaaaacctaaaaaacaccagaagacctcaatcaattttcacggatgctcaagaaaatcaccgtcgaggctgcgttaaatgatgaactgaccgaccatcttggttatctaaaacgaaaattcagctttgcattgtgcatttagtgcgtaacagcttgaaattcgtttcgtggaaagattacaaagccgtcaccgcagatttaaagcaggtttatcaggccccgacggaagcacaggctcgcgaaaatctgaccgcactttcgcaaaaatggcaggcaaaatacccgcttgtggcgaaaggctgggaagataactgggcaaatattgccacattttttgattatccggctgacattcgtaaagcgatttataccacgaatgccgtggaatcgcttaatagcgtgattcgtcgcgtgattaaaaaacgaaatgtattcccgacggatgattcagttttcaaagtgatttggcttgcgattaaagatgcaccaaaaaaatggacaatgccgattcagaactggaaactggcgatgaatcgatttatgattgattttggtgatcgcttagacgatcaccgttaagttgaaatgggtgtttacacagaatttgggatagggtcgaatttccactttattttcggtaaaatcgctatccctttattttcgttttgctcataatgaatataacaaagatactcgctactctcattagttttggtttatcttatttagcaagttacctaatgttacttggctcaggcttttttcctactcctgaaatcagcaatgtgctactgctggttctcgttattttatttgctaatgcctctaaaaaagcgttcttttatctgcttttaccgattgtcactttatatgccctttacacgccagttggcttgacctttggcccaccatcgtaccaatacgttgcttcggtttttgccacagatatacaagaaagcaaagagtttttcagccaaatccccctgattaactttgttgcttgtactggcatttttatatcactgttaggttttcgttttattagccaaaaatggcaaattcagttccacaaaaataaaacctttcttgccttagggattgcattagtttttatctctactccgcccttcaaatttctacaagaaggaagtagtgcaattagtaaagtaaaagcagaattagaccgcttgaatagtatgtccattcaaagtgaatggagaacgtcgcaactcaatgcggaaagccgttacgatgattacattttagtgatcggcgaaagtgccagaaaagattatcaccacgcctatggctaccctgctgaaaatacgccgtttatgagcagtgccaacggcattttaattgatgggctgaccgctggtggaacaaataccattgcttcattaaaattaatgctcactaagcctgatactgaaaagtgggaaggggaatacagccttggtatgatcgatttgattaaatccgcaggaattaaaacctactggctatcaaaccaaggttatcttggtacttttgatacacctgtttcttcccttgctaacaaaagtgacgaaaaattattcttaaaatcgggggactctttccatcaaaatatcagtgactttgatttattgcctaaatttgaacacattattgagcaaaaaactcatagcaaacgttttgttgtggtgcatttatacggttcacaccccatcagctgtgatcgtttaactgattaccctaaaatgtttgatgatgaaaaaataggcaaaaagtatttcaacgtaaactgctatgcatcgtccatcaaaaaaaccgacgaagtgttaaaacgcttatatgaaacccttcgcaaaaatgagcaacaatctaaccgctcgttttcggtggtctattttgccgatcacggtttagctcaccatatcactgaaaatgacattgcaatccacaacagcagtggcaaaagtaagctacactttgatgttccgctctttaaaatatctagtgatgataccgatagaaaagtctataaagcgatgaaatctggcttaaactttaccgatggcattgcaaaatgggtgggaattagtaatccgaaattgaatacagaagtcgatttatttagtcctcattcagacaaggaagattatgggctaaaaaaattgattgatggttttgaagggaaagtggatcctgctgtggttattcctaaggatgagtaattctatatcccaaaatgattttctgacagcataagtgcccatagtaatacaataattaatttagccatttaaaaatctagacgtttagatgtctaaaatttcttgacgaaacgatttcctattcgtaaacttgaaaccattcaaagacaagcggtcgcttttttaccgttttttgcaaggattttatggcacagcagattactctttttgatgatattccccttgagcttgctttaggcggaacactttcgcctatcaatgtcgcttaccaaacctatggcacattgaacgctgaaaaaagcaatgctgtgctgttgtgccacgccttaacaggcgatgctgaaccctattatgcaccgcctgcggataaaggctggtggcaagattttatcggtgcaggattagcttttgacaccgataaatacttttttatctgctcgaatgtgcttggcggttgcaaaggtacgacaggcccttcgtctatcaatccaaatacgaataaaccctacggcagtcaatttcccgttatcaccgtgcaagatattgtgaaggtgcaaaaagccttgatcgataaactcggtattactcagctacaagcggtcgtgggtggctcttttggtggaatgcaagcgacacagtgggcgattgattatccggaacaagtgagaaatgtggttaatctctgttcttcgcttaccttgagtgcagaagcaatcggcttcaatcacgttatgcgacaagcggtgataaacgatccccattttaacaacggcgattattatggcagtacgcccccagataacggcttaaaaattgcccgaatgctcggtatgctcacctaccgcaccgatgtacaacttgccaaagcctttgggagagaagtgaaacagacgggaacgatttggggtgatcacttccaagtagaatcttatttaagttatcaagggctcaaatttctagatcgctttgacgctaatagttacttacgcctgttaagagccttagatctctatgatcctgctttaacctatgcaaacgagcaagaagcactcagtcgcattaaagcgaattacacccttgtcggcgtaacgagcgatcaactgtttaaacagattgacctacacaaaagcaaacagcgtttagaaaatgcaggcattgccgtcgatttttatgaatttcattccgactttggacacgatgcatttttagtggattatccgttttttgaagagatgattaagaaaggaatctccaagtaggtcgggcatttatgcccgacaagctcatcccttttatatctaaaaacatagaaattgtaggagatataatgcaataccgaagactttatcaaccaggagcacaatatttctttaccgtagtcacctatcaacgccgcccaatattaacaaacgctgatgtccttcacactcttaagaccgctataaaaagggtacaacaaaaatatccttttaaaattaacgcattagtaattttacccgatcatttacatactatttggcaattgcccgacaatgattcagacttttcaatgcgttggaatcaaataaagcgttatgtaagtcaccattgccaacattatgacaatatagaaaaaaccaacaatgaactaagaaagcgacaaagtagcatttggcaacaacgattttgggaacgctgtataaaaaatgaagaagatttcgaaaaacattttgactacattcactataatcctgtaaaacacggatacgtttcatcagtaactgattggaaatactcaacctttcacaaatacgttcatcaaggtatttatccaaaagattgggctggggttaatcaagattttgattatgagtagtgctatatttcgggatgtcgggcataaatgcccgacctacccttctaatttatttagttttgaatagcgctagatttcgagatgtcaggcaataaatgtccgacctacccttttaatctgtttggtaaaacagactgaaacagctctctgcttttcagcggtgctgatcccaaataaggctttaaagcaatacgggtgaaacgttttgccgattgtaaggtttctttctctgaaaaatccatttccgcaaaagctaataaatccttgccgataaaggtatagttattttgtaataaagaggcaataaagccttcattttctctaaattgatagctcatttttggatcgacaggcttacctgttgcggcacaatggcaaaaatccaccccataacctaacgctttaagtgtttgaaattcaaaagtgcgtaagatcggttcgatctcgtttggctggcttgccaactttgtcatacactgtagataatgctgaaacaattcagggtaagcggtatgattttccaaaactcttgcaaggacttcattgacataaaaaccgctatacagtgccagcgtttgcatcgggagggttaaagatgcaggttcagctttggtaagtgttttgagatcgcctttgctcgtccatttcagcagtaaaggggtaaagggctggagaatggatttcaatggcgaacgtggtcgtcttgcccctttggcaagtaaggtaattcgcccgtgattttcagtaaaaaaatcaacgagcaaactgctttcactgtactctctgcgatgtagcacaaagccacgttgccactgttcgatcattattcgtcaatatagcccaaacttcttaacgcacgttcatcgtcagcccagccggctttgactttcacccacagctcaaggtggaccttattatcaaacaagcgttccatatccgcacgagcttcagtgccgatcactttgatcttctgacctttgttgccgatcaccatttttttctgcccttcacgttccactaaaatcaaaccattgatttcgtaagtgccacgctcgttagttttaaactgctcaatttcgaccgttacagagtaaggcaactcttcacccataaaacgcattaatttttcacggataatttctgacgccataaaacgttgcgaacggtcggtgacataatcttcaggatagtgatgaatgccttcttttagtgactcacgcacaaatttctctaaaatatgtacgtttttgccccgttgagctgaaatcggaatgatctctttaaacgggaatttctgcgataaagcggtcagatgtggcaataattcttctttttccttgatattatccactttgttaatcgctaaaatcacaggggctttggtcgagcgcaatttattgagtaccatctcatcatcatcggtccacttcgtgccttctaccacaaaaatcaccatatcgacatcaccaatcgcactggctgccgcacggttcatcaagcggttaatcgctcgtttttcttcaatgtgaagccctggggtatcaacataaatctcttgatacgccccttcggttttaatccctaaaatgcggtgacgtgtcgtctgagctttgcgagatgtaatcgaaattttctgtcctaaaattttgtttaatagcgttgatttccctacgtttgggcgaccaacaatggcaataaagccgcaatatgttttttgatctgtcattgtgttctcttaaataaatacaaattgaaatggtgggtcaagagccaccctgcattaggctattttattcccaacacctttatcacctgcaatgccgcatcttgctcggctttgcgacggcttgtgccgttaccgataaagatttcatcaactttttcgactttacaactgactttaaaagtttgattatgggcttcgcctttaatatcaatcacttcgtaagttggtaagggtagcttacgcccttgtagatactcttgcagacgagttttcggatctttttgtgcttcccctagttgcatgtcatttagaagttgctgataccaacaatgcacacgttccatcgcccgatcaatcccagcatctaaatataccgcggcaataatcgcttccacacaatcggataaaatagactctcggcgatagccaccactttttaattctccagcccctaatttcatatattcgcctaactcaaactgacgagcgacaaccgcaagggtctgttctttcaccaatgccgcacgcatacggcttaattccccttcattcgcttttgggaatttttcatatagggctttaccaatggcaaaatttaagatggaatcgccaagaaactcaaggcgttcattatttttggaagcagcactacggtgagtgagggcttgggtgaggtaatcaaggttagcaaattgataacctaattttttctgtaatcgttctagttgcattttagtttatcttcgtggaatacccccctttgaaaaggggggctagggggattttgctaacattgaataaaattcaccctttaaaaatcccccttaatccccctttttcaaagggggaaatgttctctttatttaatcgccgtaaacattctctcaaaacgtaatccgcttggaaattcattcggtttcttatcaaggcttaaccaaataacacttgctttaccgaccatattcttttcagggacaaccccccaaaaacggctgtcttcgctgttatcacggttatctcccattacaaaataatgcccttctggcactacccattccccagcaggaataccgtcttgtttgaagaaataaggctcgtagttaaaagcgtgcggattatttaaaatttggtgggtaacatcaccaatttcagtgcgttcaacttgcatttcaccgtggtagaaaaagtcaggatttggtgcactgccttcgtatttaaacaccacttctttgcctgaatcgccgtgaacaacggttaaattacgggtatggaaatcatatttcacacggtcgccaccaacacccacaacacgcttaatataatcaacgtgtggctgttttggagctttaaataccacaatatccccacgttcaggcttacccatcggaacaagcgtattttgccaaattgggtctttaattccataagtaaatttattcactaacagaaaatcacccacgcgtaatgttggctccattgaaccgcttggaatttggaacggctcaaaaataaatgaacgtaaaatagtgactaatgctaacaccccaaatagtgacgcaaaaaaatcccccactaatgaacgaggttgaattgtggctttttcttctgctgagagcggtttgcctaaacgcttttcttcacgctcaatcgcacgcaagcggcgaggttcggcactaaatttgtaaaatgaccaaaagccaccacaaataacgactaaacctactaatataatggaaatcgtgtttggcaattgcattgagtccaacactttccaaacaccgtacaatactgcaataaaactaatggttaaaatattgctcatatttaaaattcactccttttggaatttatttactatccaaaatgtagggacacactgagtgtgtccattgcaacatttatcaatagaatagatatgaatgttgtaggcggacacactcagtgtgtccctacaatatctattcactaatccttcccaacgtgcaaaatcgctaagaacgcttcttgtggcacttccacgttacctaaagatttcatacgttttttaccttctttctgcttctgcaacagttttttcttacggcttacgtcaccaccgtaacatttcgccaatacgtttttacgcaactgcttcaccgtcgaacgagcgataatatggttaccaatcgccgcttggatcgcaatatcaaactgctgacgtggaattaactctttcattttttccactaactcacgaccacgataaggggcattggctttgtggacgattaacgctaacgcatcgacacgctcgccgttgatcataatatctacacgcaccatatctgccgcttggaaacgtttgaaaccataatccaacgacgcataaccacgcgaagtcgattttaagcggtcgaagaaatctaacaccacttcacccatcgggatttcataagtcaatgcgatttggttaccgtggtaaaccatattcgtctgtacaccacgcttctccacacataaggtaatcacattacctaaaaactcttgtggtacaagcatattacattctgcaatcggctcacgaatttccgcaatatggttaatcgcaggcaacttcgacgggctatctacatagacaatttcgccattcgtttgttccacttcatagactaccgtcggtgctgtggtaatgagatccaaatcatactcacgttctaaacgctcttgaatgatctccatatgcaacaagcctaagaagccacagcggaagccaaagcctaatgccgttgagttttctggctcatagaaaagcgacgcatcatttaagctcaattttgccaatgcatcacgaaacgcttcataatcatctgagctaatcgggaataaacctgcataaacttgcggttttacttttttaaagcctggtagcacttcgcttgcaggattgtgatgatgggttaaagtatccccaacaggtgcgcctaaaatatctttaatcgcacaaaccacccaacctacttcgcctgttttcaattccgtagtatcaacttgttttggcgtgaaaataccaagacgatctacttgataagattgtcctgtactcatcactttgattttattgccttttttcaacaccccatttttgacacgcacaagggaaaccacgcctaaatagttatcgaaccacgagtcaataatcaaggcttgcaacggtgcatcaggatcgccttcaggggctggaattttcgccacgatttcttctaaaacgagatcgatacccacgccagtttttgctgagcaacgcaccgcttccatcgcatcgatcccgacaatatcttcaatctcttctgcaacacgctcaggatccgccgcaggcaagtcaattttgtttaaaatcggcaccacttccaaatccatctcaattgccgtgtaacagttagcaagagtttgtgcttccaccccttgtccagcatcaacaaccaacaacgccccttcacaggcggctagggaacgagaaacttcataagagaagtcaacgtgtcctggcgtatcgataaagtttaactgataggtttgaccatcttttgcttgataatttaaggtaacactttgtgctttaatggtaataccacgctcacgctcaagatccatagagtctaacacttgagcttccatttcacgatctgacaaaccgccgcaagtttggatcaagcggtcagataaagtcgatttaccgtggtcaatatgagcaataatagaaaagttacgaatgttctgcattttcataagggcagtaaatgtcctattgtattgttattgataaaagaaaaataatcggcggattgtacctgaaaattacaggaaagggaaaaggaaaggagaatattagaatgaaaatttataaaatagagaaaaatctagacctagtaaacgactatagccttcaatataaggctatagtcaattttatagcagctatttttctgcttatctaaaatacttgactgatgtagttaagtcttttactagtgtttaactattaaaagtatacaagaattctagttatttttctcatcagacatacttaccgctgcggtaaataatacgtccgttgatgagttaagtgctgtttcagctgagtcttggataacaccgataatgaagccaacgccgataacttgtgctgcaacatcgtttggaatgttgaataagctacacgcaagtgggattaataataatgaaccacccgctacgcctgatgcaccacaagcacatactgaagcaacaacacttaataatactgctgttgagaaatctggtacgataccttgagtataagccgcagctaatgttaatacggtgatggtaattgctgcaccagccatattgatgttagcaccaagtggaattgcgatagagtaaatttcttctttgatgcctaaacgttttgctaatcccatatttacagggatatttgccgctgagctacgagtaaagaatgctgtcacaccactttcgcgtaaacaggtgatggtgagtgggtatgggttgcggcgaattttccaatacactaataatgggtttaggataaatgccacaattgccattgcacctaacaataccgctaataaacgtgcataaccgataaaggcatctgcaccgttggttgccatggtttctgctactaagccgaacaccccgattggagcaaaggcgattaccacttttaccacgaaagaaacagcatcagagatgtcgtttaacatgactttggtgcttggtgctgcgtggcgtaatgcgatacctaaaccgatagaccacgcaagaataccgatgaagttaccgttcgtaattgcaccaagtgggttatcgactaagttgaaaacaacggtttttaatacttcaccaacgccttgtggcggtgcaagcccttccgggctggtaacaagttcaagtgtcgttggaaataaatagcttaaaataaccgctgttactgctgcaacgaaagtacctaagacatacatcactaagataggttttaagcggctatcgctgccaacttctttgttagcaatggaagccattacaagaacaaaaactaaaatcggtgcaattgcacgtaatgattttacaaagaattgtccgagaaccccaacgcttttggctgcatctgggctaactaatgctaagcagatacctagcactaaacctacggcaatgcgtaatactaaattaccgccaaggatttttgaagataaagattggttactcataaaatttcctgtaagacaaataaaaaaaagacttcatttaccaaggtaaatgaagtctgcgagattagccgaaaatgtagaataagggaatagcaagcggcaatttttctgcaaaaatttttaaaaattagaattttaagaaaaaacaccttaaaaatttaataaaaatctccgagaaatgataataactattaaataaacacctgttctgtcacttgataaccttgcggaacctctgctttatcatcaaaggttacaaattcccaagcattttcattcgctaacacagctcgtaataatttattgtttaagctgtgacctgatttataggctttgaaatcacctaaaatattgtagccacacataaataaatcaccgacagcgtctaacattttatgacgaactagttcatctttaaaacgtaacccttcttcattcaaaatgcggtattcatctaaaacaattgcgttatctaaacttccacctaatgcaagaccaatagattgaagatattcaacatctttcataaaggtaaaggttctagcacggcttaattgttgaataaagtgttgtgctgaaaattccattttgtagttacgcacttctttggtaatcattgggtgcgtaaagtcaatagtaaagtctaatttcagaccgtggctataaggtttaaactcagcccacttatccccttcttctactcgtacactttctttaatacgaataaattttttcggcacatcttgttcttcaatccctgcatctaataagagatagataaaaggacttgagctaccgtccataattggaatttcggctgcatcaacttctacaattaggttatctaaacctaacgcagacattgctgcatttaagtgttctactgttgaaatacgtacaccttcatcgttgatcatacaagtacaaagttgtgtatcacggatagattcagcacttgcagggaagtaaacgacaggatcaagatctgttcttgcgtaaataatccctgtatgtgcaggtgctggacgcaacgttaaggttactttcttgccactgtgcaagccaatacctgttacttttgctgcttgtttaagggttctttgtttaatcatatcgtttccttatttcccgaaatggttattgaccatttctcataaaccctgggattgagttcggcgaaaagacctgcgctgtatcaactttctgtggtcttggagctgtttgctgaacctgttgtggttgctgagacatttgatgcgttgtatattggttttggtttgggtaaccgcccatattatttataaattcaggctgacgagcaccgccaaatccgttattaataatagattgttgcggaatatcggttcttccttgcacacttggaatttttggcatttcttctggttgtccgatacctgtagcaaccaatgttacacggatcttaccatccatttctggatagaatgcagaaccaaaaataatagctgcatcaggatctgcgaagctagtaacatattccataatggtattgacttctgcaagttcaatatcatagccagaagaaatattcacaagaatgcctttagcacctgataaatcaacatcttccaataacgggcttgctacagcttcttttgctgcattttctgcacggttttcaccctctgcaatgcctgttcccatcattgctctacccatttccgacatcacttttttcacgtctgcaaagtcaacgttcacaagaccttcggaagtaatcatatccgtaatacctaataccgcattgcgtaagacgtcatttgcaacgccaaaggcttcattaaattttacacttttaggtaatacttttagtaatttatcattttggataatgatgagtgaatccacatgttttgcaagttcacggatcccttgttccgcatagttagaacgttttctaccttcaaaagagaaaggtttagtaacaataccaactgttaatgctccttggcttttagcaatttcagcaattacaggagctgcaccagtacctgtgccaccacccataccaacagcaatgaagaccatatcagcacctgtaagcatattcgttaatgcttctctatcttcttcagctgcttgatgaccaatgtttggatctgctcctgcccctaagccttttgttacacttgcacctatttgaatcgtattgcgaacggcactactacgtaatacttgtgcatccgtattaaccgaaaagaattcaacactaccaacatcagattggttactaaccatatgatttagtgcgttaccaccaccgccaccgacaccgataactttgataaccgcatcttgcgttgcttcataaataggttcaaacatttgtgattctccctcacggcttaatattgttattaatgcctattaaaaacttgattttatccaattatacgcttttttagcactatgacctaatgtatcaataatgccgcccaccttatgactaatttctccactttggctactatcaacgtcattataatgactatactgtagcaatcctaatacggttgcataagaaggtttgtttacataatccgttaatcctgtaatgttcaatggattaccaactcgaacttgagatccaaagacagattttgcacattctacaatatcttcaacctgagagccaccacctgttaatacaattccagcaattaattcttgttttatgcctttttgatatagttcattgcgtaattgggataattcctgattaattacgctcagtaaatcgtggtagcattgagatgtaacattagataattggctttttgtaaaagttcttggcattcgtccacccaagcctgccacctcaatttttttctctggaaaatgagttgggggtgcaatagcacatccatactgtactttaatattttctgcatcttggcgagaggttgtgaaaacatgagcaatatagtccgttacattattcccaccaaaaggaataactttactaaaacgcaaagcaccatctgtataaacaagaacatccatagtgccaccgccaatatcaattaaacaaaccccaagttctttttcatcttctgttaacacagaataacttgaagcaagccccgaaaaaacgatttgatcaatttttaatttacttctctccactgcattttttaaattacgtagccaatcgttatggcaagcaattaaatgagcttgagcctgcaaacgcataccagataaaccaaggggatttttagtagcaggtaatctatctactctatattcctgaggaatgatgtgtaatgtttccagcccatcgggtaatttaatagaacgagcaatatgaatagcattatccaaatcttcatttcttacactaccagacaacggcacagttccactttcattaaaagctgtaatgtgagatcctgaaagggcaagagtaacacatacaatatcatatccagaaatcgattcagcttcttcaatcgcacgttgaatagcacttgttacagcatctaaatcaacaacgccaccaccttgaacacctttagacgggctaattccagagccaatcacattaatcaccccatcaggcaatacctcacctaccacagcaactatcttgtgtgttccaatttctaaacctactctaattctagattctgctacttttgtcatattaattatgtttgcaagttaataaattattgattattaaatccaacggaagccccgtgttcataacgtaaatctacgtaggataaacgtttcccctcaggaatatcaatttcaggaaaaatagtcacaaaacgatcgattttgggtagccattcccctcgccctaattttagttcaacgccattatcaagtcgaattgaccaagctcctcgactatccattgcaatggaatataatcctaaattacgtgattttaaatctgcttttattttatcccaagcctcaagcacaaccttactttctgtgtctggtccgtataaaataggtaagcctgtgttatcaaacctatctttcggcaaactgaacactactccatgttcagaaacatactgactattattccatacagccattggacgatgttcaagtaacgtaatacttaatttatcgggataaacttttctcacagaaacattactgatccaaggaattgttagaaatttctctttaatttcttgaatatcctgttcaaaatagccttttaacaagggttctttagctaaaacttcacgaatatcattattcgtcgtaaattgtgttttatgcgttaatgcataagaacggattggcgttctatccagtgatgcaagcaaactagaccaattggtataaattgcataaaccataccgaaacataataacacaacgataggcttaacaaaaacaaaccaattaatcggatatttcggcttacttgcttgtgtacgaattaccgaagtcggtttcttacgtattaccgcaaccattacgcacttaactccaatacacgctcaactaaacgctcgaaactataacccacagtcgccgctgattttgggaaaatactatgactggtcatacctgggcaagtattcacttcaactaaacggaagtttccttcgccatcttccattacatcaattcggctccaaccacgacagcccaccacatcataagcctgtttcactaacttagcgacttccgcttggcgatcagcatttaacgctggcacaacatactgggtattatccgaaatatattttgcgtggtagtcataaaactcgccgtctggaataatttgcaccgcaggcaacacttcaccatcaagtactggcacagagtattccgcccctgctaaattttcttccaccaacacaattgaatcatattttaatgcttcttcgattgcaggtaataactgttctgcggttttcactttgcttacgccaacacttgagccttcactcgcaggtttcacaaataatggtaaacctaattttgcaataatttcatcggagttgaccgcttgcccacggcgtaccacttccattgccgctgttggtaagcccactgcattccacaatagcttggtgcggaacttatctaaagtaatcgccgaagccattacgccacagcctgtatagggaataccgagttgctctaacgccccttgaagcacgccattttcaccaataccaccgtgaagaatattaaatacacgctgaatgcctttttcttttaatttttcaatcggaaattcttttgtatcaatcgcttcaacgttataacctaaactttgtaatgcttcaaacaccgatttgcctgaattgagcgaaatttcacgttctgctgaaacgccaccaaataacaccgcaattttttcgttttttaagctcattatttttaccttatttatgttttacaagcggtcatttattgcaagaattttacattattatggggaattgtagggacacactgcgtgtgtccgcaaaataaaccatatcccattttaacaacggacacacagtgtgtccctacagttaattcattgaaattattgcaaattttcggatttaccgtaggagagaattacattcgccctgatgttactatgattatttggggcaaatgtgatttgcccctacacattattttgtacaattacacaatagcgaaaatttctcgaaatcttatcgcttgttttaaatcttctttatgccttccaactttccgctaaatcacgcgaaagcttgctcacgttgcccgcaccttgtgccaaaattaaatcaccatcttgaataatttgatctaacacttcgccaagttgtgaagtatctgacactaaaatcggatcaactttgccaagattacggattgaacgacacagatctttactctctgcccccacaatcggtgcttcacctgcggcataaacattgagcataatcaatgcatcaacctgcgacagcacttgcacgaaatcgtcgaataaatcacgggtacgagaatagcggtgcggttggaataccattaccacacgtttattttcccagccttggcgagcggctttaatcgtcacatctacttccgttgggtgatgtccgtagtcatcgactaacatcaccttaccatttggacgaataaacgaacccaactggtcaaagcgacgacctgcaccttggaaatctgcaagagcagccaaaatcgcctcattcgcaataccttcttcttttgcaaccgctaatgctgccgttgcattcagtgcattgtgtctacccggcacgtttagtaagatctcaatacgctcacccgttgggcaaaccaccgtataatgcccttggaagcctgtttgttgataatcttcaatacggtaatcggctttttcactaaaaccatagctaatcacttggcgaccaacttttggggcaatttccatcactgtttcatcatcagcacacatcactgctaaaccgtagaatggtaagttgcgtaagaaacgtacataggtttctttcattttctcgaaatcgccaccgtaagtatccatatggtctggttcaatgttggtcacaacagaaaccatcggctgtaaatgtaagaatgacgcatcactttcatcggcttctgcaattaagtaacggcttgcacctaaatgagcatttttacccgctgattttactaaaccaccatttacaaaagtaggatctaatcctgcttccgtataaatcattgaaatcattgcggttgtggtcgttttaccgtgagttcctgcaatcgcaataccgtgacggaaacgcataatttctgctaacatctgcgcacgttgaatcacaggaatacgtgcttcttttgcagccgcaacttcgggattgctttcattaattgcactggaagccacaacaacacttgccccttcaatgttttcagcttgatgtccgataaaaacttttgcacctgcttttgctaagcgttgcgtgactgcaccatcagcaatatccgagcccgaaatttgataaccttcatttaataatacttcagcaatcccagacatacctgcgccaccaatcccaataaagtggatttgatttacacggcgcatttcagcgactaattttttaactttatcttggaaatttttcatttttattccttatattcgatcattttgcaaaaaaactacaaaatctgaccgcttacaaactattttccacaatcacttctgccactcgttttgcggctaatggtgtggctttcgctcttgcttttattgccatttccgtcagtttttgacggtcggcaattaacggctctaatgcttttaataaactttcaggggtaaaatcctgctgttcaataatcattgcagcacctacttgtgcaaggtactctgcatttaaaaattgttggcgatctttatgttgaaacggcacaaaaatcgcaggcaatcctgctgcagcaatctcgcatacagttaaagcaccagaacggcaaatcaccaaatccgcccattcataagcggctttcatatcatcaataaattcgctagcaatgccgttacctgttgcttgataaacttcttccacaccggctaatttgcctttgccgacttgatgactaataaatacgttttgtcctaacactttcgctacttccagcacggttttattgatcaccaatgccccctgactaccgcccatcactaagatattgatcggatagcctttttcagcaaaacgttgttcaggcggtgcaatttcaaatagatcttggcgaacaggatttcccaccacttccgcatttggaaacgccgttggaaatgcttgtaaagtacgtcgagcaattttagaaagccatacattcgttaaacctaccaccgcattttgttcgtgcaaaatcacaggcacaccacataatttcgctgcaataccgccaggtccggatacataaccgcccattccgagtactgcatcgggcttgtacgcgttaataatttttttcgcttgaagtaccgcccttaagatcgcaaaaggggcagtaagtaatgctttgatccctttgccctttaatcctgaaatttgaataaactcaatcggaataccgtgttttggcacaagatctgcttccatacgatctttggtaccaagccaacggatttcccagccttgttgttgtaattctcttaccacagcaatcgccgggaaaacatgtccgccagttccgccagccattaccaataatttttttgtcatattattttccaatattaatcatcgctgaaatgtgcatgaccaattcgatccaagcggttttcgtaatcaatccgaattaataccgcaattgcaatcgccataatcactaaacttgaaccaccatagcttaccaatgggaaagttaagcccttggtcggcagtaaccccgaagcaacaccaaggtttacaaagccttgaataaaaatccaaattgcaataccaaaagcaaaaaaacctttaaatcgctcttctaacattaacgcttcccgactaacctttaaagctctaaaagttaaagcgagtaataatagcacaacgacaacaattccaactaatccaaactcctcagcaataacagccattacaaagtcagtgtgtgcttcgggtaaatattctaatttttgtacggagttacccaagcctcgtccccaaatctcaccttgcccgaaagccatttgtgagttagatagttggaaaccatcgccataagcatcagcaaaaggatccataaaagaagttacgcgttttaagcgatattccgatgttaaaactaatagagcaaagactacaacgcctgtgataccaagaaaaataaactgtaagactttcgcccccataataaaaagcattgcaaatgtcagcacaaaaagcaccgctatacttcccaaatcaggttgagccagcaacaagcagctaaataaaatcaggattaccatagggcgaatgaaactaatgcttttttgtcgtatttcatcaaattttcttacatagaagctcgcaaagtaacaaatcaccgcaaattttgctaattctgcaggctggaaattaataggaccgatagggatccagcgtgttgctccatttactgtttttccaacaaacaatgtaattgcaagcagaagcaaggctgaaataaataaccaaccattatacttttcccaatatttacttggaatttgaacaaagaaagcacaagcacaaatagatgcgataacataaaaaccatctcgcaccgcaaaatagaagggatcttcgtgtagccgactactcacaggaatagaggctgaagtcaccataacaaatccaatgatcagcaatgcgagaaataaccacaccaatgttcgatcatagagtgcattaacaggcgttaatcttgtccacttatcccactcaatccgaattttttctagcattagataaccccttgagccaacgccacaaactgtctgccacgctcttcaaaatttttaaactgatctaaacttgcacaagctggtgaaagtagcaccatatcgcccgcttttaatcttaaacgaatttgtgcgacagcttgtgccattgtttccactaaaacgctattttgagttaaagcggcgagttccgccccatcttttccgaagcagtaacagactgtatttggttgattaataaaaggttttaactcagaaaaatcagcatcttttccgtcaccgcccaacaacagataaagcgttccttcgacttgcaaaccatttaatgccgccacagtactgccgacattcgtggcttttgagtcgttaatccagcgtacgccatcattcgtcggtactagctggaaacggtgatctaatcctgaatagctttgtagcgctttcacaatacccgaacgatcaacgcctgcagcttccgccaatgacattgatgctaaggcattcatcacattgtggcgaccagtaattttcagctcatcaatcgcaatgacggcttcatcgccagaatagagttctccattacaagcggtatattctgcgtctttttctgcaaattttttcaaagatccgaccgcttgttcagggaaagtttgcggatcttcgccattcacaattacattttcggcatggtgataaattttcaatttcgcttggcgataatcttcaatgctctcatagcgatccatatgatcttcgctgatatttaaaatggtcgccgcttttgcttttaaagaataggtcgtttcaagttgaaaactcgataattccaacacataaagctcgtaatcgcctttcaataaactcaatgccggcacgccgatattgccacccattccaactttaactccggcttgttttgccatttcagtcgtcaaagtcgtgacggtacttttaccgttcgagcctgtaatcgcaataatcggcgctttggcttcacgacagaacaactcaatatcgccaaccacctccacaccggcttgaatagcttgctgaatttccggtgtcgctaaggcaagccctgggctaatcacaattaaatcggaacttaataaccactcaaggtttaaactgcctgtgtgtagtggaatatccttcgacaacttatccgcccctgcaggatttgctcgggtatcaatcactcgcacttgagcctgtttgtccgcaaaaaattcgacacaagataagcctgttgtgcctaagccgataattgtgatagttttgccttgatattgattttgcattttgttgttctctagaaacggtattttcagatgtagggacacactctgcgtgtgtccgctttattttcattattcctcggttggtaaaactgtaatggacacacgcagtgtgttcctacattaattaacgtaacttcaacgtcaccaatccaattaacactaacattaaggtaatgatccagaaacgcacgataacacgtggttccggccagcctttaagttcaaaatggtggtggatcggtgccatacggaaaatacgtttttggcggagtttgtaagagccaacctgtaaaataaccgataaggcttcaaccacaaatacaccgcccatcaccactaataataattcttggcgaactaacacggcaattacacccaatgcaccgccaagtgacagtgaaccgacatcgcccataaaaacttgtgccggataagtgttaaaccataagaaacctaacccagccccgacaatcgccgtacataaaatcactaattcaccgctatatttgatataaggaatgtgcaaatattgtgcaaaattatagttccccgttgcccacgcaattaatgcaaatgcccctgcgaccataataagcggcacgattgccaagccgtctaagccgtcggttaaattcaccgcattacttgtaccgacaatcacaaaataggttagaacaatatagaataagccgagctgtggcatcacatctttaaagaaaggaacaactaactgggtggccgcggtatctttaccaatcgcatacataccaaaagcggacactaaggcgatcaccgataaccaaaaatatttccaacgagcaatcaagccatcggtatttttacgagcgattttccaataatcatcaacaaaaccgacaaccccatagccaaataggataaatagcacaaaccagacataggggttacgtagatccgcccataacaacgtactcacaccgatagcgaataaaatcataataccgcccatcgttggtgtgccccgttttttgtagtggctttcagggccatcgtggcgaacttcctgtccgaatttgagaatttgtaaacggcgaatgaccgtcgatccaatccataagccgataattaacgccgtcaataacgccataatggaacggaaagtaatgtacgacaccacgttaaacgctgtgttgtattgcaccagatattcagcaagccacactaacataagctaatccttaaaaagaaacatcaaaagaacgacataaggaagcaattacctcttccattttttggctacgagagccttttgccaaaagaacaagcggttggttttgctcgattttttgcaaaataatcggaagcaaaaacgccgccattgcggttttgtcattaaagtggtgagttgaattaccgctaatcacctcactctctttgccgaagctgaccactaaatctaacttcgcctgtttaacgaaatcggcgacttcttgatgacaagcagggctgtctttgccaagctccgccatatctcccgccacaaaaatgcggaaagccggatactgttttaacactgataccgcagatttcattgaatccacgtttgcattataactgtcatcaataaacagcacattctctttaatttcaatcggatacaaacgccctttaaccgctgaacgctgttctaatccagctttaaccgcagttaaatccgccccgactgccattgcgagtgccgttgctgctaacgcattacttacattatgttcgcccaaataaggcagattgatctcaatttcgccttgtggggtatgcaaagtaaagcgtgaaccattaagatgtagttcaacattttccgcccaaaaatctacataactgtctttatcttcgcctgtgtaacagaacgattgcaactcgtgatcgccaatctctttttgccattcagggtagtaatgggctaaattcacaatcgctttaccgcctgttttcaagccacgataaatctcgcctttggcttgagccacgccagccaatgaaccaaatccttcaagatgagcagatgccacgttattcactaaacaagcatcaggttgtgctatttcggtggtgtaagcaatttcgccgatatggttcgcccccagttccaccacggcaaatttatgctcaggggttaaacgtaataaggtcaatggcacacctaaatcattgtttaaattgccaaaagtataaagcacctgatcttcacaagcggttactttttgcaaaatttttgcagtcatctctttgacggtggttttgcctgaagagcccgtcattgccacagtttttgggttaatttccgctttcagccattttgctaactgccctaatgccaagcgagtatcttccacaataatttgcggtacattcaccgccaattcacgctcaacgactaacgccacacagccttgttctatcgctttttctacataatcgtgagcatcaaatttttcgccttttaatacaaaaaataaacctttttcgaccgcttgacgcgtatctgtactgatgttttcagcaacaacctcgccactaccgagtagtttaccctttagggtttgagcgagttgttgggtggtttgttttatcatctttatttacttataaattatttttactatttaaaatctacttttgtaggggctaattacattagcccctcttccttatgattgcttttggggcaaatgtaatttgcccctacaaattattttgtgcaatagattaaattccaactaccccaaaaacttcctcgcccactcttgatccgaaaaatgatatttcttcgtgccgataatttggtaatcttcgtgtcctttacctgcaattaaaatcacatcttttggttcggcttgggcgattgcttgttcaatcgcatattgacggatatgcatagactgcaccgcttttggcttgcggaaacctttcataatatcgttaaaaatcacatcaggatcttcggtgcgtggattatcatcagtcacaatcactctgtccgccaactgttcggcaatacgagccattagcggacgcttacctgtatcacggtcgccaccgcaaccaaacacacaccatagttcgccttcacaatgcaaacgagcggcatctaaggctttttctaaggcatcaggggtatgggcataatcaacaatcaccatcgggctttcttccgcattttctttgctgattaaacactccatacgtccgcatacaccgtttaacagcggtgcggtttcgactaatttttgcaaatcgtagcccaaagccaataaaccagcgaaagcggttaataaattgctgacattaaacgccccgattaaacggcttttgagttcgccgttgccccagctactttcaaattcaatggttgcaccttgtagggtaaattgtacggctttggctttaatccaacgggcttgttgtggttgaaactggctatcggtgctgacagcgacggcctcaggcaattttgctaaccatttacgcccaatttcatcatcagcgttgattacttgttgttttgaagaaagctcgccaaataagcggagcttcgcttgggcgtactcttccattgtgttgtgataatcaaggtgatcacggcttaagttagtgaaaatcgccaagtcaaagtctagcgcttcggcacgatattgagccaaaccgtgagaagagacttccattgcacagaaatccgcccctaattcgacaaagttcaccagattgtgttgaatttcaacggcagaacctgttgtattcaccgcttcttgcacttgcccatatagtccgttgccaatagtacccatcaccgcagatttaccgccaagcaagtttcgccattgtgaaaaaagctgtgccgtagtggttttgccgttagtgcctgtaatacccacaagggttaatttttctgatggattgccgtaaaaggcacctgctatcgccgaaagttgtttcggtaaatttggtacttccagtacacaagcggtcgaatttgcaaatttttctgcaaatctcaccgcttgaacgtcatcgtccgcttcagctaaaactaaagaagcaccttgttcaatcgctttttcaataaattgacgaccatcgacttgatgtccttttaaggcaacaaatagatcacctttttcaacctgacggctgtccaaggtcattttgtttaattcttttaattcgccccaatggttaagttcagggaaaaaggaaagtaaagggttcattattgcctcttagtttgtcgaatttgttttcatctctctcactgcactttttgtatcttcagtaagattatctggtttaatgtttcttgcttttaaagtatgtcccataatgcttgagaacagtggggcagataccgcaccgccgtaataattgccagctttaggttcgttgatcaacaccactagtgcaaagcgtggattacttgcaggcgcaatacctgcagtgtaggcaaaatattttttaacgtattgccctttttctaacttacgggctgtacctgtttttaccgccacacggtagccatcaaccattgctcgttgtccgccttcgcctttttgcgcaacgctttccatcatcttcacgacatcgcgtgttatcttttccggtaatactcgatcgcctaacacaggcggatcgacttttgtaatagaaagagggcgataaaccccaaagctccctaaagttgcataagcgcgagctaattgcaatggtgttacatttaaaccataaccatacgccattgtcgcacgttcaatatccgcccaacgtttacgatcgccgtttgtaccacgttgttcaccaagccctaagcctgtatctttaccaaaaccgaccttgctataagtttcgactaatgcggttgatggcattcttaacgctaaacggcttacacctatgttactggatttttgtaagatccctgtaagtgtcaaactctctcttggcgctacgtctttaattgtatgcccattaacgacaaaaggtcttgtactaatgacttcacttggataagtcactttattttgtagcgctgtcaataccacgagtggttttactgttgaacctggttcaaaagtatcggtaatcactcggttacgcgctaattctgatttgaattctgcacggttatttgggttaaaagatggtgcatttgccatcgctaacacttcacccgtttgaatatccactaaaacagctgttcctgattctgccttattttcaattaccgcttttttgatttcacggtaaaccatggattgcaattcttcatcaatgctcaacatcacatcttgcggatcatattttttctcatcacgaatatgttcaatcacattaccacgagcatctttacggataacctgtttaccgtttttaccaaccaacaagctatcaaagctacgttctattccttccgagccttgtttatcatcaacatcggtaaagccgattaattgggaaatttcttctgcaagaggataaaaacggcgagtttctgcttttaatacaagcccatcaatttttaatgctcgagcataatctcctatcacatctgattcgtgacgagaaatatataaaaaacgttgatttgctgaagcataaagtttatccatcattacgctgtatttcatatctaatgctttggctaactcttgcattttttggcgttcaagctgagcatactcattttccaaatgtaaaaacatagaatttggattattgcgtatgcgttgaattaatacgttgtaatctaatgcagttgcacgagcgagtaatgtccaataatcctcatttttattgtttaaaatcgctctaggatcatatttattttctttattctgtggtttttctttaataaaacgattcacactagcttcaattttactggctgaagcctccatttccatagccaaaactcgccataacgatttattacgacgaagtttagtatcaaaatattctttaggatcaatcgtaattgaatacatcggcacactaattgaaagcactcgcccatttctatctaaaattttcccccttgtaaaaggaagctcttttgtccgtaaagagcgatcatttgcttctttgattaaacgttctgaatcagtgacttgtaagaaaaaactttgaccgatcaaggcacaggccattacaccgataaacagataaacaaatccaaatcgggcaggcaaaaaactaggctggggtgaaatatctacctcttttaattcatctcccatcgtatttttatttttagggttatatttcactgattttttcatttttattccactaaaatgatttcttgttcttttttaactggttgtaatccaaatttttcagcaacagcttcgactaaaaacttctgactttttgaattttcttctaattgcaaatgaacatactgattttcaagcttctgttttacttgcaataattttccctgctctgctgttaataaacgtgtttggtgcgtaatccaaatcgttgcaacagcactaatcaccaccccaacaagtagcaataacgccactttattatggctagttaaatcgtctaaaatcacttgacgtaaaggatagcgttcactcgacattatcttttctccgcaactcttaacaccgcactgcgtgagcgtggattggcttcaatctccgcttcacttggcataatcgctttgccgacggtttttaaaggaatattcttatttaactcactttctaaaatcggcagacctttcggcaccgtctcgcctttgctctgcttacgcataaactgcttcaccattctgtcttctagagaatggaagctgataatagacaaacgcccttcaggtgccagtacagttagggctgaatttaatgccttttctaattcatctaactcactattaatgtaaatacggattgcctgaaaagagcgagttgctgggtgtttatgcttatctttaaacggcacggcatctgcaataatttgtgccagttgcaaagtacgggaaattttttcagttgcagatttattgtaagaaacgaccgcttgtgcaatgcgtttggcaaaacgctcttcgccaaactcttttaacacccaagcgagatcatcaacagacacctgtgctaaccactccattgctgacaagcctttggtggtatccattcgcatatctaatggtccatcacgcataaaactaaaaccacgttctgcttcatcaagttgtggggaagatacgccaagatcgagtaagataccgtcaattttgccgactaaattaagttcgtcacaaatatcaggaatagatgaaaaagcactgtgaacaatttgaaaacggggatcagtgatcgtgttcgcttctgcaatcgcacgcggatcacgatcaatcgcaatcaatctaccctgttcacccaatttgcttaaaataagacgtgaatgcccaccacgcccaaaagtaccgtcgatatagataccgtttggtttaatggctaaaccatcaactgcttcgtgtaataacaccgtaatatgtttgggtgagtcactcattttgattatccgttattgttataaagaaaggttctttaatgcctcacaatgaagcatttcttctgagctaccaattgcaagatcttcgctaatctgtttctgccattgttgatcttgccaaatttcaaatttatttaactgcccaaccaacataatctgctgttctaattgagcgtgctgacgcaaagtcgggctaagtaaaatccgtccagcagaatccatttcacattctgtcgcaaaaccttgcataacccgttgaatacgacgctgtgcaggatcgaagttagacagagcgagcaatttttgctcgacaatttcccattcgtgcaacggatacaataataaacaaggctggcgaatatctacggtacaaacaaatgacccgtggtaactctccaaaagctcggcacgataacgggtcggaatagcgatccgccctttgctatcaatgctgattgaagttgctccacgaaacatttttttgctcacttaaccttagagattcggaaatttggaaaaaattccacaaaacaccactttttcccactttaattgaaggattttatagttttcgtagattaggggcaagaaatttgtcagaaaaatacgaatatatttaattataaatagaattcattacccgcagcaaaaacaacaaactactttacattgcctcaaaatcaagcaaacgaaaacatttgtaattgttgtaaaacacagtacatttacttgtaaacgtttttacaataggagagctttttaagcttatttacatgaaaaacagagttcggtggaatcatcaatttagacaaagttcgttctgacaaagtatatagcttaaatttaacgctatggaagcgcaattggtattggttaggagtaacacctagggctacaatttacctatcgtaagcaaaatagtaatttgccaacgctctatttctgtacggataaaaacgtcaatatcttagttgaaagccagttttaaattgtagcaactgtgtttacacacaaaaaagttattcaattttgacccacagattctgtggataagtagcgtgtagcgtcccatttttcattgcgtctaaccaacgcattcataatggttagcagtttacgcatacacgccataatagcgactttcttcgctttgccttttgcaaccaatcgggtgtaaaaggctttaaaaacaggttcaaagcgaattgccgatagtgctgccatatataaggcattacgaacaatcgctcgaccaccatagcaaaaggattttcctttccattgaccgctttcctgtggatgcggaataacgccaacgagtgaggcaattcttttgctgcttagcttgcctaattccggcaggcttgacatcatcacggcgacgcaatttttgccaacgcctttgatgtctgagataaggtcagctttatcactaaaatgcttactttggtcgtcgatatctttatcaagttcggcgattaatttatcaagcatttcaatgtgttgttggatattgtccaactgggtttcgtggctttgttgcaaacgatttagctctgctactcgcatatccacaagctgacgacggcgaaccacaagggcttccagctgttcttcttgctcagaaagcggaacatacaactgatgctctacttcgcctttaagctcacaagtgagcccatagaaagcgagattaaccgcatcttttgcatcggttttggctctcgtttgagattttgcaaactcactggctttcagtggattagcaataaatacacgataacctgctcgagcaagggcttttgccacgggaatttctaatccacccgttgcttcaagcgttatcagagccacattaaactggcttaaatagtccaaggtatgttgaatacctttggcgttattggtttcggttttggtctttttctgatgggaaaaaccaatcacgaaattgcgtttagcaacatcaataccacaataaatcggagcgttcatcggtaacctgccttgtcttcgggtttatatttcaactgttcggttttgctgatgaagttatccacgcctacgctacagaacgagttttagctctagggacacccaagctgtggataacgttatggtttatgttgctagtttactataattttaatatacaagggatagggactatccgcttcgatctctatttccttgcctttgaccaatctaacgaggaaacaagcgaaaatcccctcttacataacttttcttaaaattagctgttgtgcagctgctacacaacaccagataaaatcttatttaaaacaaattgatctcgtcgccctattcctttattccctaactttctctataatcctaatcctcttatgttctttaaaatctggtggaattatgaacccaatgttaaatatcgctattcgtgcagcacgaaaagcaggcaatattattgctaaaggctatgagcaagcgcctcaagacactcaagttgctcaaaaaggcgcaaatgactatgttaccgaaattgataaagcagcagaagcagccattattgaagtgatccgtaaatcgtatcctgatcatgctattgttggcgaagaatcaggcgttttagctggcacaaataacgatgtacaatgggtgattgatccattagatggtacaacaaactttgttaaacgcttgccacattttgcggtgtcgattgctattcgtgtgaatggtcgtactgaggtgggtgttgtatatgatcctattcgtaacgaattatttaccgctgtgcgtggcgaaggtacaaaattaaatgaattccgccttcgcattagtaatgaacgtcgtgatttacaaggcacagtgttagcaacaggtttcccgtttaaagtcgcaaaacatcgtactgctcacttaaatatgattgaagccttgatgaacaatggcgtagcagatttccgccgtactggttctgcagcattagatttagcttatgtggctgctggtcgtgttgatggttactttgaaatcggattaaaaccgtgggattgtgctgcaggcgatttaattgctcgtgaagcaggtgcgttagtgaccaactttgttggtggtacagattacttaaaatcaggtaatgtagtggcaggtagcggtcgtgttgtaaaagaaattttaaacagtattcaaccgaccttaactgaagaactcaaagcctaataatagatttttttgatgggcagttgcccacccaacgattaaagataagcttatgcaaaagacctatccattgctcagtcaaatcaactcacctgatgatttgcgtttattaccaaaagataaacttcaacctctttgtgatgaactgcgtgcctatttgttagagtccgtcagtcaaacaagcggtcacttagcctctggattaggcgtggtcgaattgaccgttgccttgcattatgtttatcagaccccattcgatcaacttatctgggacgtaggacaccaagcctatccacataaaattttaacgggtcgccgtgaccaaatgcatactattcgtcaaaaagacggcttacacccattcccttggcgtgaagaaagtccttttgatgtattgagcgttggacactcttctacctctattagtgctggtttaggcattgccgttgtcgcagaaaaagagaacgcagggcgtaaaacggtctgtgtgattggtgatggcgcaatcactgcaggtatggcatttgaagcgattaaccacgcaggttcaattcataccgatatgttggttatcttaaatgacaacgaaatgtccatctcagaaaatgtgggagcattaaataatcacttagctcgccttttcactggttcgctttatggtactttacgtgaagggggcaaaaaactgctctcaggcattccgtcgatcaaagagtttgtgcgaaaaacagaagaacacgttaagggctttgtttcgcctgttggcacaatgtttgaaacccttggctttaactatatcggcccgattgacggacacgatattgaagaactgatttctaccctgaaaaatatgcgaaatatgtcagggccacagttcttacatattaaaaccaaaaaaggcaaaggttatactccagcggaacaagaccctatcggtttccacggtgtgccgaaatttgaccatacaagcggtaagttaccacaaaccaaatccgtaccgacctattccaacatttttggcgactggctttgcgaaatggcagagcgtgatccgaagattatcggcattacccctgcaatgcgtgaaggatcgggaatggttgagttttctaaacgcttcccacaacaatattttgatgtggcgattgccgaacagcacgccgtgacctttggagcagggcttgcgattgcaggttacaagcctgtagtggcgatttactctagcttcctacaacgtgcttatgaccaacttattcacgatgtggctattcaaaacttgcctgtcatttttgcaattgaccgtgctggtattgtgggagcagacgggcagacccatcaaggcgcatttgatttaagttttatgcgttgtgtcccaaatatgacgataatgtgtccaagtgatgaaaatgaaatgcgtcaaatgctttacactgcttacacaatgaacagccctgttgccgtgcgttatccgcgtggcaatgcacaaggcgttgagcttcaaccgatgcaagcccttgaaatcggcaaaggcaaagtgttaaaacagggggaaaaggtcgctattctcaatttcggggcattattaaacgaggccaaacaagtggcagaaacccacaattacacgctggttgatatgcgttttgcaaaaccgctagatgaagccttgattgctgagcttgccgaccgccacgaattattagtcacccttgaagaaaatgcccttcaaggtggggctggcagtgcggtaaatgaatacttgcaacatatcggcaaaatcaaaccgctattgatgttgggcattcctgatttctttatcccacaagctacgcaagccgaatcctatgcggatttagggttagatgcgaaagggattgagcagaagattctatctatgaaatgagttaatttccaaatctcattaaaaagctaagatactaaacctaagttgcccattcttaggcatggcagacaaatgggcacagtagacaaactagttactaatgtttattttttctaaatattagcagcaaatttgtctattatccccattcttatgccataaatctatcttccacaatatcactattaggagatattacttcagctgctcttcaataatcccaccgcccaaacagacttcgccttgataaaatacggcggactgtcctggggtaacggcgatttgaggttcatcaaaaatcactcgaatggtttcgtcatcaagcggttggatttcacataaaatatccgcttggcggtagcgtgtttttactgtgcaacgtagtttttcacggatcggttggcgatctacccagtgaagttggcttgcaatcaggccgcttgaaagcaacgcagaattatcctgaccttgagcgacaattagcacattattcaccagatctttttccactacataccacgcattttcactcgcccctttgacaccaccaatacctaaacctttgcgttgtcctaaggtgtggtacattaagccatcgtgacgaccaatcacttgcccatcgacggttttaatatccccagcttgtgcaggtaaataacgagcaaggaaatctttgaatttacgttcgccgataaaacagatccccgtcgaatcttttttctttgctgtcgctaaacctaggtcttctgcaatggctcgcacaatcggtttttcaatatcaccaacagggaaaagactttgtgcaacttgttgctcgctcagagtgtagaggaaataactttgatctttgttgctatcaagtccacgcaataattttggctgttgatcaagcggtggacgacggacataatgccctgtggcaataaaatccgcccctaaatcctctgcagcatattctaaaaaggctttgaatttgatctctttgttacacaaaatatcagggtttggtgtacgtccagcttcatattctgcaaggaaatgctcaaacacattatcccagtactctgcggcaaaattaattttatgtagcttgatactcagtttatcgcaaactgcctgtgcatcggctaaatctgccgccgccgtgcagtaatccgtatcatcgtcttcttcccagttcttcataaacaagccctccacttggtagccttgctgttgaagaataaaggcagaaaccgaagaatctacgcctcctgacattccgcagatcacttttttctttgcattttccgctaattgttcatcggtaagtgcaggaaaatgttgttggtaagtttttgatttcattattgttgttctgtccgttgataaaattgctgtcccactctgtcgatatgctgaataaaattttcgtgagccagttcgtgataaattgaaagatcaaacagataaggtaggctagagtcttctaaatctagcctgattttacccaatatgttctgattaagatttggtcctttaaaagttaagtcaacatcagaacctatccgataattaccctttgctcgagaaccataaataatcgcctgctcaatttcggggtatttcttgagaatatcagtaattaccctaatagattgttcatttaatccaaacttttctgccataattccatcattctcttttctaatgcaaggaaaaggggaaggtaaatgtgaacgattttttcaaattctttcaacaaaatttgagcatcgtaaatatgaactgtcatattacagctattcaacatttccatccaatgatgcccctcaaaaataagctcatattgaaaggctattcgagttacgtttctaggtccatttgcatctaaaagaccttgatatttcaaatagtcttgcattactttccaagcaagttcgtgagcgatttcaaaactttgaataatcccttttttgataatatcaagatcagtatctgcatacttttctacatcatcttttagataagcaacagcctgttgataattttcaaaacgctgtttccagcgaatatcttgttgctccatttttccttcctattgatgaaaaaattattttacttcgtaaaactgagcctctttcttggcaaatttttcttcatattcggctttagcagcttcatcgccagcttctaattttgcttttaaattatcacaaggctcatcgcagtcacagacttttttcattcctaatgcagaaataccgccacaactacctttaattgttttacctttgataataaagccgattgacatcataaatacaatggctacaaagaaagcaaaggttagtaaaattgtttccattttttatcctattatttttgattaattaatttttcaaaggcactcgacattttagtttcatatccgtcgcctttcttgataattaagaaaattgctaaattttcacgttctgccacttccagtgctttttctgctcctaacacatataagcctgttgaaagtccatctgcagtcattgtggttggtgcaaatacagtaattgaggctaagttatggctaatcggacgtaatgcttttggatcgataatgtgagataggcgattaccctgttcatcttcaaaatagttgcggtaattacccgaagtcgccatacctaaattatgcaatggcacaacaatttgacttgatgttccttgagcaaattcaggtttttcaactgcaatacgccacggttgcccttttaaatttagcccttttccgcgtaattcaccgccgatctcaacaaggtaatgttgtacccctaattgctcaaggtaatccgctaatttatctacgccaaatcctttggcaattgctgaaagatcgagataaagctctggtactttttttgttaatgtggcttttgtggcgttatcatctaagactaatttttcaataccaacccaagtggcacgttctgcaatttgttcttccgttggtgctttatttaggcgtttatctggtccaaatccccataaattaaccaaaggcccaacggtcacatctaacgcaccttctgtcactttatttagacgtaccgcttctttgaccactttggcaaaatcagaggcaatttcaaacggtttatctgcctctttcatttgattaaattggctaatttgagagtctttttgataggtggacatctcgttatttaccatttttaacaacgtatccatttgacgttgaacctcttctggtttaggtaaatttgttaagctaccatcatcaatatatttgatatggtaggttgttcccattgttttaccttcaaaggcaatttgttggggttctttattacaagcagaaagcattacagcgaaaaatgccgaaattgcccacattagtaacgttttgattttcatacatcctcccaaaacgaataattaaattaataatggaaaatagacaagggcgatttccttatctattttccattattggattgttaataccctacatagaattatagcataatctattagattcagtatgtggaaaatgctccatttgtaaaacacaatagatttttatgatataaaatttactatttagcagttttattcaccaaaatttttcggtaaaatttttaacatttcagtccaaatttctgcactacgctgacgactcattgctaaacattctaccgctttttcataatcattagtttcacaagcgcttcgaagtgcttgataaaatgcaaaacttaattgacgagagctaggattggagaaaaataaagatgccgtttttaaatagagatctttaaaactatttaaaatcaacccataaacaggcttattggcaataaaggtaaattcccgatatagcttatagtcaaattcagcataagcttgtgccgtgtcttgaagcgattcaagatcttttaaaagtgacgaagaagctaaatgatcagctttaattgccttgggaataaagtattctcccattctagtacgcaacgaaacaacatttgaaataatcgtaggtgtgatagactcatctaaatgaattaatgtactaatgatgtttggacccgctgtttcccaaatattatttactttggttggtttaccgtgttggatactcaaccaaccatcacgcgcaagacgctgtaaaacttctcttaacgttgtacgcgtaacaccaataatatctgcaagttcacgctctgcaggtaaatctgaaccagcaggaaagcggttactccaaatacttttgattaaatattcttcagcaagggctgctgggctttgggctcttaaaatgtctgattgattcattgatttatctcaaaaaatgaagaaatacttcaaataaataataaaaagtgtgatgtacttatcaaaaatgatattgccttccatataatggctcttgggctattatcgtttaatctaaactagattacaatccacaatcatttttactttttagttaaatctatgaataatcttgacgctttttataaaaattttctcggtaacgcaccagaatggtataaggcttgcattattgccttcttaattatcaatccattgctctattttttcattagtccatttgttgctggttgggcattagtggctgaatttatttttacgttagcaatggcattaaaatgttatcctctacaaccaggtggtttacttgccattgaagctatcgttattggaatgacgagtgctgaacatatcaaaaaagaaatcctcgctaactttgaagttgtcttactgttgatctttatggtggcaggcatttactttatgaaacgcttgttactttatgcattcactaagctactgatttccatccattctaaaaaaatgcttgcactcactttctgtttaagtgcggcattcttatctgcattcctcgatgctttaacggtaattgcggtgattattagtgttggaatgggattctataaagtttaccataaggtcgcatcaggtgggcttttggacgatgatgagtccgatgatgcttcaaatgataaattaattacgaacaaacaaattttagaacaatttcgtggtttcttgcgtagcttattaatgcacgctggagtgggtagtgcattaggtggcgtgatgacaatggtcggtgaaccgcaaaatttaatcattgctgctcaagctaattggggatttggggagtttttcttacgggtagctccaattagtatcattgtgcttgtatcaggtattgcaacctgttacctcgtagaaaaatacaaactttttggttatggcgaccgcttgcctcgtaaagtttgggtggtattagcccattataacttgcgtaaagaacaagagatgacaaaacgagaccgaatgaaattggttattcaagccatagcaggtgtttggttagtcattgcgttggcattgcatttagcggaagtaggattaatcggtctctctgttattattttctgtacagctttctgtggtatcactgatgaacacgccttaggacgttctttccaagagtcgctaccatttaccgcattgcttgtggctttcttctctatcgttgccgtgattgtagatttgaaactctttgatccaattattcaatttgttctgtccgctgaaccaagctcacaattggtgctgttctatacatttaatggattgctttcaatgatttcggataacgttttcgttggaaccgtttacattaacgaagcaaaagcggctttccaagctggcattattagtagggaacaatttgacctgattgctgtcgcaattaacacaggaaccaatttaccatcagttgctactccaaatggacaagctgcatttttattcttattgacttctgctattgcaccattaattcgtttatcctatggacgaatggtctatatggcattaccatataccgtagttttatcaggagtagggttctttgcattagaatttttactgccacaattaacaaaattaatgacggagtggggctggttaatcactcgttaaaaataaagggaaccgtatgctaacttattttaaagagctatcaataagtcgtagtgcttggctacttctcactgcaagctgtacagcactagaagctgctgcgctctattttcaacacggaatgggactaaacccttgcgtgatgtgtatttatgaacgattagctctattggcgattttaattgcggggattatcggctttttagccccccgcaaaacgctcgtacgttggcttgcattattacttggtttatttggctcaataaaaggtttaagccttgcaattaagcatacggattatcagctcaatcctgctccgtggaaccagtgttcaccttttgtagatttccctgaaacattgccattgaacaaatggttcccagatctctttgaagctacaggtaaaggcgattgtggaaaagtggtctggcaatttttagatctctctatgccacaatggttgattgtggttttctctatttatattgtcgtttttgctgttattattataagtcaattcaagcaaacttcttcatacagaacattatttcgttaggtgaaatatgagtagcgaatctaaatctttttttcgtacattattagagaaatacaacgagttatgtaaagatcttgacgttgaccaaggtgcttgtcgaggctgtgtacccgttgtaaaatttgatcccgaacaagatgataaatctggagaaaaaacaaaagatgtttaaattatcttaaatgggatagagaaaaatctatcccatttatccgttctaaacatgtcatactatgatgtccccccccattcatttctaaaagaatgatttaactctcgcaattttattcataatctctataccatttgaaaatttttatttggagtctttatgtcatctactcaacaattccaaacgctgtttgaacagtcgttgaaaaactactgtgaagagcgttttttaaaacctgaacaactttctacacaacaatggtatcaattcattgccgaagtcagccaacaggcgattttgcaaaatttttctaaaaacgcaccgcttgtaaacactcgcaaagtaaactatctctcaatggagttcttaatcggacgtttactgggtaacaacttaatgagtctgggcgtttatcaatatgtgcatttagcccttgctcaatatggtaaaaatttagtcgatattctcgaagaagaacgtgatccatcgttaggtaacggcggtttaggtcgtttggctgcctgttatttagattcaatggcaagccttgctcagccagcagtgggatacggattacactatcaatacggcttattcaaacagagctttggctgggcaggtgaacaacgtgaagaaggcgatgcgtggagccgtgatttctacgctcaacaatatcatcgcccagattttcgtcaaaccgttggctttggtggcgaagtatggcatcgtgacggtgataaatatgaatggaaaccagcgtggacaatttatggtaaagcctttgatttacctgtagtgggttataaaggggttcaacagccgttgcgtttatggcaaggttatagcgaaacgtccttcgatcttgatcaatttaacgacggcgactatcttgagtctgaaagcaaagtggttgatgcgtcaaaattaaccaaagtgctatatccaaacgacaatcatcaagaaggtaaagagttgcgtttaatgcaacaatatttccactgtgcttgctctgttgccgatattctaaaaaatcaccttgcacaaggcagaaccttagagcagttgcctgaatttgaagtgatccagttaaacgatacacaccctgcgattgcaattcctgaattaatgcgtcttttgattgacgaatacggtttatgttgggatcgagcttgggcaatttgttcaaaaacatttgcttacaccaaccatactttattgcctgaagcgttggagcagtgggatcaaaatctcgtcgcgaaattgttgccacgccatttaatcatcattgaccgcattaaccacgagctttatcaacaagtgaaagcggaatttagcgaagcagaatttgcagatgcgtgggacgaaacagcggtcttaatgaaccaccgtgtgcgtatggcaaacctttgtgttgtaggatcttttgctgtcaatggtgtggcacaaattcactcggatttagtggtaagcgatttattcccagcttataaccgcttgtttaaaggtcgcttccataatgtaactaacggtattacccctcgtcgttggatccgccaagcaaacccattactaagtgcgttgttagataaatatatcaaaggtgactggacgaaagatcttgaattgttggctcaaattgagaaatttgccaaagatccacagttccaagcagattacaatcacatcaaacagcaaaacaaacagctattagcgaaagaaattgagcaatcacttggtttaaaagtgaattgcaatgcgattttcgatgttcaaattaaacgtttccacgaatacaaacgccaacatttgaacctgttgaatatcatcgccacttatcaagagcttaaagagaacccacaacaagaggttgtaccacgcctgtttatctttgcaggtaaagcggcaccaggttactttatggcgaaacaaattattcaagccatcaacgctgtggcaaaagtgattaacaacgatcctgatatgcaaggtaaattacaagtagcattcttaccagactaccgtgtaagccttgcggagaaaatcattcctgcggcagatgtttctgagcagatttctcttgcgggtaaagaagcgtcaggtacgggcaatatgaaattagctctcaatggtgcaattacgcttggcacattagacggtgcaaacgtagaaattgcagaatttgcaggggaagaaaatgtcgtgattttcggacataccgttgaatctgtgcgtgaattgcgtgcaaaaggttatgtgtctaaaacgtactatgagcaagatcctgcattaaaacgagcaattgatgcattagcggacggcacattctcaggtggtaataaagatacctttgaaccgttagtttatgatctgttaaacaaagattatttctgtgtgttagcagattttgcaagctaccgtgaagctcaaaaagaagtcgcaaaacgttatcaagatcaaaccgcttgggttgaatctgcgattcttaatacggctcgtttgggtatgtttagctcagaccgttcgattcgtgattatcagacacggatttggaagaaatagagatatggtagctaaaaatgatttttggtattcttagctactatgttctctattacactgtaaatactggtgcgagctagacactcgcaccaattaatttagatattattagaatttataggttaaattcgcagtgactttacgtccttcgccaaagaagcaagcgtaactacaaccactgatatattttttattcgcaacattcgttacgtttactcttgtctcccaattctctgaaaggctatatttcgccatcagatccactagtgttcttgctggaacgcgaatattggcattattgtagccatccatttctgttggagttgttccagtataacgaggcacaacccctaatgttaagccgttaagtacattatccttaaatgcataattaactaatgcagaataagtatggtttggttgtaatggagtatcaatacgaggtttatctaagcgatgggattgagcaaatatataactataagctaaagaagtagataacgattcagtaatatttaaatcagcttgaatttctacaccacgatttttttgcttttcaacctgagccattgtggtgacatccccactacgagccgcgacaagagcatttttctcttttaagtcaaaataagccacagaaatctgcccattgataaatgatggcaaatatttaaagccaacttcatattgcttaccttcataaggcttataaattgatgaaccgtttgtagcattatctaaactacctgaaagaggcctaaaagattcagaatagctaaaataaggtgctaaccctaaatctgtcatatacattaaacccgctgaataggtagtatgattaactttattttctgattttgttcctcgaatatcgctgtgacctttaacaaaatcacgtcttacgccaccagttacagttaatttttcgtttaaacgtaattgattttgcaagtacaagcctagctggcgttgtttatctttataaactggaacatcagtcaaggtaactggagcggtaacaagttgagtaatatgatagcttgtagcaggccaagggaaatcatataccccatcaaccttgctgtgttgataatcaaaaccaccagttagggtatttgaaatattatctgatttccattctttgcttaaacgggtgtcaatagtatgggaatatgttttaccatcagcaaataggaagccttttttagccatagtattacttgcgccacctgttgtaggatcccattccatgccgtagtaataggttacaaattgctctttatctgttttggcaaagcggtagttttgtgagaaagttaagtcatcggtaaatttatgagtaaattcatatccaatagcatattgtttattacttacatatttaataatctcaatactttctaaaccatagacatttggttcccagccaaagtacgcatttttatatgatgaagttccatctactcatacacttgatcctaagccacgaatattaaaccagtcattagtatctaaatctgaaccgtacatttgggtattaacaccagcttcatagcgtaatgcttcatctaattgatggacggctctatccgttaactgctcttgcgaaatcacactaacagatcgaggtgccatataatcaactttcccagcctttgcaactgaccccaccacactcacttcatcgagtacagcggtattgttgtttgcagtctcatttgctattgcattgcttgcaatggcaagtagtactacttgagaaattgttgaataaacaaatgttttttttcattttaaagtcctttgtgttaataccaaattgtagggttgaacccgatgtccacacaatcagttggttcgctcttgggtcgccactggcaatggcgatgcgttgcaaagtgtcaaacagtgccgataagctgatccctgtgagtagtattttttcgggcaacattccgttgcgttggttaattgccattagcaccaacagtgctacaactgccccagtgatccctgccaaccaataccattctgtttgagctgtgttggtaagaaacagtaccgccaaaatccccatacttgtaccagacgacacgccaagcagttcagggcttgccatcgggtttagggttaaacattgcaataacacgccagccactgccaataaaatcccaacagcaacggcggtcaaaatgcgtgggtaacgtagctcgacaagcggtgcgtaaaattcgttaaattccaatacattccaaccgcttgtgcctttgcctaatacgagtgcaagccatagcacaagtacaaaaacaaacacaatcggcagtaaggtgtagcgatgaaaacggcgagataggcgagttgatgtttctgttaaacgccccgagtaattgccatttcagcgttctcacaccaagttggcgaataatggtggcggacgctaacccgataaaaccgagcataccgacacaacttaccaccgctgaaatcatataagcactgataaacaccccgaaaaaacgcagacgattaaccggcacaccaagactttgggcattgctgtcgtttaaggaaagtatggtaagcggacgaagcaatatggcaattaatccgccacaaatgaccgcttgtattgccaaaaattgcggatctcgccagctctcttgtgccaaagaaccagctccccattgtgccaagccccgtgcttcttcagggtaaaacaacatcatcaaggcggagaatgaaccgaaatagagattaaccaccaagccagccaaaatcagtaacagtggtgacattgtttttcgcattgccaaagttaaaacaaggatcaggctcaagcctgccccaactaatgcgatggcacttgagctaatgtctaaccaattcggcataaaaatagccgtgataaacagggcaattggcaagtaatttgattaacgtggatttacctgaaccgttatgcccgatcaatccatacacttttccttgttcaaattgcaccgaaatcggctgtaacaacgtacgatttggaatggcaaaacttgcctgtttaaccacaaacataaaaatccgagtgaagtgtaaagttctaaaacaaagttggcattctaattagaaattattatcattaaaataagatttacatttctttatgctatttatgaatttactttttagttgctcggaactgaacacacttcgtcaaaacttattttcagaacgcttaaaacattgccgtaatttgcttacttttgtggaaaagcctgtgatgtgagtgaaacctaccgtcaaattctgcttgaaaagaaatggacagaatacgaatggtcgcctttttataacgccgttgaatatatttctttccccgaattgccttttccacagcctgtccgcttacggaaagtctgttgccacgcccacttggatagcaaaaatgattactgtggcaattgcccgaaattgaaaaaactgccgaaagatgagttgaaagaatgggtgagtaagctctgctaatcttcaaaatcaaattacttaattcaacttttacctttagtgtttacacattcactagatactatctatcattcacaaggcaagatcttaattgctaatccacctgttgaagtttcgcggtatttcgcattcatatctttccctgtttcatacatcgtttcgatcactttatctagggttacgcgtggttgtgtcgttcggcgtaatgccattcggcttgcattgattgcttttaccgaagcaatcgcattgcgttcaatacaaggtacttggacttgtcctccaacaggatcgcaagttagccccaagttatgttccattgcaatttctgccgccatacatggcgtggtaaaaagtcgtaatggaacggcatatccgcaaaaaaatcaaaggtgattgttttagcatgttccggtcttgcttctgcaagacataaattttggtgctgtttgacatcacttacgaccgtatcaatacgctcaatatctacattgtctggcagatagcccattaatcccataataatcgcgatatccgtactgtgcccacgcccagtcaacgctaatgagccataaacatcgacttgcaagcggtcagtttctgccaattttttgcaatcaattaaatgatcaataaattctttacccgctttcatcggaccaacggtgtgggaacttgaaggcccaattcccactttaaacatatcaaagacactaatcataaacacactcaaacataagccactcaagacatattttagcgtaagttctctataagaggaatgttaccgatttatgtatatcattttggttataagttagagccttcagttattttaattttttcactaaaaacggtagattgagctggaattttcaacttagggaacttattatgcaatattcaaaactctttctcggcttgggttttctttctgcttcatgtgccgcgatttcggcaccgacaaatacattggtcaactgtattgcgacagcaccgatgaaacttagtccggcaattacaaatgatgctaatgacttcaatgccagctcacaacaagtctataaccgcttagtcgaattcaaagccggtaaaattgaagtagagccgggtctagccgaacgttgggaaatcagtgaagacggtttggtctatacattttatctacgccaaaatgtgaaattccacagcaacaaaacctttagcccaacccgcccgttaaatgccgatgatgtggtgttctcattccaacgccaagcggacaaaaatcatccttatcataatgtttcggcaggaacctacttctactttaactggatgaacttaccgagtatcttaaaatccgttgaaaaagtggatgactacaccgttaaaattacgctgaataaaccgaatacgccgtttattaccacggttgccatggactttttatctatttattcaaaagaatatgccgatcagcttcttgcccagggtaagcccgaaactcttgatcaacaaccgattggaacggggccttttattttccaaacttatcagaccgaccacgcggtacgttacactgctaacgtagattattggaaaggcaaagcagacattgaacgtttaatttttagcattacccctgatgctggaacacgttatgccaagttaaaagctggcgagtgtgatgtgattgattttccgaatatctcggacattgctcagatgaaaaaagatcctcaaatcaatctacttgagcgtgagggattaaacttagcttacattgggctaaataccaccaaacctgaactaaacaacgtcaaagttcgccaagcccttcaccatgctaccgataaaaaagcgattgttgatgcggtttatcaaggcggcggaacggttgcaaccaatccgttccctgatacagtattaggttataactcgcatttgccacaatatgaatttaacttggaaaaagcaaaagcattattggcagaagccggctatccaaacggttttgaaacggaaatttgggtgcaacctgtggttcgtccatccaatccgaaccctcgccgcacggctgaaattattcaagcagactgggctaaaattggcgtgaaagcaaaactagtcacacatgaatgggcggattttaataaacgcacccgtgaaggcgaatttgccgcaggtacttatggttggacaagtcgtaacggtgatcctgataatttcctattccctttatttagccaagcaaatatccctggcaccaattactctcgctggacagatgaaaaatttgaggcgctactcgcctcagcggtacaaattcaagacacacaaacacgtgcaaaactatatcaacaggcagtcgaaattttccaacaaaacagcccgatcattccgtttgcccactccattaactacgtaccgttaaataaacgggtacaaggctttgttcaaaatccgtttggctataccgcattttatggcgtaagtctgaagccttaatctattagggagcttaaaatattaagctcccttatataagtctttctaaaaataaatcgtttacatcatttacttactattttgatccacagttgatagaatcctttcatatctacactaaaaataaggaaatattatgtctaaactctttcccaatgcacaacctcgtacccaagccccttatcgttttgatattgtgggaagttttctacgtcctgaaagcttaaaacatgctcgccaacaatgccaatgtggcaatttatcttgtagtgaactgactcaaattgaagatgctgaaattacaaaattagttgagcaacaaaaataataatagccagctattagatgatattgctgatgcttataaataggcaatagaaaaattctatgcattaggttgccgtaatttacaattagatgatacaagttggggagagctttgttcagaagagaagcgagctgcttatcaagctcgagggttcgatttagaacaactcgcaaaagactatgtttatttagtcaatcgcgccatttcagaaaaacctgctgacatgacaattactatgcatatttgtcgagggaattttcgttccacatggttctcctccggaggatatgaaccgattgccgaaacactatttggaagctgtcatgttgatggctttttcttagagtacgatagcgatcgttcaggggattttaaaccgttacgctttattaaaaatcagcaagttgcacttgggcttattacatctaaagatggcacattagaagatagaaatgagattattgagcgcattaaagaggctacgcaatacatagacattaaccaactctgtcttagtccacaatgtggctttgcatcaactgaagaaggtaacattctaacagaagagcaacagtggaataaattaaaatttatccgagacatcgctgaagaggtatggggtaaataatacatttaatttataaagcggtcggatttgcaaaattttcgtcaaatcccaccgcttgttaatcaattaagccctacgccacgttgtaccatttgcaccatcttcaagcacaatgcccattgcggtgagtttattgcgtgcctcatcggctaccgcccagtttttgctggctctcgcttcgttacgttgtttaatgaaggcttcgatttctgccacttcatcattattggcatcgccttgtaagaaggtttctggatcttgctctaacaaacctagcacgcctgcaagttgtttcagacgagctgcaagtttgttcgcttccgcctgattttctgctttgagtttattgacttcacgagctaattcaaataacaccgcgagtgctccaggggtattaaaatcatcgtccatagactctttgaaagcggtcacatactgatcgttttctgcaagttcaacattccagtcacagccacgcagtgccgtatataaacgctctaacgctttgcgagccaagccgatattttcttcgctgtaatccaacaagctacggtattgtgcggttaagaagaagtaacgaacactttcacaatcatatttgtttaaaatatcacgaatggtgaagaagttattgagcgattttgacatcttctcttcgttgatcgtaagcattccagtgtgtagccaataattcacataatcgtcaccgtgagcgcagcaagattgtgcaatctcgttttcgtggtgagggaacattaaatccgaaccaccgccgtgaatgtcaaaatggttgcctaactctttgctgttcatcgccgaacattcgatatgccagcctggacgacctttgccccaaggggaatcccagcttggttcattctctttcgacattttccataatacgaaatccatcgggttgcgtttgaccgatttaatttcaacccttgcccctgcttgaagctgttcaagattttggcgagataaggcaccgtatttttggaaagattcgacattaaacatcacgtcaccatcttccgccacataagcgtgacctttcgctaagagtttttcaacaatcgcaataatttcagggatatgttgcgttgcacggggttcaacatcagggcgaaggatatttaacgcatcaaaatctttgtgcatttcgatgatcatacgatcaacaagctgatcgcaagtttcattattttctaacgaacgtttgatgattttgtcgtccacatcggtaatgttacgcacatagcgtaagttatagccgagatagcgaaggtaacgtgcgatcacgtcaaaagaaacaaaagttcgtccgtgcccaaagtgacagagatcgtaaaccgtgacaccacagacatacattccaacgtgatcagggtggataggtttaaattcttctttttcacgttttaaggtgttataaattttgagcattatttcctctattatttaataaaaaattgtcaatccatctaagaaaataagaggaaatattatatttatattcttcatttaataccaaatttctcttttaaatcgctttcaaatttctgtagttctttattcagtaacaataatctatctgccttttctttaattttttcctgtccttctaaagtcgggttttgcatagtttctactgattcaataataaaatcatttaataaaatcagattttctttaatccttaatttcaataactgaatatccgtatttttaacctctatcatctctagattttgtataatagaagatattctagttttaaagatattcaatccctcttcaatttcagatttatcttgactgctcagcttttgttgcaattctgctaatacctgttcttgcttaatattccataataccaacttattaaagtcttccacagcttcaatagaagccgaactctccactgtatgcacatcttcttttgatgttttttctaaagaagtactattgatactctcatgctttccgacattatcacaagaagataaaaacatcatacataatactaaggtaataattttaataaacttatttatttcaaaatatccaaataatactaaaaaaatctttattaaatatattcatataaatcattcttatccagttattacacacttattgcctgctgaataagtagcttttttacaaaactattttgattagttgcagataatccaacacctctaactaattttttaaatggattattgccagagaaaaggtgctttaagccctccattgcaactaaaacctttatagcttctaactttctaactcgttcaaattgacgtaaattgcggtactctcctatatcttttccaaaggagagtaatttctgtagctcttttgccaatagaatagcatctgcaaaacctaaattaacacctaaacccgctagaggatggatcgtatgagctgcatcaccaatcaaagcaatcctttgctgggcaaaatcgcgagcataacgtgcggtcaaaggataaacatccctttcactttgtaactcacatattcctaattgattatcaaaagcaatattcaattgtttgagaaaagatttttcatcactattaactagtctactagcctcaagtgtaggcaaagaccaaacaatagaacaaagatgttcatcttttaaaggtaagaaagctaaaatactatcaggcgaaaaaacttgacgagccacttgttgatgcatttctgttgttctcacattacatactaatgcagtgtgttgataatctctactaatcaatggaattttagcttgttgacgaacccaagaatgagctccatctgcacctataactaacttacttgtaatcatctctccgttttctagagttaaaaaagcgcagttatcattaatgcctaaaaatttaggagcatccaatatcacttctacattatgctgatgaatgacttgcttccatagagcataacgaatctgctgattatcaataataaatcctagctgctctagtccaagttctttgattacgggatctttattgtcaaaacagagacttgaaaaactatccttttcccagacatacatttggtcataaggagataaatcactttcagaaatatgataccaagcacctatttcctcaagcattctttggctagtaaaattaattgcacttactctattactgattgacttacttaaatagggaactgttttatcaataatcttgatttgacaattactatttgcaagtaatcctgctaaagctaagccaaccattcctccaccaatgatggtaatatctgctgttttcattctacgatgtcttataatgtttttctaaactacagtgacgaactcttacttttttgcctttactttcaatatatctggctaatttctctgcaacaaatacagaacggtgctttccgcctgtacagcctatggcaatcgttaaataactcctattattttgctccaataaaggcaaccacacttctaaataattacaagtatgagaaataaattgatggacttctgactgattttctagaaaatctataacaggtttttctaatcctgtcataggacggagctcaagattccaatggggattaggtaaaaaacggacatcgaaaacataatctgcatcggcaggaatgccatacttaaaaccaaaagattcaacaataatatttaattctttctccgatgatccatttaataattctcttaatttctctgctaactcatgtgaagaaaagtacgttgtatcaataatataatccgcatgctgaaataatggttcaagaagatgattttctaaatcaatcacattttctaaagataaatcatgggtagataatggatgtaaacgacgagagtcactatatcgacggactaaagccttacgctgacaatcaagaaagattaaagtttttgaaatgtgagagggaaacgcatgtaatacttgctcaagcacatctggatcttctggtaaatttctcacatcaaggctaacaacaacagatctcttcaatttttctaaataatctgttaactggggaattaaagcaagaggaatattatccacacaataataccctaaatcttccaacgctcttaacgcaacagactttcctgaaccagatcgcccgctcataataatcaattccacattacattcctcgattctaaatttttgtttaccgaataatcataataactcaatacttgccaaatttcttctctggataatgcagctcttagatgctttaacaaattcttatcacttaattgctgtgctatttctctcaaagaatccttatattctacacaaattttttctgaaaagaatatggcataaataatatccacatccttatgatctattgattcaaaatttattcctgcctctagtttcaggaaaatagcaattggtttctctagctgaaattcttgactcatcaacaattttgcgtgaggtaaagccactccattattaattccggtagaacctaatttttcacgtttaaagaaatagctaaaacattctgctggatgaatacatagtttatctgtaggtgaaaggctattatttaatatttctgccatcgccttccccagaaactctaaagcctgttttttattagaaatgggaacattgtaataaatattattaatgtctaaaaatgtggttaattgcatcataaaaaatcaaacgacaaaaaaatatcttaagaattttatattacagcctaaattgctcacctaaataaacttttttcacatcctcattatgtaaaatttcttgaggaatcccactagctatcatctgaccattactcacaatataagcacgctcacaaacatctaaggtttctcttacattatgatctgtgattaaaacacctaatcctcgttcctttaaattcacaataatcttcttaatatcgatcactgaaataggatcaaccccagcaaaaggttcatccaacaaaataaacttaggattagctgccaacgcacgtgcaatttctactcgacggcgttcaccgccagataaagattgccctaagctgtgacgaatatgctcaatatgaaattctgcgattaattcatctgctcttgcttgacgctctgcatcggttagatctttcctaatttgtaacaccgccatcaagttatcataaacacttaagcgacgaaaaatagaggcttcttgaggcaagtaaccaataccttgttttgctctatcatgcataggtaaaacactgatatcttgatcatcaatacggattttaccatgatcgtgacgcacaaggcccactaccatataaaaagtagtcgtttttcctgcaccattaggacctaatagtccaactatttcgcctgatttaatatttaaacttacatctttaacaacttggcgacttttataacttttagccaaatattcagcatataatgttggcatacagaattcctatttcttatcactttgcaattggtttggaattaatacagtttttactctttgtcggtcattactcgtcgctttaaggttctgttttttgacatcataagtaattttttctgctttaatggcactatctagctgctttaattcggcattgcctcttaatatcaaaaattcagaatctaaatcataatgtacagaattagccgtaccattaacaatcttaccattatcaagggtctgctgaaaaacaaccggtgtgccaaaagcctcaataagttccttttgagtatcccttctaatgattgtaactttttctgcattaagcttaattgacccttgagtaataacaacattgtcgctaaatgtcacaatatttctttctatatccaatgactggctacctgaatcaattttgatgggcatatttctatctgtttccaaagccttaaccgatagatttacaagacacaatgcaattattaatacaagtttagttctaaaattcattctatatccctatgtaaaactctaattatttatcaacattaataaattttggttcaatataagttttcacatctttggttaaggttgccgtttgttttttcaaattgccttttaagccaattccagtacttgtaaatccaatgcctgttgatttcaccatactgtctgaaaaaatatcttgagtatttaaatctatgcttaatacttctgcttcgattttctgtaaccgagaagtcggatctaagctattaattttaatatttccacgcaaattcaatattttgtctttggtaacatctgcataatcggcttcgacttgccactgttttaatgcactttctgcatcaaataaatttagtaatggctttagaaattctgttcgttgcgtactttcgtaacgtttaacctcctctgcttgagcagaatattgcggctttccatttaaatcataagcacttgtagaaatcttttgccctatatactctgcacttccttccttttttattagctgagataatccagtatcatcgctttgttgactataataccaaccagcaagtactgctgctaatgtggctagaataatatttaaacggatattcatacaatctcttcttcgtttagatacggctgagaattttaacataaatttctacggcaatatagaacgaaaattgcaagaaaagttcatacaaaaaacctcaaggtaagccttgaggtttttaagcgatgtctatggaattacttcgcagcttttaactcttgataatatttttcatagagctcaatcgcatcacccacatcatcttgccactggcttttttgtaacacttcagaggttggataaattgctggatcttcggtaatctcttttggtaatttttctaacgcttttacgtttgaagttggataaccgatttctaatgtcaatttctcagccacaggtgcactcaataagtagttaattaacttgtgagctgcatctgggtttttcgcattagatggaattgcaagcgtatccacccataatactggaccttctttcgggaacaccatatttacaggagcttgctcttttttcgcaatacgtacagaaccgttccacaattgacccacttctacttcacctgaaataaatgagtttgcaggattgtcagagctaaatgctaatacgtttggacgtaattttaataactcttcataagctgctttaattactgctggatctttagtatttggatcttgacctaattttaataaagcaatgttgaatacttcacgagcatcatcaagtaattgaactttacctttaaactcaggtttccataaatcaccccaagcggtgaaattgtcaccattgtatgaattagtattaaatgcaatacctggcgcacctaataattgtggtaaagagtatttgttgcctttgtcgtaaggtttatttaaccagtctgggttaagatctttgatcacaggtaatttgctatgatcaagctccattaacataccttcacgtcccatttttgacacgaagtagttacttggtgcgattacatcataaccaccatctttaccctgaattttgagtttcgcatacattgtctcatttgattcaagacttgaaaccacaaccttaatacctgtctgtttagtaaattcttctaacaaaccttctggcacatattctgtccaagtataaagatgtacagtgtcatttgctaatgcactatttgcccctaacatcaccatacccgaagtgaatgcaacagcccattttttcatcaatgtattctcctaaaagagtaaaataaagaagaggttggattactccaaaaaaaccaagtctttcaaataaaagacgggggaattctaagcccccccctgtattttgcaacaactttatttcaaaatagattattttttaagctatcaagcctaatattacattaccactacgtcaaattgatcttggtgataatacggctcaattttaatttcgacttttttaccgataaaaacttctaattccgcaagcaatgcgtgagattcttcattaatcaagtattccgccacgctacgagaagcatatactacataacgttccgatttgtataaatgatgaactcgaaccacctctcgaacaatctcataacagactgtttcaacggtttttatcgtacctcgccctttacacgaagaacaatcgcaacataacactcgttcaaggctttccctggtacgtttacgcgtcatttcaaccaaaccaagttgggtaaagccattgacatttgttttaactcggtcgccttttaaagcaagttctaaggactctagcacacgctggcgatgctcttcttcctgcatatcaataaaatcaataatgataataccacccaaatttcgcagttgtaattgatgtgcgattgcctgtgttgcttcaatgttagtattaaaaatcgtatgggcaagatttcggtgtccgacaaaagccccagtgttaatatctatggtggtcattgcttctgtctgttcaataattaaatacccacctgattttagatcaacacgtttatccaaggctttttgaataccatcttcaatgcgataaacatcaaagaggggtaaagtcccactatataaactcacattcttggctaactctggcataaactcagctaagaactcttttacctgctcataggtcatttttgagtcaatttgaattgaatgaatatgcgttccaacgaaatcacgcaacactcgttgtgccaaagctaattccccataaagtaaagatctcgcaggatattttccttttcgctctagtacttttcgccataaccgctttaagaaagccgcatcttgttcaaggctctcttcgctcacactgtcagcagccgttcttacaataaaaccgcctagctcatcacaatacggctcaactaacgattttaagcgattacgttcttcttcactttcaatgcgttgcgacacgccaacgtgactattttctggcataaaaaccaaataacgagagggcaatgtaatgtctgtcgtcaatcttgcccctttagtacctaaaggatctttgaccacttgcaccacaatatcctgcccttctcgcactaactcgctgatatttttgacaacaaattgctttttctcgctttcatcaacacattcagtatgagaaacaatatctgaggcgtgtaaaaatgccgctttttctaagccaatatcaacaaatgccgactgcataccaggcaaaacccgtgtcactcgtcctttatagatattaccgacaacacctcgctttgcctcacgctcaatatggacttcttttaacacaccattttcaaccaatgctaccctcgtttcacttggggttacattgactaataattctgcacaattcatcttaaatttatccctagaatcatttacaaagatactagtactgattttcttaaaatatacataaatagttatttaccataatagaataaaggtcctaatggcatctgaggaatactaaatttctcaggataaataacttcaaccaagtatagtccctcagctttcgctgttggtgcagccaacgtcctatctcgtttttctaatagccatttaatccattcaacaggtttatcgcctcttccaacctcaatcaaactaccaactatatttcttaccatgtggtgaacgaaggcattcgcttgaatatccaatataatatagtcttgatggcgactcacaatgagatgatgaacatttctccatggcgtatgtgattgacacttcgcagctcgaaatgaactgaaatcattctctcccaataaaaactgccctgcttcatgcattttttcatgatccagagaatagtgataatgagaaatccctttcggtaatatggctgaacgtaatttattattataaataacataacgatagcgacgagcaagagcactaaaacgagcatgaaaatcgtcacttactccaatagcccatttcaccacaatatcttctggtaaatgagcattggtccctaaacaccaactctgcataggtcgatttacatccgtatcaaagtgtacaacctgcccagtagcatgtactcccgcatcagttcgccctgcacaaaacacttcacaagatgaatttgcaatgactgataaggcttcttccaatctttgctgtactgaatcaacatattgttggcgctgccacccacaataacggcaaccatcgtactcaattccaagggcaattttcattagacaacctaaaacatttaattaatctgattaactcttttttttcataagaaagtaacttgataagttactatagctaaatcgtattatttataccgctgcccgtatcatttaatgattgacatccaaacaaaaacagccagtaaatcattttattcagagattaattcgctcttcgggcattatgccagattagtatttaatttaaaacaactacacaattttgcccccgaagagaatacagcatcagtaaactcatgcagatattgtaaaattaattattgtggaaaaactcaaattcttccctacttttactgaacatttgttcttttagaacgccgatcagctcttgtctgacaacagaaagttttggtcgttcattttgttggaacaccactggacgacaaaattccattgccttaatgcctaagcgagcggtgagcagtcccataccaatcccttgtgccgctcgaaccgataaacgagcggtgagattttgtgagaaaaaatctaacccgacatcgctggcaatttccgttgcccctgcaaagaccatattggtcatcaccattcggaacagttttaaacggctgatatagcccaattccataccgtaggctttggtgattttattgactaaagcaatgtttcgccacgccaccattaaaatatccaccaacgccaaagggcttactgcaacgataattgcattttccgccgcatttttactgattagctttttcacttggttatcaatcgggcttaatacattttcactgaaaagatacagcacttctttgctgttataggcttcatcaagctgagactgccaacgttgctccgcttgttgaaccatcggcgtttgagctaaatttttaaccaccgatttgcaaaattctcgtgctttttcaccgcttgtatccgctgtttccagtagtaattgttggctcacttgttgatgataatgatgtttacgcaaccaacgtaacttccgccattcattgataatagcccctacaccagccaaactgataccaaaaaaggcaacggcaaaggcaaagtaaatccattgatttgcttgccaagtatcaatcaaccattgcaccgattgagcgatagtcgcaatgccaaacaaggctaatgcagctagaaataaccttagccaaaagcgagatggctttaaactttcttcaataatcagttctgccttaaccgcttttggctcttcgtcaagctgaatgtcagcattgctaaactcttgtttaggttgatgtttttcgtctttttcaactatttcttcagtaaaaatacgtttttccattaaaatttcaccgcttgtataatatgctgttttaacccttcatagccgtgttctgttttgagaatatcaaacagttgcaccgcttcgggatactctttatcgagataacgtagccactgtttaatgcgtgcgacgtgataaaagccggtatccagttcgttttccatatgtacatattgaaataagagctgtaatacctcgttccacgccattttaggctggttatatttcacaactttgcttaaatttggcacatttaacgctccacgcccaatcattaacgcatcgcaagcggtcacttcacggcatttttttgcagagagataatcccaaatttcgccattcgcaatcacggggataggcaaccgtttttttatctcgccgattgcttgccaattaatgcgttctgctcgatagccgtccattttagttctgccgtgtacggtaatttccgttgcacctccttgcaccaccgcatcggcgatctcaaaggcttgttcgctactatcccagcccagtctcactttgaccgacacgggaagatggctaggcaccacttctcgcattgcttttgttgctcggtaaatcaactcaggttgtttcaacaaggacacaccgccattgctgccattcaccgttttagacggacaaccgcagttgagatcgaccccgtgcgagccaagctctacggcaagtgctgcgttttccgctaaccattgtggatgttgccctaaaatttgtacacgcacaggcgtacccgatggggtaaagccgttattgtgtagctcagggcaaaggcggtaaaaggttttcttcggcagtttttgatcgaccactcgcacaaattctgaaatgcacagatcataatcattgactgccgttaataattgacgcacaaaagggtctaacaccccttgcattggtgcaaggataacttttggtaaattttccacaaaatccgaccgcttgttagtaagaagaatggcgcaaacgtaagtcaggtcgggcaattaagtagatgattaatgcggtaattgcccctagcgtatcggcgagcatatctttttgagtgtcccaaatgtcgccttgcgaacctaaaaattcaatgcccgcattgcccccttcaattaccgcatattgccattcgataatttcataggcagcggcaaccgacataataaaaaagagcgaaaagaagaatgctacgcccaagccgcatttacgtttacgcaataaccattccgccatcgggaagctataaaagccgataatatagtgagccacacggtcaaagtggttacgatcttcgcctaaaaaggtcaaatactgattcgcccaatcaaacggtacattcgcaaaggtatattttgcaccgattaggtgcataatcatccacagtgacatcagcacataggcaagtccactaaattgaaaacgaggataagtcaccaccaataagccgaacaccacaaaaatcggcataacttcggcataccacaccgcacgatcagtcggattaagtcctgaccacacggcaattacgatgattacaatagctaaaaaaagcggaacaatatgagaacgggtttgcattatttccatccttttgatttacaaataagatcataagcggcttgaatttgctgtgctttttcttttgccacttccatcatttcaggcggtaaaccttttgcgactaatttatccgggtgatgttcattcattaatttgcgataggcacgtttaaccgtcgtttgatcgtcgctttctgatacccctaatatactataagcgtcttttaaacttggcccgctcgaacgctgataaccgccataatttccttgatattgtccttgttggcttgagccgtgctgttcatattgataatagcctgaacggaaacgttgagccgccgccaccattgcgatcatctgttcaaactgtaagcgagacattcccaatgtttcagcaatagtgaataaaatttgctgctcattgccatctaaattgccatcttgtaacgccgcttgcatttggacttctacgaagaaacgcaataaatcacggcgttgtccacaggcttcacgaaactcttgcataacttggcgtaacgggaaattagcctcttttcctaaagtaaaggctttttgagcaagttgttgattatttgcatcgagtttcatattcgccattaactgacgggcaagctggatatcattttccgttactcgtccttttgctttggaaatatgtcctaataccgcaaaagttgtctgcataaagagtgactgacgagttagtgctttgccaaacatagttgaagatacgctacctagctcatgcagttttttatcgccccaatgcccaataataagccctagcaaaccgccaaaaaatccgccaaaaaacttataacctaaaatgaaaccgagaattttcccaataaattgcatctattgcccttatttacttattcaaaattgtgagcattttaacggaaaatccttaaaaaataattaaggaatgatgaatttacacataaaaataaagccccgaaaattcggggccttactatttggcattttagaaaactaaaaattagtactctaacactgcacgacggtttttagagtaatcagcttctgagtgacctaatactgctggtttttcttcaccgtaagaaactgttgccacgttgctagcacctttagttgctaaaaaatctttaactgcgtcagcacgacgttgacctaaggcgatgttgtactctggagtaccacgctcatcagcgtgacctgcaacagttactttgcctttagatgcaactaagtattgtgcgtgtgcatctaaaagttgttgatcttcagcttttagtgtgtagctgtcgaaatcaaaatatacagtgttgtaacgggtttgtaaatcttgaacagacataccaccgaatgtttgacctgcattagcacttgcattagcacttgcattgtcgtttgagctgctacatgctgccaaaacgaaagctggtgccgcaatcattaaaactttagctagttttttcatttttttctccaaaaagaattattgtttagtcagataaggtgaccaagcagggaatttatattgtccacctgctcccggcaaattagctttgaaacgcccatctgcggacaccaattgtagcactttactcacacctttggtagagctataaataaccattgttccatttggtgaaatacttggactttcgtctaaaaacgtagaactgattgcttctgtgctacctgaaacaagatctcgtcttacaattctatcacctgaaaccatgattaaattcttgccatctgccgaaattttaccactgccgctgccaccaattaagctagcaccgccaccagatgaactcatttgataaacctgtggtaagccaccacggtctgatgtaaacaagatataaccaccatctggtgaccagcttggttcggtgttatttcctgcgttactggttaattgtcttggtgaaccaccgcccacccctgttacataaatatttaatacaccatcttggttagaagcaaacgccactcttgaaccgtctggtgagaatgaaggcgccccattatgccctctaagagatccgatcacttttcttgctcccgaacgaatatcgtgaacaacaacctgtgattttttgttttcaaaagtcacataagctaattttgaaccatctggtgaccattctggtgacatcaaaggctctttactttttacgatggtaaaggcgttaaaaccatcataatctgatacacgcaactcgtaagaggacactccacgttgtaccacataagcgattttagttctaaatgcaccacggatctgtgttaatttttcaaatacttgatcgcttaccgtatgagcccctaaacgcatttgggcaaccggaacattaaatgaaccttgcgcaatcacatttcctgctgctcctgaagttcccaaagtatccactaattgataagcgatgttatagccaccacctactgcagacacttgccccacaaccacattatcaatgccgatatttgtccactgttcaggattaacttctaccgctgaacttggttgtgcaggtaaactcgcacgatcaagcggtgtaaacttaccactatttctcaaatcatctgcgataatttgagcgacatcatcaggtacgccccccattgctttaaatggaataacggctatcggttgagccatactcacaccttggtcaatcgaaattctgacatctgactcagcttttacaccgacagaaaaaaataatccgacaataccaagaatactcgttaaacgagatactaatttcatcttaaccctctaggttgaactattgaacttttaaactaaaatctaatgttggtgatctatattgctgataaactgcatctgacggtgcaggcggcactttacgggttgccacaatcgcacttacagctgcatcacacactgctttatcccctgaaacgacttgatagttggtaatagtaccatctcgctctaggaaaatcttcacatcacattgtttacctgcaaaactcggatcaacacggtattttgactgaataagtttcttaattcgttgcccataggcattaccatcaacgttagcaccttgacctaagcctttagtaccgccagagccttgtgagccggcactatttttattaccgccgttgctcgtgccaccgccaacttcgccaccacttaaaaaatcatcaagtactttattatttttcgctttttcagcttttgcagccgcttctgctttcgcttttgcctctgcagcgactttggctttcgcttctttttccgcttttgccttagcttctttctcggctttttctttcgcctctttttctgctttgagcttcgcttcttgttctgctttctcttttgcttctttttctgctttgagcttcgcttcttgttctgctttctcttttgcttctttttctgcttgtgctttagcttgagcttgctgctctgcttttagctttttctgctcttcaagtcgtttttgttgctctgcttcttttattttccgttcttcttccgcttgctttgcaagggcttctaaacgttttgcttcagcttcagctttcaaacgggctgcttctgcaagtttacgttgtgttgcttcttcctgctgttttttcaactgttcttgtttaatttgctcttgtttcaatgcttcttgacgagccaattcttgctgacgtttttcttcttgttgcttctgctgagctaactgaattgccttctcacgttcttgttgttcagcaatttcttctggggtaggtttatcttcaacctcttccttaacttcctctttaggctcttctttaggttcaaccttcgcttgcccttgcttttcagcttttaatcgcccatattcagcggctacctgtccagtatcaaccatcacagcttcaagagattcactatcaccgccacttccgccagcagaagctaagtgagtattagtgaaaaaagaacccagtattaataagcctatcaacaataaatgcagtaaaactgacacaattatagcgagttctaatctatcattttgatatttcacgctctatcctcgctgactatttaccttcggtcattaaacctacggttttgatccctgcatcttttaataatgagatccctttcattacctcttcgtaaggtacgtctttaccacctgccacaaggaataaggtattattgtctttttggaaagcctcaccagcataagcaatgacttcttgctccgctaagttctcttgttcattaacttgaatgtagtttccgtcaattttcaatttgtacaaagcgaccccagcgatttctaaaataacaggggttttatcttcatttgaaacggattgactatggtgatcttcaggcaattccacttccacactttgactaataatcggtgctgttgccataaaaatcagcaataacaccagtaacacgtccaaaaatggcactatgttaatttcagatttaatgtcattacgtttacgacgacggtaagacatagtttcctctttatctatccattcaaactaccacaacaagcggtagcatttcacttaatttttacttattttttcgcaaacgctttgcgatgtagaattgtggtgaactcatcaataaagttcacataattctgctctaatttgcctacacgcaagttcaaacggttatatgccattactgcaggaattgctgcaaataaaccaatcgctgtggcaattaatgcttcggcaatacctggtgcaacagattgtaaggttgcttgttttaccgcacttagtcccataaatgagtgcataatcccccaaactgttccaaataaaccaatatatgggctgatcgaaccaacagtacctaagaacggaatgtaattttcaagttcttctaattcacggtttaatgcaagattcattgcacggctagaaccttgaataattgactctggcgaatctgggtttgcttgctgtaagcggttaaattctttaaaaccaacgtagaaaatttgttcagctccagttaaaccatctcgacgatgttctaacccttcgtgtaaacgatgtaaatcttcgccagaccaaaaacgatcttcaaagtttaaagaatcttttttagctcttgttaatacgcggctacgttgaataatcactgcccaagataacacggaaaaagagatcagtattaagataactaacttaacaacaatactcgcttccataaataatgaaactaaattaaattcagttgccattgataaaaactccaaataaaacaattacattgagattatagcgttaaaagcctgcttaatatcttcaggtatggcgattgctttcatttttgctagatcaacactcacgacaaccacactcacttcacacaagcactcctcatctcgccataatgtctgtttaaagactatttttgcaccctttagttcagaaataatgcttttaactgtgagaaaatcatctaaataagcaggttttttatagtcaatatccatttttttcacaacaaaagccattgattgacttaataatagctgttgagaaaagcctaattgacgtaaaaattctgttcttgcacgctcaaaaaaatgtaaataacgcgcgtgataaaccacaccacctgcatcagtatcttcataatacacacgaataggaaaatccattgcaatgccctatctatctttccaaaacgaaaaacgcccaaaaatcaggcgtaaattactcgccattttagagagagaaaaatcgttgtgcaagtatttttagagataaattaaatataaaacaagcaatatgataagaacccattgctttgggttcttaatttaaaggctaatgcagcacgactaatgcaattaatgaaggtaagataatggcatatcccaacaacggcataaaaaccatttgccatcgtgttgatttaatctcaaagccaaaaccgtgaaccaataaaatcaacataccatagaaaacgcctgctactaaataaggaatttttccaccaaagtagagagcaaaggtgttggaatagagcaatatcattgcaaacattgcaatagaaaggataaaagaaagggcttgtagccagccctttcttgtgagttgatagagtgaattaaccatcttactcgtcaaacttacctgttttttcaatacttacagtgattactgttgcaaacagaatagcaagtaacacacctagtacccaagttacataaaacatattggttctccttagtataaacttgcacttttctcttcaatatatttagcgtcaagacgaccaaacattttgaagtaagtccacacagtataagctaatacgattggaacgaagatacaagctaccacaaacataatcattaatgtgttatggcttgcagttgcatcccacattgttaaactcatttctgggtgagtaattgacggcattacgaatgggaacattgcaacacctgccgttaagatcacgcccgcttgcataattgatgaacataagaatgcaagtccaccattatttgctttagagctaaccacagtacctaatgcaccaatcaccgctaaaccaggaatgatgaataatacaggcatttcaaagtagtttttgaaccaagcaccgctttctaatacgactgttttgttcactaaactagattgaccattgtgatccaaagcactggtaatcacaaagccatctttgaagtaaacccaaacacctgcaagtaagaatgcacctaacgctactaaagcggtcacttgagcaacatttcttacacggttacgcaattcgcccgttgttttcatttgtaaccaagttgcaccttgagtggtaagcatcattaaacttaccacaccgcaaagtaatgcaaatggatttaataagcctaataatttccaaagggttgaaccttcgtaagttacttggtttaactcgttaaagtggaatggtacgccttgtaataagttaccgaatgcaacaccaaagattaatgatggaacgaaaccgcccacaaataatccccagtcccaagtattacgccatttttgatcatcaattttcgcacggtattcaaagcccactggacggaagaataatgccgctagaactaagatcatcgccaaatagaaacctgagaatgatgctgcataaaccgttggccaggctgcaaagatcgcaccacctgcagttaataaccaaacttggttaccgtcccagtgcggagcgattgagttaatcattacacggcgttcaacattgcttttacctaccattggtaatagggttaatactcccatatcgaaaccatcggtaattgcaaagccgattaaaagtacaccaattaaaatccaccaaataaagcgtagaacttcataatctaacatattttactcctacttatttcgcagattgttcaaagtggtaacgacctgtttttaatgcacttgggccaagacgaccatatttgaacattaaatacatttcaactaccaagaatacggtatataaaccacatagcaagccgattgagatccaaagatctgccgctgttaatgcagagttcgcaacccctgttggcaatacttcgtacactgcccaaggctgacgaccatactcagctaagaaccaaccgctttcaatcgcaatccaaggaagtggaataccccataacaatgcttttaataacaatggtttagtacctactgtaccgcgtacattttgaacaaatgctgcgataatgagtaataacattaaaccaccggcaatcatcataatacggaatgaccagaatgttggacctacgtttggaatagtatccgctgctgcttttaagatttgctcttctgttgcatcaataactttatctgtatatggttttaaaagtaaaccaaagccaagatctttttgaaccgctttaaatgcttctttatctgcttcagtatagttaccagaacgtaatttttctaataaaccataagcaacaataccattgcgtacacgttgtacattctcttcacgaagatctttcaaacctttaatttctttgtctaaagaacgcgttgcgataatacctgcagcataaggaattgaaattgccatttcatttttcatttcagcggtgttaggaataacaaacgcattccacgcagctggagctgggtgagtttcaaattcaccttccattgccgccaatttcacaggctgtgctttaccgatttcatagcctgactcatcacccatgattaatacagaaatgatggcgactaaaccgaaacttgcacctactgagaatgaacgacgagcaaatccaagatcacgaccttttaagatatagtatgcactaatacctaatacgaagatcgcaccacaggtatagcccgctgaaacagtgtgtaagaatttagattgtgttactgggtttagcactaagtcagagaaactgaccatttccatacgcattgtttcaaagttaaattctgaacctgcagggctttgcatccaaccgttagcaactaagatccacaaagcagagaagttagaaccaaatgcgaccgcaaaagtcgttagtaagtgtttaccttttgataaacgatcccaaccaaagaagaaaagaccaataaaggtagattctaagaagaacgccattaagccttcaatcgctaatggagcaccaaaaatatcacccacataatgagaataatatgaccagttagtaccgaattggaattccattgtaatccctgtcgttactcctagagcaaagttaataccaaataacttaccccagaactttgtcatatccttatacacttctttacctgttgttacatataaggtttccatcaccacaagaacgaaagaaaggcctaatgtaagcggtacaaataagaagtgatagagagcagttaaagcaaactgcaaacgtgagagttcaacaacgtctaacatctcaaacctctttatatatacaagtctgaattattgattacaagaataccaagtaatcccccaatcaacattgtttttgcacagttaccaatcaaagattaataagtagcaataatgtcaagaatctattctactcgtaaataagcaaataaaaaatagcaaaattattacattgatcacatttttgagctaaatatttaaaaaatatgaaatttatattgttacaacttgatataaatcaagttaggcaaaataccactcatttatctgcttagcagctttgtaaattatttgtgaatagaatttctagatttaacaaattatttacaccgtagataaagatccttaaatagtacgtgacgataccttgagatctatgttaatatgcgtaactttcatctaacagttaaactaatcattaggaacactatgaaaaacgctattttacgttcaatgattatcgcaactggtgcgttattcattgcaataagtggtttcactactgaattgaaaacatcttcactggtaatgaccaaacctcaaaccaatggcatattacctgaacagtgccaaaaaatgtttcaagaagttgataaactgattgctgatgcagaaaaacaacctggtacacatactcaaatgcagacaatgaagaacaaactctcttcatcaaaacaacagatcctcaaattagatctcatcatgcagaaaaaaagttgtaataaagggctggttgcgcttaatggactgaaacacaatagcaatggagagtaaagaacacgatctatgtgatctcataccctgcgatattactcccgacagtctaaatatttataatgatttcttaattgctattttgtctattacaccagctcctatattgataattctattcatcataataggtttccatatgaaataagtattctaaattcataaaaaaactgatctcatatctaaatataacgatttttaatagactaaaataatgaataatttttgttgattagaaagttaaagccttataacaataaggctttaacctaattcttatataaatttttgtatacaatcccttaaaaagctctctcatatgtcaggagcctattataggcaatgctacagattaactaaccgaattccaaatgggtaagttaaaatcttcttataatttaattccaaacttctcttctataagaggagcaaaatccgaataaccgccaacgtgaacctcatctaaaaagatttgtggcacagtcgcaacaggtttacccacacgcggttctaaatcttgtttttcaataccttcagcgatcatatcgacaaatttaaaatcgaaatcaggtaattctgctttcattttttctgcaagctgttttgctcgaacgcaataagggcaacttaatctgccgtaaatttctacaaacatttttaatctcctataaattattaggggcattgttgcccctacttctcattacttcgtgctggtacttgtcgtggtacgacttgcacgtttacgttctacttcagtgagtaattttttacgaatacgcactgattttggtgttacttccactaactcgtcatcatcaataaattctaacgcttgttccaagctgaatttaactggcgttgttaaggttaaagcatcatctttacctgacgcacgcatattggtgagttttttcccttcaagcgggtttacggttaggtcatttgaacggctatggataccgattacctgtccttcataaatttctgcaccgtgatcgatcattaatttaccacgatcttgtagtgcatagagcgagtaagcaagggctttacctgtgccgtttgaaatcaatacgccgttaatacgctgaccgatttcacctgcttttacatcgtcatagtggctgaaacttgagtaaagtaagcctgtacctgatgtcatcgtcataaactcattacggaaaccgattaagccacggcttggaataatgtattctaaacgagtacgacctttaccatctgggatcatatcacgcacttcacctttacggataccaagcgcttccatcaccgccccttgatgttgttcttcaatatcaatggtcacttgctcaaacggctcttgtttacgaccatcaatctctttgaaaattacttttggacgagataccgctaattcataaccttcacgacgcatattttcgattaatacagacaagtgcaattcaccacgacccgatacgctgaaaacatcagagtcatcagtttcttctacgcgtaatgcgacgttatgcactaactctttcttcaaacgctctaaaatttggcgtgaagtaacgaatttaccttcttgaccgcagaagggtgatgtgtttacacagaagaacattgtcactgtcggttcatcaacagataaagctggaagtgcttcaacattgttgatgtcacataaggtatctgaaatgtttaattcgcctaaacctgtaatcgcaatgatgtcgccggcataggcttcggttgcttcatagcgttgtaagcctaagtgacctaacacttgaccaacacgaccattacgggttttaccttctgcatcaatgacagtcacaggttggttaggtttaaccgtaccacgtttgatacgaccgataccgataacgcctagatatttgctgtaatctaactgtgaaatttgcatttggaacggtgcatcaagttcaacatctggcggagaaacttgccctacaatcgcttcaaagagcggatccatatttggtgcaagatcttcgtgatccaaacctgcaacaccatttaatgcagaagcataaataattgggaaatctaattgttcgtctgtcgcaccaaggttcacgaataagtcgaatacttgatccaccacccagtcagggcgagcacctgggcggtcaactttattgataaccacgataggttttaaaccgtgagcaaaggctttttgggttacgaaacgggtttgtggcattggaccgtcaaaggcatcgaccacaagtaataccgagtccaccattgaaagtacacgctcaacttcaccaccgaagtctgcgtgtcctggggtatctacgatattgatacgatagccgttccagttaattgcggtatttttcgcaagaatggtaatgccacgctctttctcaaggtcgttggagtccattacacgttcatctacatcaccacgagaagtgtctaatgtgcctgaaagttttaataatttatcaaccagcgtggttttgccgtggtcaacgtgagcaatgattgcgatattacgcagtttttgagtatctaattgttgcattgaaataacttaattgtagggtggggctcgcccaccgagaataaaaaatgatgagctaaagctcatctgacgaaatccaaaattgtgatgaagatcacaaaagacgagcgattatacagaattttgattgaactgactagaaagcaagcggtttgtttgaagtaaaaatttgcaaattatttcgaataacttaccgcttgtatgaaaactcaggcttaaataggctataatccccacataattttatttattggaaaatcgttatgcctttactagatagctttaaagtggatcacactcgtatgaacgctcctgcggtgcgtgttgcaaaaacaatgacaaccccgaagggagatacgattactgtgtttgatttgcgttttgtccgtccaaacattgaaattttatctccacgtggtattcataccatggaacatttatttgctggttttatgcgtgatcatctcaatagcgataccgttgaaattattgatatttccccgatgggttgccgtacgggattttatatgtcgttaattggttcaccttcagctgaagaagtggcaaaagcttgggaagcctctatgcgtgatgcgttagagaaagtgcctgatgaaactaaaattcctgagttaaatgagtttcaatgtggttcatataaggaacattctcttgctgatgcacacgaaattgcgcgtaatgtgttaaaacaaccgattggtattaaccgtaacaaagatttagcattagatgagaaattgctaaatccatagttattgctacggaactaacaatagtttcttttcaaatggtagggggctcactgagtgtgtccgctacattttattaccttgcaatttttacctaccatacttataaggaaagcccgtgttaaataaattatttgattggtttgaaaatcgcattaatccttatccagaagatatgccgaatacgcctcgagcaaaggttattccttttatttttgaaagcaccaaaggaatgagaagctattttgtggcgtttgatactcggacaaagtatgagcttttatcaggacgaggttgagcgagcctccgcctctgattttattccgcttctcagtgatgctaaaggcagaacaggctatgatgcacatgttggcgagcgaggggttaaactgtctggtgggcaacggcaacgtattgcgattgctcgtgtgatgttgaaagacacaccgattttattattagatgaagcaaccagtgccttagactctgaagtggaagtcgctattcaagaaaatttgaccgaattaatggaagggaaaactgtcgttgccattgcacaccgtttatcgaccattatggcaatggatcgcttgattgtattagataaaggcgaaattgttgagcaaggtagtcacgaggaattattagctctcaatggtgtctatgcaaaactgtgggatcatcaaagtggtgggttcttgcaggaattacaggacgatatataagatagaagaactatttaaatcaaagagttggtaagaatcaggaatataattattaccaactttttgttctacagccctatggggttattcatactcttctaaccaaatcgttaaaatcgcttccaagatatgttcatttgacgcttctggatcatcatcaaaatcttccatctcgcagatccatttgtgcatatcagtaaaacgcacggtggttggatctaaatctgggttcatatcatacagattttctgcgatcattcttacatcagtccatttcattagtgtgctgcctcatttgcgtgatttaagttatattttggaatttcaacaacgagatcttcttcacccacgatacattgacaagacaaacggctgtcgatttctaagccccacgctttgtctaacatatcttcttcttgatctgatgtttcatttaagctgtcaaaaccttcacgaattacaacgtgacaagtagtgcaagcacaagaacagtcacaagcgtgatgaatttcaactcctgcattgtgagcaacttctaataagttttcacccgcttgagcttcaacaaccataccctctgggcaaaattcttcgtgtggaagaaaaacaatttttggcataatgtcctctaatatcttctgtttatttgtagggacacactgcgtgtgtccgttatttattttgcggacacacgcagtgtgtccctactggattttatcccatcacctcatcaaccgccttacctgctaaggctttttgaatggataaattcattcgtctagcggcaaattcttgggtggcaagatcaagatctttaataccttgctggatagcttggcgatctgttccttgttttgcgtaaatcaatttctgtaattccgcttcaatccttttaaattcatcaaccgaaagtagctctgcaccatcttcttgcaacgcaataatcacgctatcaatcacacgatctgcctccacacgctgttccgccagctgacgggcttccatatcttgcttcgcattcgtcattgacgatttaatcatttcggtgacttcttcgtccgtcaaaccgtaagacggcttaatttggatagacgcttgcactttggttgatttttccattgcggtgacactcagtaacccgtccgcatcgacttgataagtcacgcgaatgtgtgccgcaccagcgaccatcggtggaataccacgcaaggtaaaacgtccaagtgaacggcaatcatcgactaactcacgttcaccttgtacaacgtgaaccgtcatcgcagtctgtccatctttaaatgtggtgaactcttgtgcttttgccacaggaatagtggtattgcgaggaatgattttttctactaatccgcccatcgtttcaattcctagcgaaagtggcaccacatctaataacaacatttctgcatcaggcttattgccgactaaaatatccgcttgaatagccgcccccaacgccaccactttatcggggtcaatagaggttaatggcgttttgccgaaaaactcgcccacttgttcacgcacaaaaggcactctcgttgaaccaccaaccatcaccacttcacgcacatcttgagcttctaccccagcatctttcaaagctcgacgacaagtcattaacgagcgttttacaagcggttggattagctcattaaattgcaaacggctgatttcaccctgccaatttgcaaattttgcagtaaaactctccgcttgtgacaagccaattttcacttgagtggcaagagtaagtagttcacgttgctgacttactgtatttggctgaatacctgcttgttccgcaatccaattcgctaacagatgatcgaaatcatcgccacctaaagcggtatcgccacctgttgccaaaacttcaaacacaccacggctcaggcgtaaaatcgaaatatcaaaagtaccgccacctaagtcatatacggcaatcacgccttcttgaccactgtccaaaccataagcaatagccgcagcagttggctcatttaataaacgcaatacattaagccctgccaaacgagcggcatctttggtactttgacgttgtgcatcatcaaaataagcaggtacagtaatcaccacgccagccaattcgcctgctaagcgtttttctgcaaattgatttaagtgacttaaaatatcggcagacacttcaatcggacttttattgccttgtagcgtttgaattaacggcaagccgttatccgtcgcaacaaattgataaggcagatttggataacgctgttcaacatctgccaaagaacgaccaattaaacgctttacagaaatcactgtatgttgcggatcagttgctgcttgctcaaaggcttccacaccaacaactttattctcagcagcataatgtactaccgacggcactaacgcacgctctttctcatcaagtaatacctgagcttgtccgctacgcaccgttgctactaaagaatttgtcgtcccaaggtcaatccccaccgccaagcgatgttggtgcggcgctgccgtttgccctggttctgcaatttgaagtaatgacattttattatctctctatcatttattcccccctttgaaaaagggggggctaggggggatttttacaagatcattaaatccccctcaatccccctttttcaaaggggcaagtgtaatacttaattcaccgtataccccatatcatcaggcgcaaatgtcgcttgataatggcgttcaatcggttgtttttgttttgtgtctaaatttatcacttgattgccgtttaaatctgcaatctcagcttgccaattttcactacgcaggctgtggtaaaaaccagcaatatcggcagttaatgcccagccgataaattgtgaataatttaagccaatactttcccatttctgctttttcgggtggaaataatgaactaaaccgactttttcgcctaatccgcccccgttcaccgcaaaataaccaccaatggcatcatcagcaatcagtaaatgaaacggtctttcgcccgattgttcaaaggttttaccaaaattccactcaaacaaaccgcgtggcagtttctcattacccgaacctaaaatgcgtaaccagccgtgatcgactaaaataccgcccgtttcataaattaccgcacccagtggcgtacttgtcggtaactgcattcccaccaattctgcccctgcattttccacatctctcggcaggatttcataatggttattcgcttgcttgaaccaatcttgcataattgtccaagcggatttttgtttatcattcagctcttcgagggttttcatatttatttttctatgtagggacgccacgcgtggcgtccctactttcttttgtgcgaataccacacaattaaaattcaaacaacttctcttctactcgctcaatttttacttttttagtttcaatgtcgcttctaaaaaatgattaaaatcacttctgtaaatacgatcctgctttattctaaatttatcatattcctgttcagcttttaattttgccatttcgtgacttatttttcctttatctcgtaaaatcggataatttgataaagttaagaagctatctaaaaaagtttcccattctgccattgatgttaaaatttggcgagtagctctattctctgctaaatctaaataagctgaaaccaactgttctaactctttaatatgttgctcgcttaaataatttttagcaatactgacatcactctttaaaatttttccatccggtgcatttttccaagttgttaatcccatatttatagcttctgcatcggcttgtgtataaatcaactctgcagctgttttgcctgtaatcgcccaatgtaattgattttgaacagtggaaaaaaagcgttttgtatgggcggaagatttatcataatcactggctagagcataaatatcggtaattttctcgtaaaatcgtcgctcagaagctctaatttcacgaatacgttcaacaagattagtaaaataatctaaaccaaactgtttaccttgtttcaaacgctcatcatcaagtacaaaaccttttaaaataaattcacgtaaaacttgagttgcccaaattcgaaattgtgttgcttcccgactgtttacacgatatccgacagcaataattgcatctaaattataaacattcgtcaaacgagtaacttggcgatgaccttcttgttgaactatttccattttggaaatggttgaaaattgaacaagttcccctgtactatagatattatctaagtgtttagaaatagccggaacatcaacaccaaacaactcagccatacttttttgagaaagccaaaaagtctcatcttggtaaaagacattcacttttactgattcatcaggtgtcgtatagaataatatattcgcactcgttggaatctgtaagttagacatgttaattcactcgtcaaataatcggatattttaattatggcgaatctgccataattaaaactcaaacaacttctcttctactcgttcaatttctaccaataattttttaataaaacgaagtttgtcgttaatggctagtgcatccgcccattgttgtgcattaagagcttgctcaagttgttgtaaaatggctttttgctgttgttcaatctcttggtcgaaagcggtgagatccgcttcgttttttgtggtttcaatgctttctaaggtttcacgccattccatttgttgcattaaaaacgccatatctcggttacttttttgctcaatatcttgctgttcacccgtatgaatagcgatgatcgcttcagcacgcaaaatcggatctttgagaatatgtaacgcatcattaatttccgccgatttctgcattgctaaacgctgttctgtcgcagaacttgccgcaaaattatcggggtgaagcgatttttgtaaggctaaataacgctcagagagttgagcattatctacttggaattgcacaggcagatcaaaaagcgtaaatggatttgacatcagaacctcttagacgttaaaactttcaccacaaccacattcattcttcacatttgggttgttgtacttaaatccttcgtttaatccttctttgacaaaatctaattctgtaccactcaggtaaacaaggcttttttcatcgacgataattttaacaccctgttgttcaaaaacgtgatcatcttcgtttaatacatcaacaaattcaaggacataagctaaccctgaacagcccgatgttttgacacccagccttaaaccgatgcctttgccacggttttcaaggaaggtacgaacacgatctgccgcggtttctgttagggtgatactcattttttctcctaatgaattgatttactaaaacgtttgtagggtgggttttaacccaccattaataaaagagatggtgggttaaaacccaccctacaaccgctttaaacgcaagcggtcagattttgcaaattttttgcaaaaactaaccgcttgttagagattacttaccgtttttctctttgtaatctgcaatcgctgctttaattgcatcttctgcaagaattgagcagtgtacttttactggtggtaattcaagctcttctgcgatgtcgctgtttttgattgcttgagcttcatctaatgatttgccttttacccattcagtaattaatgagcttgatgcaatcgctgaaccgcaaccgtaagttttgaaacgagcatcttcaatgataccttgtttgttcactttaatttgaagttgcattacgtcaccacacgctggtgcgcccaccatacctgtaccgatatctgatgcttttttgtcgaatgaacctacgttacgtgggttttcatagtgatcaataactttatcgctgtatgccattttttaattcctctgttttattctgcccccgtttacgggggaagtggttgagcgaagcgaaaccgaagggggattgaatatatagaaaaatttacttgattatttgcccccatcaccttgcttcgcaaggtacttcccccattacatgggggaagaatttcattttaatgatgcgaccactcaattgagtttaagtcgataccttctttgaacatatcccaaagtggtgaaagttcgcgtaatttagttactgcttttttcacgatttcgatagtgtgatcgacctcttcttccgttgtccaacgaccgattgagaaacggattgagctgtgtgctaattcatcgtttaagcctaatgcacgaagtacataagatggctctaaacttgcagatgtacacgcagaacccgaagataccgcaatgtcttttaacgacatcatcattgactcaccttcaacgaagttaaagctgatgttcaagttgctatctacacgtttacctgcttccatcgtaccgttcacatacacttcatccatatctttgaaaccgttaaataaacggtcacgaagtgctttgatgcgtggcatttcagttaccatttcttcttttgcgatacgatatgcttcacccatacccacgatttggtgaacaggtaatgtacctgaacgcataccacgctcgtggccaccaccgtgaataatcgcttctaaacgtacacgaggcttacggcaaacatataaaccgccgataccttttggcccgtaaagtttatggcttgagaaagacattaaatctacgtttaatgcttgaacatccacagggattttacctactgattgtgttgcatccacgtggaaaatgattttttttgcacggcagattttaccgatctcttcgattggttgaataacaccgatctcattgttcacatgcattacggaaactaaaattgtgtctggacgaattgcagcttcgaattttgcaatatccactaaacctgttgtttcaggctctaaataggtcacttcaaaaccttcacgctctaactgacggcacgtatctaataccgctttatgttcagttttaaccgtgatgatgtgtttacctttggtttggtagaagtgtgctgcacctttaattgccaggttgtcagactcggttgcacctgaagtaaatacgatttcacgagcatctgcaccgattaaatcagcgatttgattacgagctacatcaaccgcttcttctgcttcccaaccaaatttgtgagaacgagatgcagggttaccaaacacgccgtcctttgtcatatattccatcattttttttgcaacacgctcatcaacgggcgtagttgctgcgtagtccaaataaattggtaatttcattgttactcctaactaagagatttttataagattaatggtaatgatcgtggcagtgagaagtctcacaatcgtgatcgctattttcttcaactaattcggctaaagttatcgtatgtaaatactgttcgatttgattttctaaacgctcccacagcgaatgggttaaacaacgactgttattactgcaatttccattgcctttacatttagacacatcaacactctcatttacagcggcaataatcattcccacattgatttcttcaacagattttcctaattggtagccaccgccaggacctctcacgctatgcacaagaccttctcggcgaagttgtgcaaaaagttgctctaaataagaaagtgaaatggcttggcgatctgaaatatctgccaaactcactggcatatctttgccatgcaacgcaatatctaaaattgcagttacagcataacgtcctcgtgaagttaatttcatactcaaactttttaaaaatgctcgattgttaggaaagaattctatataccctactaatttagtcaatatttttacacaaattaaatcaaaaggtttttttaatcaatttgctaatcttattcacataaacattattttaaagtttagataaaacactaagcggcgaaattctaaactatttttataaccatagttaaaatcccaccgcttacgtcaagattacaaagttagcaactatttgtaatcatattgataataatcataacgattagaagccttacgttttataccattcaaaataaaacctttaataaagacccctgcacgttcaaaacgttctttagctaatccaacttctttaagtgtagtttcaccaaaacgcccaacaagtaaagatgttcccgcatacctaccaataatagctgcatctgtaacagccaaaataggcgctgtatccactatcactaaatcatattcttttgctgcccattctaatagtgcctgaaaacgagcattagatagtaattcagatggatttggtggagtttctcctttaacaataatatcaaaattatcataatgttgaatcacttgttcaaaaggaatttgctgtgcaatcacatcactcaatccaacctcttttgctaaacctaataatcgacgcaaataactccttcttaaatctgcatcaattaacaacactttatgcccagctttagcaagaacattagcaaaattggttgaaataaaactttttcccacagacggagaagctccagaaatcattaatatattatttttagcttctaacattgcaaaatgcaaacttgtacgcaaactacgcaaagcctcaactgctggatctgtaggcgttgactccgacaataattcaaaacgctgaaccttatgcttagaaaaaataggctgttcatttgaatatggaatcgtagcatacgttggcaagcctaacacatctaattcagatgttccctcaatacctctatgtagtagcgttttcgctatcgcagtaattgaggcaaagataagtcctaacataaatgccaaggcaaccacaatcatttttctaggtgaaacggcattaggaaaaacttgcgcctcgtctaaaatacgaacatttcctatcgcactagccttaacaatttctaactcttgcattttattcaacaattgaatataaatttgctggcttacctccaaatctcgagttaaccgaataacctctttttgagtagtaggtaaacgttctacttgtttatttaaacgaattttttcctcatttaatactttacgcttatcaatcaaagcaacataagcagggtgatttcgagtgaacttttgagaaatttcactctcctttaatgttaactcatttaaatctgcttctaactgaactatagtatctaatgctgatttagcttctagactgagatctactgattcattttttaagcggaattcattcaaattattctcagacgctgacaaacgagctttaatttctggtaattgtttagacaaaaactctaaactcttagacgcttctgcagaattacgaacaatattttgcagcaaataattttcagatacactctttactatcttcttaatttgagctttattctctccattaatagaaatttcaataatgcctgtttgcttaccactatctgttaccgaaatttgtttttgtaaagtgctaattgctaacaacacatcattctttttaattttaaataattgtcctggcttagcctctaattcagaaatctcaaacgaaaaatcttccgtttgatactttttcccaatgctcccttcaagaactttttcatctgcaaaaaataatgagaactctccagcattctccccgacctctaaaatcacctctttcatctgaggattcttaggctcaaataaagagaccgacaattgtggttcatatcccatcaaacgatgaatacctttactaagaaaagggatcgagaattgaggttcaactaccgtagttaaattaagttgctcaacagtattggataaaaccattcttgattttagaattgcaatttcagtacttgaagatgatttaccctctaaaattcctgcgaaatcttttaaccccccccctgaagatttactttctacttgaattgaagcattcgcagtgtaaacaggcgtagctagtaaaacataagcaacaccaaataacgtcaccaacaatgtaaaaatagctatccaccacttataatctaataaagcccccaacaactttactaaatcaatttcatcatgattattttcattcatcttttaactgccttaaaattagagtttcaatttccatctcaatgctgcatcctcaatcaatgcataaacctctcggaacatatcttcactttgacgataaggatctggaatatctttattgctatccaaccaatgaccaaataacatgacttttccagaactttctggtgaaatttgtcgaaccaagtcaatatgacctttttccatgacaagaatcaagtctacattcttacatagttcagacgttaattgctgtgaacgatgttcagaaagatccactccacgagaaatagcaacttgttgcattgttggatctacaccttttccaactaaatggctacgctcagctgaaatacctgctgaaaaaatacgcttttcaggaaaatattgttttaataatttttctccgacgggggagcggcatatattaccgatacaaacaactaaaatacttccaaacattaattaccaattcctcactcttaatatagactctgttagattattgaaaccagataatgacggaacaacatgggcaatcactctattccaacgagttgctggcgctgttgtcacataaacaatgtcataaggttttaaataaaactctgttcctaatacataggaagttgcattagtcaaatccaattgataaatatctgcaatcttatctgttttttcagcttcatttgaaaccgttgacttatttacatcacgttgaccacgaataacaaaaatacccgttgcatctgcagataatttatcaattcccccactctgagcaattgcttcggttaacgtcataccataatgagtaattttcaacatctgaggttttgacacttcccccacaataaacaccttattcgcatcattgcgtggaatatgaaccacatcgccatcagataacaaacgattctgcgttaaattaccaaattgaatcaattctgctaaagagactttctcctctttaccatgacgagtaatagtcacattatgccagtcagcattttcagacaaaccgccagctttattcactgcatctaataaagttaatggaacattagttaaaaactgctggccaggatttttaatttcccctgttacataagctttcttagattgatatgctgcaacagtcacttcaatttgaggatcggtaacataggcagatagctgcttcgccaatttatctctcacctgattaaccgttagtcctacaacctcaacttttccgacataagggtaaaaaatcgttccattggcatggacttggttacctgattcagcggcagaacgataagcacccgcaggagttgtcaattcaggatgatcccaaactgtgacatttaatatgtcgccaacacctatcttatattgataacgcttaatttgttgttctaaaccaatgttatcacttgctttcaccgcacgaggagctaactgctttactaactgaggcgtaattaaataagcatccacaaccttctcaaagtccacattctctcccctcacttccgtatcaacaataggagaatgcgttgcaggtaaaatcatcccacaaccagaaagagataaaatcacaccagtaaaaacaagagctttagttaacttacacataatccatcctactcattttataattaacaaaatccatcagaatagctcaaaactcacacaccaaacgtcgaattgaacttaataaacatcgttccagtatacaacaaaccacatttatttgcacagaaaaactcgaaaagaaatatcgatttgacacacacattttgaggtgtaataaatcttcactattctactatgccttctactacccaattcttattctcactgaatatatcaaaaaggaataggctaatctaaatatactatttatctacttgcatccgccaaacaaaatccactattttacttaccggagtatacccaattagagaattcaacaaaatatcacgaatcttatcgcattgattatcttgacaagctaactctaattcttcaagtaaagctagcaattcatttaacggcaaaaaatcttcttttgcagtcataatacgatgatgtgcggttgtttctacattatcgcctgcaatcaataactcttcataaagtttctctcctgatctaagcccagtaaacttaatctcaatatcaccagttggattatcttgatttttcacctctaagccagataagcgaattaaatttaccgctaaatcaacaatcttaacaggctcccccatatctaaaataaatacatcgccaccttttgccattgctcctgcttgaataactaattgagctgcttctggaattgtcataaagtaacgaataatatttggatctgtgaccgtaatcggaccgccttggcgaatttgctctttaaatagcggaataacggaacctgatgaacctaaaacattaccaaaacgaaccatagagaaaagtgtgttatgttcaacaccgtctaagctgtttctcttttccatagccaatgcttgcaaacacaattcagcactgcgtttagttgcgcccattacgttagtaggacgcactgccttatccgttgaaatcaatacaaaagagttaacttgagcttcaatcgccgcctgcgcagtataataagtaccaaaaatattatttcgcacaccttcaactacattatactcaaccattggaacgtgtttgtaagctgccgcgtgatataccgtatccacttgataaacccgcataatttcaactaaacgtttaaagttctgaacgctccctaagagtggaataatttcaatatgacctaactgctgagttttaacaatttcgtttaattccctttcaattgcatacaatccgtattccgaaatctcaaataaaagcaatttacgaggttgattacgaataatctgacgacaaagttccgaaccaatagaaccaccagcaccagttaccatcacaatttgctgttgaatatttttactgaataattcaggaattggcgccacaggctctcgacctaataagtcaataatattaatttctttaatatcactaatagaaactttcccatcaacaatttgagttaattccggaatttccataatttttactttagcgtcagataaaaacttcacaatctcattttttctagcacgttcaacggatgacaaagcaataatgacttgatcaatctgataacgttgaaatttctcaagcgcattctgagcagaaaacacttttagacgccctaagcgagtattcgccaaattctcattatcatcaataaaaaagataggcaaatgctcgtgagaacgaagcaacaacacagccaattgctgccctgcagatcctgcaccataaattgcaattcgcttacgcggagtatccgcttgtaaggcgtttttaaccaaagctctaataacacctcgactcaaatatacccaagcaaacataaaaaaaccgaacatcaaaggaattgatgtcggaataaccgctggagtgctatcgcctaacaaaaatagtgcaataacagtgatcaacgttgcaatagaaagctggaaaattaacgtttcagagaatgtatgaataacaaagtgataaaccccacaaatggctaaactcgctacagcaataattgaaactaaaatttcaccataaggcaaatttggaatagcttctgcatttaaatcaaagagacgtaaagcataagctatccaaattaaaaatggaaaaatacaaaaatcaataaataataaaataaattttttatatattcttggaatatatattgatgaataaataaatgacattaacatattgttatcttaccctgtctacacttcttttcctaaaagttagcaacaaaaaattgtaaatacctatgcaatctaacctttctatccatttgattttacctaatgatatatctacccaatctgttgaataattgatttaatactacttaatatgtattttaaattatcttcagtcaaagtaggatgaaccaaaaacattaaactcgtttcacctaattttttcgcattttctaaacgctgttcagcgtctccaaggcgtattatcaaatgctttttctaagtacacttcagaacaagagccactataacaaggtgtgcccaattcacaaatcgcattcataatacgatccctattccaatcttgtggtaatgcctcaatatttacctaaaatcagcggttcattatacactaaacttagaatagcccctacatttaaaatggaaacatataaaaacaacacataataaaacaagtttattttgtatattcttggaatatatatgatattaacatattattatttcactcgatctccaaaaccttttcctaaggctgttaaaactatatatttaaagtaatatttcaaattcaggtttttgatcatttcagaatcggtttttgctaataattctgggatagacatatcaatatcacttaattgagctaatcctgtaatacctggtagaacgtcatatacactatatttttctctttcttgaataagctctttttgattaaaaagattgggtctaggacctactaaactcatttcgccttttaaaacattaattaattgagggagttcatcaattttagtttttcttaaaaaacgacctaatttagtaatagaagatgaacctgcaagatgactcgccactgatgcggtattaacattcatagtacgaaatttaatgagtttaaatggtttcttatttttaccaacacgttcttgaataaaaataggcgaacctgtatcaaaataccctaagatagttactataacaagaataggaaatgtaaatacaagacctaaaatagagaataaaaaatctaaaattctgatcataaattttcctataagctaatattaccaatatatttgaacagggaattgagacaatgcagagtcacagctaattaaagtcaaattttctaagatactctgagcagctaacattctatcaaaaggatcttgatgttgttgggaaaataacccagctattgcggcatggcttaacgttatatctaaagctgtaaaatcatcatcttccaataattttacataatggttaaatataccttccacctgtgttaacttgccttttcgatatttcgttgcgatttcccaaatagttgctgaactcacatatacttcagaactaggattagaaatagcttgaataacctttggtgatagtttttctggctcagtccaccaccaaatcaacgcatgagtatccaataaatatctatttactatagctttaattcttcttcatctaatggctcaaagaaacgttcatctaatttaatcccttgcccaactaatcttcccgcttggcgttttttcttaacacctgtttgaaccatatttagctgagcaataactttaccgccatgagtaaatagcacttcttcgccaggcttcgttactaacagtaattgctctatcttttgtggtgaaatattgagatctatttgcatatttccttccttactttgattcagtcaatctaacactttccctaaaatccctaatttggtattcaaaatcatattgactcattgatttttcataaaccaaattaccaaacaattttttcacaatatccaatttaaacattaatctaataaccggattaaatgcttttgtcaaaaaaacttttctgtgagaaacttctgcaatttctctaaccaactctgaagtagatacatattctttattttgtggaaaaaacaaaccgcttttctctttatcaataatttgcttgataaactcacaaagattatcaatatgcaacatacttctctgattataaaaatcagggaaaattggaagcaatttagcaagtttagataacttagggtaatttcctttcgaacctttaccgtaaatcattggaggacgaagaatagcaattttaaaattatcctcagctagttgacttaatccctgttctgcttgccatttactgtctccataaatatcatttggagatggttcggtcgatgctgtaataactctattatttaatgtactatcaccataaacaattatgctactcataaagataaattgtttaacccctgataatttggccttttgtgccacatctacagctaattgagtattaacttgtctatataattctttttgagaaatgtctttggaaaaattagcaatacctgcaacacgaaataccacatcatattcggagaaatcgtaatctttccaatctaaatttcgtagatctaatgtagtagtatcatatacattatacttagatagccaatactctactgatgaaccgatataactatttttacctgtaattaaaatctttttcatttatataactctagcaaaaaaattatttatcaagaagctcaactaacttctttacttgtttttttatctcaaattgttctaaaaaatatctacgcccattttctcccaaacgtctctgttcttcatctgaacttacatacaatttcttgatcattttagcaagctctaccgcattttctgcttcacaagtgtatccagcttgcgcctcttcaataattttagcgccctctccattaagacttgcaattataggctttccagaagctaaataggtttggactttggctggtatagtttggctatagatatattcattttttaaggttactaataatccctttgctctagataaaaactgtggcatttcatctgaattatatcgcccagctaaaattatattatgaatattatttttaaatattgtatcttccaaccaagaagacatactaccagagcctacaagaactaattttatatctattatatcttgtaaatatttggctgcatcaacgatcgtctctactgcttgagcagtccctaagttaccagtgaatacaatacaaaaattattatccaataaatctaaaatctcttttggcacttttgttggtcgagatatatctggcaattcatctacggcaaaatttgggaaatacctaattttatctcgttcagtatactcagcaacaggatctataaatcccctcgactgtacaaatatcttgtcagcctttgaatagatccatttaaccatgtagccaatgccattcaatataaatttatttttaatatatcctgtagtactcaaactttcaggccacaaatcaagaatccataatgtaagtggtgtttttgttttatgctttaaataaatagccggtatagctgcagtaagtggagatatattaaaagtaaatatatgatcataatttttatattgtgcaaaattatagaaattacgaactccataccaaatgaaagataagtaattaatagctaatcccttagcacttttttgtcctcttggatataatggtactctatatatcgttgctccaggtataaactcttctacttgtaatccatttttttcatagccttcaaaaatattcccatcaggataattcggcttaccagtaaaaatatcaacagtatgaccttgtgaaactaactctttcacaagatcattaacagagaaagtttcaggccaaaaatattgagtaactagagcgattctcattattaatattttctccaaacaacacggctaacataatcagtgtaacttaaaataatacgagcaaccttctcacttacatttggcatactataatcctcaactaggagtaatgttctcacttctcctcttgattgagattccaaaatgtttaatccttgcaatactctatcagttgtcagcccaaccatcattactgcagcttcttccataccttctggccgttcgtgagcttggcgtaaattcaatgcggggaaatttagaatagaagcttcttcattaatggttccactatctgataaagttgctttagctgacagctgtaacttattatagtcactgaaacccagtggttttaacagctgtactagtgagtgaaacttaacccccatttcctcaactctcttgcgagtacgagggtgagtagatacaataacaggatatttatacttctctgcaacggcatttaacatttcaactaaatctaaaaaattcttatctgaatttatgttctcttctcgatgtgcactaacaacaaaatattcattttcttttaaatttaatcttgttaaaacatcggaagcataaattttatctttataataatttagcacttcaaacattggactccctgttttaattacttgatcaggtctaagtccttccgccagtaaataatctctcgcaatagagctatatgttaaattaatatctgcagtatgatctacgattctacgattaatttcttctggaacacgcatatcaaagcaacggttcccagcttccatatgaaatgttggaatcttacgacgtttagctggtaatacggacatacaactgtttgtatcgcctaagacaagtagcgcatcaggatttacttgttctaaaatttgatctactgaaataataacttttcctattgtttcagctccggtagaacctgcagcatttaaaaaatagtctggctttctaataccaagatcagcaaaaaagatttcattcagctcatagtcataattttgacctgtatggactaaaatatgttcaaaatatttatcacacgctgtcattaccctagacaaacgaataatttcaggtcgcgtaccaaccacagtcattaattttaattttttcatacatttttctcttcatcattgagttaaaggcataaaataagtgtcgggcttttctctatcgaaaatttcatttgcccataacattacaaccatctcttcattgccaatattagtaatatcatgcgaccacccaggaaccgtttctacaattcttggttcatcgccatttgtctctaattgataatattctccagttacaatatgcttaaatttaaataaagcttttccttttattaccaaaaatttctcattttttgaatgatggtaatgcccgcctcttgtaatgcctgggtatgcagtaaaataagaaaattgacctgctgatggtgtttttagcatttcaacaaagactcctctctcatcgccatatttaggcacagaataatcgaaatgctcgggagtaaaaaaacttaagtaagtcgagtataaagctcgttttagccctacacctacttcatctgttactaatgattgtcttgagtgcttaaatgaagctaaaatttcaactaactcactaactgtcaccttatattcaggttcaacttgataaatgcctgtaggttgatataaaccttgaataatattccaaaaacattctacaacatcatcaatatacaccaatctaattacggcattcggatcgtggatttcaataggtaaattgtgtactgtattataacagaatgtagcaacagcagaattatagttaggcttagaccatttaccgaaaacattagctaaacgacaaatatatataggattaccgtttaatttagataagttagaaataatatcctcaccagctaatttacttcttccataagcattatctctttcagcttgaatagatgaagataaaataagcggtgtttttttattatttttttgcaaaaatttagctattttttgagttaattcaatattaccctcgataaattcttgctcatttttaggacgattaattccagctaaatgaactatccaatcagcctctaacaacatagaattaagttcttcttctgacgactgacgattaaatagcattatctcaatatcatttttttcagaaagatattggattaaatttttggcaataaaaccatttgagcctgtaactaatactttcatattattcctctggagaaatatattcacctttaatcattgagcgaataaattctagtttcaaaagtaattttttcattccttcaacatctaaacgctctgtattatgcgaattataatctgtcacttcagaaattcttagatttcccgtttcaacatatttaccataatttagatctcgctgatctgctgggactctgaaataataaccttggtcgattgcgtgaagcatttcttctctacttaataaagcttcaaacgctttctcaccgtggcgtgttccgataatgtcaattgggtgatttggtacagaaagtaactctgtgatagcttttgctaaagttgcgatagttgcagcaggggctttttgaacaaaaatatcaccattttgaccattttcaaaagcatatagaacaagatctactgcatcatctaacgtcatcataaagcgagtcatctcaggatccgtgacagtaaatgccttaccttgacgaatttgatctacaaataacgggataacagatcctctagagagcattacattaccataacgggtacaacaaatagttgtccctgttccctctaaattacgagatttagctacaataactttttccatcattgccttagaaatacccatagcattgattggatacacggctttatccgtacttaaacaaacaactctctctactctattttgaattgccgcttcaagtacattctcagtacctaatatattagtcttaacagcttccataggataaaattcacaggatggaacctgttttaaggctgcggcatggtaaatataatcaacaccacgagtcgcatttaatatactattataatcgcgtacatcacctatataaaactttagcgtaggtgagttatattttttacgcatatcatcttgctttttctcatctcgagaaaaaatacggatttctttaatatctgtttgtaggaaacgtctgagtacagcgttaccgaaagaacctgtaccaccagtaataagaagaattttatctttaaacatagccacactaataccctaacttaaataaacagtcctataccataacaaaggtcattctttgatatcacaaagaattttattatacagtttataatattcttcaaacttcataaacttatcaaatttttttgcttgttcaatacaatcatttctattccactggtacgatttccaatgattaatgtgaaaaacgacatgctctagctctcctttttccacaactaccccacatttatccgttaaacattctgggcttccccccgtattataggttagaacgggagttccacaagccagagactctaaatttgtagtaggaaagttatcctcataggtaggattaaaaaatatatctgctgcttgatataagctagctaattcactcacactatccgttctttcaatcgcatgaatattatatctttctagatattttttctgttttaaggttacacctaccattataatctcatatttatccgtatctaatagatttgataattttataaaatcagcaaatccttttcttttattccaaacactagcaacccctagtatttttaatctatcattattaatacatctgctttgtttaaaatgatgactatttggcttgaattgttctaaatcaataccattagctatagtataacaaggatactgctttaaaaaactttttcctacctcatttcttaaccatatagaaggcgttactaaatataaattctttaatgaagtaaatagtactctttttctatgaaaattatttaagctattgtcgataaaactttttggatactccgaaatttgaggacaatcattacattccttttgccatttttgacaattaattgcatcatagtaagcacaatggcctgtaaaagcccaacaatcatgtaatgtccataggacaggtttattatattctcttaaaaaattaaataataattcaatattcaagtaataaccatgaatattgtgtaaatgaattaaatccggagcatattcttttatttttttgatcattttttttgtataagagctagaagcaaaaccagctttatctgtaaccctagcataaataacatgcaatctgaaatctaaatcagatcctattttaaatatattatcatctaagattttttttcctctaccatagacaataactccatcagagccttgagattggataatatatttcaaatctttaacaattcgaccggtactaccaaaattataaactgaatttaataacaatattttcatttaattctctttatagttctattccaaaaaaacataaatagtgaaattatcaagcaatagtatagcaacctaacactttcccttaaaatatattgagaattcataaatacaaacccacaaaagaatgatacaaatataatataaactgggtgattttcagaagcctttaacatccagtggaataaaaaaccacataaaaaataaaacaatatatgataacctattccttctcgataaaccataacaattcctggcacaggagaaaaagcatttaccattgcctggtcatataatggctgcacatttaaataagaactaggcaatgggtttatacttattaagaatgcatctgtaccactaagtttctgttctaaagcatattccatttcatatactgaaaaactggtcacataattcacccctctaaaaaaaacatctaggctaatatcaaaaatgtaagataaatttaatatgttatatataaaaccttgctctgacaccccccttaaaataagagaggatatagaaaaaaaatcacactaaaaataattatggatttatacaaaaaacctcttttaaaacacaaaacactcccaatataaaacatcattaaatctaaggatattattctagaattgaggctaaaaggaacacttaaaataagaaatagaaagttatacttcaaatatttatttcgaataaagccacatagaaaagatgaaatcggagataacactttaaataaaataactaaaaccctatgagtttcattagtaacatacttctgacgataaagtaactcattaaaatcaaatgcaagaaaactaataaatattgaaaataaaattattattatacttatacagtacggaattttaaattctaaattaacattattccattttataggataacgtttagaaaataatataccaactataaaaaaacacacagctgaacatatcaaaacaccgctctgtaaaaaagaataatcattataaatctgataataaaatggaatttcctctgcaaaatcaaaatatttagttcctatataagtgtatatatgtataaaagtaaagaaagctggaaatatgtatactagatctttattttttaacttatttagagaataacatagaataaaagattctattaatatcaaaaaaacaaccataacatttatctcctaaataaattaacaatattcctaataaagaagaaagctttagtttgaataaaaaaacctaataaatatctaattttttttgtttttctaaatgcctgtaacaaaaaccccctaataacagcgagatgttttaaattattagacgacatttgatcgcaatgtatgcgataatatagtagaacatcatctaaattagaaaacttcttattcaataatattgctctaatccataattcataatcttctgcataagctatctcttcattaaacccttttaaatctataaaaaaatttctcttggctaaaatagatggatgaactaattcacacttccaagccattttttttataatatcattatgttcagtagacatatgtgatctatagagtagcctcctgctatacacatccatatgctgcatattacaacctactatatcaatatttttgttagagagcataaattccacttgtttttccaatctaactggtaatgaaatatcatctgaatccatacgagcgatgtaatcccctttagctaaattaatccctttatttaaagtctttggaagttttaaattctgctcattttcaatatatttaattctaggatcttcctcggctaacctttttaaaatttctcctgtattatcactagagcagtcattaataacaataatttccaagttactgtatgtttgctccataatagatctaactgcactttcgacaaaattctcagcattatagcaagggatgataactgaaactaaaggaagactagtcattttcaacctcaacaattgaaaaattaaagttatcctgcatcatttcatagatattacttaaatcagtaggaaaatctttaatttttattaaattaatctttacattaggtaatcctattaaagaaataactgccccactaaaaaaagtataaatcacatagtccgtattttgagagtatctttcaaaaaagaaatcctcgaaaacttttactgtttcaatatatttatttttaactgataaaaaattattttctctaggatgaggaaaaaagcaatcaacatctaatttatctattaatttattaaccgctctaatatgttcagtaattttatattcacccgttttatccatttcataaataggctgaccaacaaataataccattttattagtacgagaataatccatttcagaattatctttatcatactttacatcattaaatagcctaatatattctacattatctacaatattaggcttatctttataaatactataatgtttttgagacttattttttaataatgccattgttgtactactacaacatagaaagtaccttaaccatgctattttcttagaaaaatttgtatctcgataaaaaaagctatttttatctaaattagcagttccatcatcaaaagtttgaatgacaacatccttattcttctgtataatggtgtggatgtggatgtggatgtggttattatctatactccctaatataattttattaacttgtaaatatttattatttaagatgctttttagtctatatttgatacacagccagattaattcaaaaccatttctgaaatccacatgaatgaactctgaatctcttattttcgatttaagacgattaaaatagtaatctgttttattattttttatattagaaataaacctaaaaatatactcttcattaggattcatctctacaattttttctgccaacaaaacctgaaacggtgtcgtacaaataatcaaattcatctaaccaactctcttcgtcataaaatataacacaggcaaaatccctcctgccccaacaacactcgcccaaggtatatagctaatctccgtaaacattaacccacctagtgcaatcaaataaatccctgtcgataaaacagagcaatatgaaatctgttttgtttttccatgataaaataaataatttactaaaaataaatagggaataatcaaacttgttgaaagcaagaatagtgccacatagtatttcactccctgaaactgctcacctaacaaccataaaaatagttgttcgggaattaatagtgttatcaatgaaggtattggtacaataaacaatgaatacattgcccatttttgtaaatgttttaatgttacggtgccttgttttaatctttcaaataaataaggaactaatgctttgtttactgccaaaataaccacagataaaatactcgcaatttgcgcccccatcgcatacaaaccaagatcagcttcgctaaatctgtgataaataaagattctatctagttgcccttttataaagaaacttccgtgatgaaatatcattggaaatccgaaagcaattacataccataatgcgagtttatattgtgcgatgctaaaaattttagtcgctgtttttcgtttataaataatataagctagaacagcaataaaaatattgctacatagtactgcaataatacgcttttctgccaacgcggtttcatagatttccaatattaatactgtaaatactgcattggttattgctgagcctaattgaatcagtgtataaggaaacgcttgtttttgacattgccttatactaagttgtactgcaagaaatacttgaaatatgctacttaatactaaataaaacataatttcagattttgctacccaacaggcaattagccctaaagctcctatcgtaatagtataagcataccccgttgttaccactaaatctaaagaacgttttccatatcgataaaaatatcgtgcaacagcaccatcttggcttagtccaataaaaatagcaaataatgctaaaaatgtttgataataagagagttctccaaatccttctacacctaattttctagataaatagggcagtaaaagaaaaggaattgattttgaaactaactctccaaatagatagattgcactatctttaataactttcattgtttaccaaactttccgcaagttgcagatccaatgttgtatcaatatcaatagagcggtaacttggcattaaataaaacttcacttcgggaataaagaaatttttttcttttaataaacttgcggtatcgttgatgtaaattgcgccatttgctctataagctttaggtaatgactgacgaggagcttcaaaatcacttaattgattaataggtagaattttgtgattttcgtccaaaatgaaagatttatacgggtggtgttcacattcacatgctgacacgactgatttgcaatttcctgccaagaataattccatggcattacgaatatccaaacctgaacgcaatgggctggtaggttgaaagtgtgcggtaacaccctctgttaatccaagtgttgttacacaatgtaaaatggtatcaattgttctagtatcactttgagccaattctacagggcggcgaaatgctgttgcgctatatttttctgcttcagcaagaattctgtcgccatctgaggttacaataatttcgtcaaaagcctctgattcttgagcggctaaaatggctcgcccaactagagatattcctccaacaagttgtagattcttatctttgattccttttgaaccagctcttgctgggataatggctacttttttcatatttatctcctttacatgcccccatccccctcgctatcgctcggggacttcccccataaatgggggaagaatttttatcttcagactacattactttttaatacttcccccgtttacgggggaaggtgctcgaagggcggatgggggaaatctctttgtatatttgtatacattcccctaatttcaatcacaactcatacaacccactcgtatcaaaactcaacgctggaaattttattgatgtaattacatcaccttccaccacaggttgcacgcctatgtagcgtccattttctagcacataaatttggatatgttgttcttccgggcggactatccaatattcacttacgccttgttcttgatagagttcgtatttgtctttcatctctctttttgaattaccaggggagagaatttcaacgattagatctggcgcgccaatacagcctttttcgtccaatttattcgggtcacaaatgacacacaaatcgggttgcactactgttttgattttgccattgctgtctggaaaacgaacatcaaagggagcaacatataattcacactgatgactatcaaaaacatctaagaatgcttttgttaatttcatcgaaatccgttgatgtaatcgattaggcgctggcgacattgccattattttgcctttgataatttcaacgcgctcttgaaatttccattttaaataatcgccatagctataactgccatttaaatctaattggctaaggcttgtgatttcattcatattaagctccgaattacttagctgtttatgtgagttttatctagcgcttcgctatctcattcccaactcaaaaatcattgattcaacttggtagctaaatttgaaacaagcggtaagttggaagccattttctgtagaaataatttcactggtaatctcacaaggctcagattctgttgatcgagctttgctggttaaaaatgctaaagcgtcttcagcttctgctttagtagtgtaaagttgagtaaaatttacagcacaatcactgttatcaataatagttcccacatcaatagaacagcaggaacttgaattacattcggacatattttacctctcgaaactggcaaactgtattcttataccactgattgtactacctttttccaacaacaacaacaacaacaacaacaacaacaacaacaacaacaacaacaacaacaacaacaatttttagtttaaaaaacatccattttaagatgtcatctttttatttgactggtcggaactctttgtattttaaaggaattttattgcgaccgatgattaagctacgtagaataacaatatattttcatttcagttctttaatttattttttacgtgaaataaattaattttgatacagtcgattctataaaggattacctaatgaataaatttactaaaacagctcttgcttctatctttactttttctgcagctggtgcttctgcggcagcgttccaattagctgaagtgtcaacttctggtttgggtatggcgtatgcaggtaatgcggcagttgcagataacgcttctgttgtggcaacaaacccagcattaatgaccaaattcaaacaagtagaaatttctgcaggtggggtttatgttgatgctgatgttgatgttgaaggttcttttagaacagtaaatggaagagcgattccatcatcagcaacaggaaatgcaaatgcaaaagacattattccaagtgcaattgtccctaatttatatgttgttgccccaatctctgagcgttttgctgtgggtggcggtgttaatgttaattatggcttaaaatcagaatttgagaaaacctatagtgctggcgtattagcaggtaaaacaaaacttagtgcggtaaactataacttcagcagtgcttatgatcttggctacggatttagctttggtgctggcttaaatgcagtacatgcaaaagcaacattagagcgccattttggtgctttgaatcctatggcaccgacagcgacagcaagtcgattaaaaggcgataaatggggctttcgttggaatgtgggcttaacctatgatattaatgaaaacaaccgtcttggtgttgcataccattctccagtggatttacgtttcaaagggaaatatgtgggtactcaaagtgccaatgttgaaattccaggtcgcttaaaccttgagttaccagcatattgggaaatctcaggttatcataaacttactgagaaattggctgtacaatatagctataaaaagacacattggaatagcttccgagaacttcgtgcaatagataacaacggtaaagtgttgttacaaaaagatgaaaagttcaataataactctcgcattgcgttaggcgtgtcttatgatgtgattgaggcattaacattacgtgcaggtattgcttatgatgaaagtgcaagcgtggcacatccatctatctcaatccctgatacagatcgtacatggtacactttaggtgcaacttatcgctttaccccgaatttatctgttgacctcgcttatgcacatttgcgtggtagcaaaaacgaattcacagaaagccaagcaataagacttcaaagtggtgctgtaatgaatgcagaaggtacctttaaagttaaatcaactgctaacctttacggcttaaacgtaaactataaattctaattttcatttgatgtaacctcaaaggcgtgtacactaagtggtacgtgtcagattattgccaaagtagcttgtatggtgggtcttgacccaccatatagccgtaacatattgattttattggtgggttaaaacccaccctacaatattcaatccatctaatatatggtttgtcagcaacctgaggcgtgtacactaagtggcacgccttttgttttaggataatcctatgaaatttcagatcttctatcaattttatcattcgccagtggggagattgcttcttattgcaaaccaaacaggtttacttggcattgaatttgaacaagagcaacaaacacttaaccttcaacaatggaaaagttcagaacaggcaagcggtgaaattcaacaactattttgcaaaacagtgcaagtattaaaccgctatttttcaggggaaaacgtggcgttttgtcagctagattttttaaaccctcagggtactgcttttcagcaagctgtttggaaaatattgcttgagattccttatggtaaaacggtaagctacggagatattgccaagcagttaaataatcctaacgccgttagggctgttggaggagctgttggacgcaatccgatttcgattttaataccttgccaccgagtgttaggcaaaacgcaagcgcttactggttttggtggtgggcttcctactaaacgttatctacttgaattagaaggtatttcttatcaaaataaaggcactgaatttgtaaacccaaaacataaaaaatggacatcaatatgacaaagcacaacttagcaactcaacttgttcacgcagggcgaaaaaaacgttacacccaaggttctgtaaatagtgttattcaacgagcctcttcccttgtatttgattctgttgcagacaaaaaagaagccaccaaaaaccgctataaaggggctttattttacggcagacgtggcacactaactcattttgctctacaagatgcaatgtgtgaactagaaaatggagctggttgctacctttacccttgcggtgcagcggcggtcagtaatgcgattttatcctttgtacaaccaggcgatcacgttctgatgactggagcagcctacgaaccaacgcaagatttttgtcgtatcgtattaaagaaaatgggggtttcaaccactttctatgatccattaatggcagaaggaattgcaacgctaattcagccgaataccaaagtgctttttctcgaatcgccaagttcactaaccatggaagttcctgatattccaacgattgttcgtactgcaagagcaatcaaccctgaaattgtgattatgattgacaatacttggtctgcaggcattctttttccagctcttgaacacggcattgatatttcaatccaagcaggaacaaaataccttgtggggcattctgacacaatgattggtactgccgtttcaaatgctcgttgttgggatcagctacgcgaacactcttatttaatggggcaaatggttgatgctgattctgcctatgtcaccgctcgtggcttacgcaccttaggtattcgcttaaaacaacacgaagaaagtagtcttattgtggctcaatggctggctcaacgctctgaagtcaaagcggtttatcaccctgcgctacctagctgtccaggaaacgcatattttaaacgtgattttaaaggttcaagcggtctattttcctttgaactttgcaaaactttatctgatgaagagcttgcgaattttctcgaccattttgaggttttctcaatggcatattcttgggggggatttgagtcgttaattttggctaatcaacctaaagagattgagcgtattcgccccgccattgaacgtaaattaacagggacgctgattcgtgttcatattggtttggaagatgtggaagatttgattgctgatcttgaatctggattcgagcgaattacatcataaatatcttcagaatatatttgttttcataccttcccccgcttacggaggaaggttcccaaaaggctgatagggatttcaatgacggaagtgacgcattccagttagtactattgccattccgtgttcgtttgcggcatcgatcacttcttgatctcgcattgagccacctgggtggataacgcaagtaatgccgacttttgccgcggcatcaatgccgtcacggaatgggaagaaggcatcagatgccattacacagcctgccacttgtaaaccttcgtcttccgctttgatccctgcgattttcgcagaatacactcggctcatttgtcccgcaccgataccaatcgtttgtttatttttcgcatagacaatcgcattggatttaacatatttcgctactttccagcagaagagtaaatcctctaattcttcttgggttggtttgcgttcagacacaaattgtaaatcttcaacagcaacttgtccttgatcggcatcttggactagtaagccaccattgacacgtttgaagtctaaacgtggttgtgcttcgctaaattcgccacacgctaatacacgaacgtttttctttttcgctaaggcttctttggctgcttcagagatggttggggcgatgatcacttcgacaaactggcgatctgcgattgtttgtgccgtttcgccgtctaattcacggttaaaggcgataatgccaccaaaggcagacgttgggtcggtttggtaagctcggttgtaggcttctaaaatatctttgccaagagcgacaccgcaagggttggcgtgtttaacgatcacacaagctggttcgttaaattctttaacacattcaagggctgcgtcagtatcagcaatgttgttgtaagaaagggctttgccttgcagttgaactgcggttgccacagatgcttctttgagttcgttttcaacatagaatgcggcattttggtggctgttttcaccgtaacgcattgtctgtttacggatgaaatttaagtttaatgtgcgtgggaattgtccgcagacttgggtaatgtcttcttcctcagcaccttgatatggcggtactttttgtccgaagtagttggcaatcattgagtcgtattgagcggtgtgttcaaaggctttgattgcaaggttgaaacgggtttctaagctgagtgagttttggttttgatccatttcagcaagaatagcgttaaagtcgttgttattgacgacaatcgcaacatctttatgatttttcgccgcagaacgcaccattgttggccctccgatgtcgatattttctaccgcatcttcaagggtgcagttcggtttagcaacggtggcggcaaatgggtagagattaaccacgaccatatcaattcgttcaatgccgtgttgtgccataatttcatcgtctgtgcctcggcgacctaagatcccaccgtgtactttcgggtgtagggttttaacacgtccgtccatcatttctgggaagcctgtgtagtccgatacttcggttacaggtaaaccgttgtctgcgagtaattttgctgttcctccagttgagagtagttttacaccacgttgaactaagccttgagcaaattcgacaatgcctgttttgtcagacacacttaataatacttgttggattggacgatgagccattatgggttcctttgtgtattgattgaacgttaatcatcgatctcccctctttagcaaagaggggcagggggagatttggcagaagtgaatgacgaagaaaataagtaattaaagaaaaggaatacttgctttttatattgtgaagtttcactctctcacttcgattatgtcgtctgccaaatctcccctaacccctctttgctaaagagggggatccgatctgtggaatattttcggttaaattataacgcaatcgtttgcgtaaatccattatttacaaaacttaaactttaaattttgcgaaaatctttttttctcagtagaatgaacgaacgttcagtaacttgacttgtttttatgtttaagggtattttgcctcaaaatgaggtggcaatgtgtattctcaatgcaacagataggttgatggcaaaagaaggggttcaaaatctttcgacccacaaaattgcaaaagaagctggggtatctgtgggtacgatctatctttattttaaggataaagagactttgcttaatcagcttgtgttgtatttgtttaatacgtttcattctgcggtagatcgggaatatgatcctgatttgcctctgtttgagcaatataaaaaattgtggaatgcaacttggcagtttatgttggataaccctaatattgttaaaaatatgcatcagtacgagtcgctaccacaatttcaagcgacaatggtgaatgtttgaatgcagattgggtgacgtggaataaatttgtcaagcaggggcaatcgcaaaatattattgcgaacttaccgccttttgttttacttgcaattagtatgaaaacagcgtgggagttgatgtatcagcagttaatgttaaatcaaccttatgctcaagagatgcttgaagaagtgattatccgtacttggaaagcgattacgatttaatcaaaattgatatggagaaaatatgataataaatatgaaaaagacaacgaagggtaagcagtttgctattgttgtgaccttattggttgtgcttatcatgtttggtggtgttgttggtatgcaacagtttatttcgatgaaaaaggctgaagctgcggcgaatatgcctgagcctgtgagcaatgtaacagtgatgaccgttaaaaatagagaatggacacctgttatttctgcggttggttctattcgtccgaatcaaggggctatgttaagttcacaggcggctggcacggtcactaaagttttggtgaagtctggcgataaagtgaaaaaaggtcagctattagttgaaattgatagcagtgcggaacaagccagtttgaaagcgacagaagctcagttatcgacagcgagagcaaactataatcgctatcgtaacttagtagcgtcaagcagtgcttcaaaagcggaatttgataatgccaaagcaacttatgagcaacttgtggcgactattgaggcgacaaaagctcagattgagcgtcgtcaaatttatgcgcctttcgacggtgaagcgggtattgtgaatgtgaatgtagggcaatatgtgacgattggcacaggaattgtgcgtgtggaagatcagtctgcgatgaaaattcgttttaccttacctcagactaacttagaagatatttttgttgggcaaaaagtgaccgcaaccattgatgctctacctgctcgtactttccctgcgaaaattaccgctatcgatcctgcggtggatacatcaactggtttgattaatcttgaagcagtggtcacagaagggcaagataagttgctttcaggtatgtttgctcgcttaaatgttgcattaccaaccttatacgatcaggttgttgtgccacaaattgcggttacttatacaatgtatggcgaaactgtttatgtgcttcaaccattatctgatgaagataaggaaaaagtgactaaaatgactgaaatgaacaaaagtttagacatcaataaaatctatcgtgctaaacagatggaagttacgacggctgaacgcagtggagtctattctcatttgagcaaaggcttaaaagccggtgatgtgattgtcactggtggcttacaacgtttaaaaaataacgccttaattcaaatttctgatgtgcaacctgttggggttattgcaccagcgacaaaaacaaaactgtaatggggtaagctgtgaaatttaccgacatttttatcaaacgccccgtacttgctatctgtattagcctattgattacaatcttaggcttacagtctattagcaagctacaagtgcgtgaatatcctgagatgacgatctcaattgttactgtgagtgttaattatgcgggtgcagatgcaagtttaatgcaagctcttgttacgtcacaaattgaagaagctgttgcacaggcagataacatcgactatatgacttcatcaagttcaccaagtactacgacggtaacggcaaagatgaagttaaataccaatcctcaagaggcgttatcggatatttcttctaaagtaaatgcaattcgtggaagcttgcctagtggcattgatgatcctgcgatcagcgtatcatcgggatcaaatgatgcgtttatgtatattcgttttacctctgatgatctttcatctccacaagttacggactacctaaatcgcgtggtgaaaccgcaattttttacgatcaatggggtgtctagcgttggtatctttggtggttcaacctttggcttacgcatttggttagatccagatagaatggctggctataacctttcaggtgcgaatgtgttatcggcattaagtgcaaataacctttcgacggcggcaggcagtgcaaatggttattacactgtctataaaaacaaggtgttatcgacaactccaacggtagaagagctggcaaatattactgtggcaaccaaagcagatggtatgcaaattaagttaaaagatattgcgaccgttgaactgaataaatcttcagataatgctcgagccacagcaaatggcaaagatgcagtggtgattgctgttgagtctgcagcaacggcaaacaaattaaccgttgccaaaaatatctatccgttatttgcacaaattgagaagaatctgcccgcttccattaaagctgagattttgtatgacagcactattgcgattaatagctctatttctgaggtaattaaaaccattggtgaagcaacaatcattgtgcttattgtgattatcctattcttaggttcactccgtgcgatgattatccctgttatcactatcccgatttcattgattggggtgttattcttattacagatgcttgggttctcgatcaacttgctcaccttgctaggattgattttggcaattggtttggtggtagatgatgcgattgtggtattggaaaatgtagagcgtcacgttaaagagggtaaaacgcctttcgatgcggcaattattgggacgcgtgagattgcattgcctgtcatttcaatgaccattactcttgcggcggtatattcaccgatggcattaatggaaggggttacaggatctctgtttaaagagtttgctttaacccttgctggtgctgtatttatttcggggattgcagcattaaccctttcgccgatgatgtctagccgtgtgttaaaagaacataaagggggtgaagaagggcgtttagtcaaatgcattcacgctatgttagataagatgacaagctgttatcaaaatatgctttcagcagtgatggcagttcgtggctttatgctgttctttgcgattgctatttttgctagcttaccgttcttgtttacttcattgtctagtgaggttgcaccttctgaagaccgtggtgttgtggttgcttttggatctggtcctgcaaatactaacttggactatacgcaggaagtgatgaaaccttttaatgagaaagtggttaaattgcctgaggttcacggcgcaatgtcgattgcaggctttaacggtggcaacagttcattgtcgattatctctttaaaagattggtctgaacgtagcaaatcgcagtttgaagtgaaagacattgttgcaggtatggcaaaacaagtggttggtatggatattaacgccgttgctttccctgaaattcagacaggtgaaagtgggctgccgttctcactggttattacgactgcagatagctatgaaaaacttgcagaagtcgccagtgaaattttagccaaagcacaagcgtcagggcaatttttcttcgctaacttagaccttaaatttaacacggcaacgatgaagatgaagtttgaccgtgaaaaaatggggacttatggcgtaacgatgcaacaggtgagtggcactttaggttcgttcttgtcgggggctatagttactcgtgttgatattgattccagagcttatccgattgtatcgcaagcggtgagaaataaccgattaaatccagaagatttaatgaactactatgtgacaacagcgagcggacaatctatcccattgggttcttttgtcacaatggaattaagtacagaaccagcttccctcagccgaatgaaccagcttaactcggcaacaattggcggtgtggtgtcgggttctattggtgatgccgtaaaatgggctgaagctgagttagctcgttctttgccatcaggctatcaatacgattttaaagccgaatctcgtcaatatatccaagagggtaacgcattaatgtttacctttgtgctggcagttgtgatgatttatatcgtcttagctattcagtttgaatcgtggcgtgatccgttggtgattttagtttctgttccgttagcaattagcggtgcattattggtgatgaatattttgggtattatgaaagtatcaggtgcaaccttgaatatttattctcaagtcggcttaatcaccctcgtaggcttgataacaaaacacggtatcttgatgtgtgaagtggcaaaagaagagcagttgcttcacggaaaatctcgccgtgatgctattttccacgctgcaactatccgcttgcgtccgattatgatgacgactgccgcgatgatcgcaggtcttattcctctgctttatgcttcaggggctggtgcgattgctcgctttagtattggtatagtgattgtcgcaggtttagctatcggtacactctttacactgtttgtattgcctgtgatctatacctatttaggtagtgagcataagccgttgagagagtttgatgaagcgaaatatgctaaggattaaactttaattcctgatgtagcggtaaaattaataagcaactcggtaagggttgcttatttttttgacagtgcagtagccaaaacatagcgacatagtaaaaaggttaaagcctgatgaagctttaaccttttttaataaaagatgtaatttattggtgtaatagacaaatttgttgctaaaaagtggcttaaagccttatagtacaaggctttaagccctctttttgaaatatgaacaaaaaactgcccattttgccaaagtcagaaaataaagaaacatgatatacaaaataatactcaacgttatttttgtaatgaatgttataaaacgtttatcttaaaatctaaattagatccaattaaaatttggactgattacacatccggaaaacaaacctatcaacaacttgccgaaaaatatcattgttcggttagaactattcaaagatatatcaataaagcgcctaaaacggttttaaaaccacctttaaatcgatacctgaacatcattatggatacaacgtttttctgtcgttattttggcgtattagtgctaatggattctaattcaaataatgtgatttcacattattttgtgcgaaccgaaaaagatatttactacaaacttgccctgaataggttaagagaaaaaggctatataattcaatcgattacctgtgatgatagacgtggtttgatgaaagatttatttaatacgccggtacatatgcgtcaatttcatatggtagcaattgtgatgcggaaattaagaaaaaaacatcaatcgcaagcgggtaaagaattaaaaataattgcaaaaacactcacaagaagctcaaaaacgaattttatcggcgattacattcttggtttataaaacatcaagattttttaaaagaaaggagtgataaagcgaatgaaaaaggctattttccttataaacatcgcaatgaaagaagtgtttatgccagtttaatacgttatatggattatatttttacctatgaaaaacattctgaattaaatatagaaaagacgacaaatcgtttagaggggttatttagtgaacttaagcgaaaattaaataatcacaatggattaactaaaaaacgtaagatgttgtttatacaggatttttttaaataaaaagagttactaatatttcaagaaaatagatattagcaactattttgtctactatgccaatttatcgtgactttggatactgtttttagaagaactaatgtaccttcttaaccataaataaaatggtataaccttagccaatatattgttcaatcaaatttcccatctccgaggtagttacgggcatcgtagtatgatcagcaagatctgccgtgcggtaaccctcggctaatactttttgaaccgcattttcaatcgctttcgcagattcttccaaaccaaaactatgacgtaacatcatcgctgcagaaagaatttgtgcgattgggttagcaatatttttacctgcaatatctggcgctgaaccacccgctggttcgtataaaccaaatcctttttcatttaaactcgcagaaggtagcattcccatagagccagtaatcatcgcacactcgtcagaaataatatcgccaaagatattagagcaaagcaacacatcaaagaaatcaggttgcttgattaactgcattgttgcattgtcaatataaatatgatccagcttcacttcaggatattgttttgctacttcatttacggtttcacgccaaaggattgaactcattaacacattggctttatcgacggaagtaacgtgtttggtgcgtttcattgccgtttcaaatgccacttttgcaatacgttcaatttcataacggtgataaacttccgtatcaaaagctttctcattttctccctcgccttcacgacctttaggctgcccaaaatagataccacccgttaattcacggactgttaccatatcaaagccttttgctgcaatgtccgcacgcaatgggcaaaattgttctaagcctttataaagtgtagcagggcgaagattgcagaataatgcaaagtgtttacgaagtggtaacaaagcaccacgctctggttgctcatttggtggaagatgttcccattttggaccgcctacagagccaaacaaaatagcgtcggcttcttcacacccttttaatgtgctttctggtaatgcttttccgtgattatcaatggcaacgccgccaatatcataatagttataacttaatttaaacccgtacttttgttgaacagtatcaagcactttaatcgcttgagccataatctcagggccaatcccgtcaccacttaacacggcaatgttgtagttttgcatataaatacctcaatatttgaaaatttataaaatataagttatattaataaaaataaataaaagaacaacattttttataaaaaaataaatttttattattttttagaatttaaatctaaaaattaaagaaaacattgtttttaatgctagacaagcggtcagattttttgcaaaatgcccaacattgtttttatggtgtaaaccttatgttaattttgttggaggattcaatgaaaaaactctcaggagcggaaatgattgtgcaatccttgcgtgacgaaggcgtgaaatacgtttttggttacccaggtggctcagtccttgatatttatgatgcaattcacaccttagggggaatcaaacacgttcttgtccgtcacgaacaagcggctgtacatatggctgatggctatgcacgttctacaggtaaagtcggttgtgtattagtcacatctggcccaggggcaacaaatgcgatcacagggattgcaaccgcctacacagattccattccactggtcgttttttcaggacaagtgccttcaagccttatcggaaccgatgctttccaagaatgtgatatggttggtatttctcgccctgtggttaaacatagtttcctcgtcaccaatccagaagaaattcctgagatcataaaaaaagcattttatatcgcttcaacaggtcgccctggccctgtcgttattgatgtgccaaaggatatggtaaatccagcaaataaattcagttaccactaccctgattctgtatcattacgttcttacaaccccacggtacaaggacacaaagggcaaattaagaaggcattaaaagcgatcttagtggctaaaaaacctgtactttttgtgggtggtggtgcagtgatttcggagtcaaataaagagttgatcgaatttgctcagaaattaaatctacctgtcacaagttctctaatgggattaggagcatatccaagtacagataagcaattcctaggtatgttaggtatgcacggtacctatgaagctaacaatgcaatgcacgaaagtgatttaattttgggtatcggtgtgcgttttgatgatcgtactaccaataatctcgcaaaatactgcccaaatgctaaagtgatccacattgatattgatcctacctctatttctaaaaccgtccctgcatatattcccattgtcggcgatgcaaaatttgtattagaagaatttttagcattgttaggtgaagaaaatctggcaaaaggtcaatcagatctgaccgcttggtggcaacaaattaatgagtggaaagctcgtcaatgtttacgttttgagcaaagtgatgtgattaaacctcaacaggttattcaaaccatttataaattaacaaatggcgatgcctatattgcttctgatgtaggacaacatcaaatgtttgctgcgttacattatcctttcgataaaccgcgtcgttggattaactctggtggtttaggcacaatgggctttggcttacctgcggctatgggagtgaaatttgcacaccctgaagcaacggttgtttgtgtcacaggtgacggcagtattcaaatgaatattcaagaactttctacagcaaaacaatatgatacccctgtggtgattgtgagtttaaacaaccgcttcttaggtatggtgaaacagtggcaggatattatttatgcaggtcgccattcccaatcttatatgaactcactacctgactttgtcaaactggcagaggcttatggacacgtcggtattcaaattaacacccctgatgaattagaggaaaaattagcacaagcctttgcaattaaagataaacttgtttttgttgatgtgttagtagatgaaacagaacacgtttacccaatgcaaattcgtggtgaatcaatgaaagatatgatgttaagtaaaacggagagaacagatgcgtagaatattatccgtcctattagaaaatgaatcgggagctttatcccgtgtcgttgggctattctctcaacgtggttttaatattgaaagtcttacggttgccccaacggatgatccgagtttatctcgaatgaccattgtggcacaaggtgatgaacaagtcttggagcagatcgaaaaacaactgcataagctaattgatatattcaaagtgacaaatcttagccattgcgaacatattgagcgagaagtacttctactaaaagttcgagctgtaggtagtacacgagatgaaattaagcgaatggttgacattttccgtggacaaatcgtggacattacgccaaaacaatataccattcagctctctggtgctagtgataaactcaatgcttttattgaaacagtgaaagcagaaacaacaattattgaaatcgttcgttctggggtgattagtttggctcgaggggaaaaaaacagtttataaaattgattaaataaatagcatagtagatacaacatcaatcaatgtgagtacacacactttgagttaaaatcatttcctactatgcacttcacctaatataaatcaattaactaaacaatgcccaaatcggcttacagcttgaaggtaatatcaaatccttccctaactcaacccagcctgtcgggtagtggaaatctgagccgacagaggcatagagatcaaactcttttgcccaacgagcaagaagctgacgctggtctggcgtttgggcggctcccgttacctctatgccatctccgccagcctgtttaaactcttcaataaaacggcggatccatttcgctgttaatttatagcgtaatgggtgtgcaaaacagataacgccaccagcttggtgcgtcgctgcgatggcttcttcggtgctgcaccatacgggctttacataagctgttttgccgatccctagatagcgtttgaaggcgtgttcatcattgcgtgcatagccttctgccacaagaaaacgggcgtagtgagcacgagtaacttcaccgcttgcaatggcttttgccccttgatatgcgttcgggacacctgctttggcaagtttttcaccaatcaattctgcacgttcttggcgtaattgtttttggcgagcaagtaaattgacgatagcagggtgggtttcgtcgatatttaaggcagtgaggtgaaggcttttcccttcccataacacagaaatttctacgccactgataaaggtaagcggttggttttgggcaaaagttttcgcttcagcgatacctgcgacggtatcgtgatcggttaaggctagcattgttacattttgttctaccgctcgtttaacgagttccgtgggggtaagcacgccgtcggacgcagtgctatggctatgtaaatcatatttcatttaattatccttaatccttccaaccataacaatataccattttgtagggacacactgcgtgtgtccattcgttccaacaaaaaccgcaattcgtatcaacagacatacgttgacggacacacgcagtgtgtccctacgattattttctttattgttgtttttcacaagatttcacagaaacagaccattctgcccctgatttaattttgtattttcccgcaaaattatccatatttaaggcaaaagaaacattcaataaactattgaggtacatcaatggtctgccttcttcaacatcaccaaaactgctcttatatggcattgagccactataacggactttgacctcatctgccgttgtttctttgatttcaacacagaccttaccatctttttgaatacctgattgctcaagtaattcgtggctgatatttgtccagacatttccatattgaatatctagtacaggaatgttgccctttaatgtaccttcttcaatagcaggtttttggtagctaatttcggtgactttggcaggtaactctgcaccgacttcttcaaaacggatctgcccagacgctaattttgctcctgtataagcatagacatcgcgtccgtggaaagtataagatttttcagaaccttccaagcggtgttttgtttcatcaatttcacgaatgctctcaatccctaaaaattcagccactaacgttaatgtgccattatcaggggttacaaaatagtgtcctgttttagtttttaatacgaccgatttacgatctgtgccaacgcctggatcgacaacgctaacaaaaacggtgccagcaggccaataggttgcggtttggtataaacgataagaggcttcccaaatattatatgcaggaatttcgtgagttaaatcaaacatttttaacttgcgatcaaccccaaaagccaccccttgcattgcagatactgcaccatcttttaaaccgaagtctgtttgtaatacgagggcatttgcagcttttgtttcctcagaagcgactgcttgttttccgtttgttgttgcaaaagaagttgcagaaaaagccacaagagcaagagcaattaatgttttattcatatcgttttccttatcgtcgtgtttataaaaattggagtgatagtaatcgtttgcctagccattgtctatagcgagaacaagtttattttttattaagcaaagccccaatcgcttttaatttatccgctttactcagcccttgatcagcaagttgatttaattccgatactaatagctctgaagctggtgaattgacggacttggtggctttaggctgcattaattgtgctgcgtaagcggtgagatctgtcaataattttatcttttcagaattatcgtgatattgagccgataacagatcaaccgcttgttcaaaggcctctgcttttgtttcaagttgttgatagcaatacttttgccagcgtacttgttctgcgcgtgttaaggtttctgagtaatgtcttgctcgataatggaaaagtagaggttcaattcttggatcgctaaatttcaagccgtgatgtgcaagctcttcaggttttagatttcgcaaaatcgccatattgtttttatctgcaggttcaaaaaagccatcgtataacgtggtttctatattatttgacgctggataattcctttcctcagaaaggatatcaataaccttttctcgcacaaggcttttttgggattttagcagttttaaattttctaaacaggcttgacgatcgatgcctaaacgtgttgcattttcagacagtaacgttttagctggagctaaaattgggcatttattaatatgcacgagttttagtggaacagcataaagcccttgagcttctaattctacttttttggtataaagacgttcacgcaatatttcgcttggctcattcaataggtcgtttatattccccgatagatcacatacaatcactgcgtttcgattagtcggatgccaagccaatggcacaacccaagcggtgttgcctcgatagttgcctaacattccagaaacgtgaacaagcggtgtcatttcaccgacatcaatcatctcttctagggcttttttacctcgattttgcaggaaaaagtcgaataatttaggttgtttttgtttgattaactttgccattgcaatagtagcatacacatcagccattgcatcgtgagcgttgtcgtgagcaataccatttgctttggtcaaattttctaatttaaagctcggcataccttcatcatcatacgcccattctatcccttctggacgtaaagcataacaggcacgcacaacatcaagaagatcccaacgagaattgccgtttttccagctatattcataaggatcgaaaaaattgcggaaaaaggtataacgggtcatttcatcatcatagcgaatgttgttatatcccattacgcaggtgttaggttggctaaattcggcgtgaatacgagcggcaaattcaggttcaggtagcccttgttgattacaaagctgtggtgtaatccctgttaccatcacagcttctggtgaaggcaaataatcttctgtttgttggcagtagaacattacaggttcaccgataatgttgaaatcgctatcggtgcggatccctgcaaattgtgcaggacgatctgtagcaggatcgacaccaaaactttcgtaatcgtaaataaaaaaggtggtttgaaccatttattcgcctcgttatctcattaatttattaattatttcaataagatataatttttttaaattttttagcattttattgaactaaattttattggggtagtcttagaatacgcataatgtgctagttttatttttcatttccttaggtaagacctcccccgatactgttttttggtatcgggtttttttatgccctttttattatttttgtttattatcatctattacacaaacctttttatacaagcaagtatagagtagaaattgctaaatgtggagccaaaaagtcaaaaagattaaacaatacgcattgattgtgtgtatttgtgtgtatataattgctcttgattaagacaaaggaggacgaatgcactcaagcgacttaatcaaggaattgaaagaagctggttgtttctttgttaggcacggaaaaggcgatcaccaaatatggcaatcaccgattacaggaaaacgatttcctgtaccacaccccaaacaagatttacctattggcactttgcgttccatcaaaaaatcggcagggcttttatagctctgccgagcttagcaaaggagaggattatgttatttaccgttggtgtagaaactccacataatgagaatgaagcatttggactttgtgtacctgcactatttactgatgaatatagttgctttagtgcggccgatgcaattgatgaaattatccctaatgtaaaagatgccattcatacaatgttagaaatgatggtagaagatgagtttgatattagcacgcttcaagataagggatttatccactacaaacaacaagaagatttttcccactgtgatagttggttgcttgttgatatagatatttctgcattcttgggaaaaaagcaacgagtaaacatagtcttaccacaatacctgctagacagaattgacaatcgtgtttcacatagtaatttttatcgagatagaagccattttttagcagtcgcttctcaacgagaattaacctctcaacaggtttaatcattttaagaaaagttaggggaaatcaaaacatcatcaagcgtgacatttgtgttttggacgccaagcacggctcccctacttaataatccttaagacctcaacccaacccctctctcaattaagccataaacccaagcgtaaagtgctaggataaataagattaacacagcaaaagtatagtagatcgacacatcgctaatacctaaaaagccatagcgaaaaccgctgatcatataaacaatcgggttaaattgggacacttgttgccaaaattcaggcaataagctaatggaataaaacacaccgccaagataggttaagggtgttagtacaaaggtagggataatgccaatgtcatcaaaggttttcgcaaataccgcattaatcaatccccctagagcaaaggcaatagtcgtcatcaacatcgtaaggataatgatgccccaagagtatatttgataagaaacaaagcacaatgtcaccgctgtcacaaggataccgaccattacgcctcgcattatactgcctgccacatatccccaaataatcgtatgggtagatagcggtgacacaagcaactcttcaatgttgcgaacaaatttgcttaggaaaaatgatgaagctgtgttggtgtaagaagcggtaattgctgacatcattattaacccaggagcaataaattgcatatagcttacaccgctcatctcaccgatacggtgtccgataagtttaccgaagattaaaaaatagagtgtcgttgtaataattggcggtactaatgtttgtcgccaaatgcgtaagacacgttttgtttcttttattgcgagtgttgaaaatccgatcatatatttatctaattttattggctattttaattgcataaacaactcttccaagcggttggacttatttcgcatacttaacacttcaatatgttgtgaactaagctgttggaataagttgtttaacccttgttttcggtttacttctacttcgatagtggtttcatctacccatttaaacggataaccgtcaataacaagcggtcggttttcacttaaatctagcaaaaagatctccgtttcgagttttgccaataacgctttcattgaggtattctcgatgatttgcccttgctgaataattccgatattacgacacagagtttccgcttcttctaaatagtgcgtagtcagaataatagttgtcccttgctgattaagctctcgcaaaaaatcccacaaactacggcgaagttcaatatctacccctgctgttggttcatctaaaatcagcagtttagggttatgcattaatgcacgggcaatcatcactcggcgtttcataccgcctgataattcacgggtaaaatgatcacgtttttcccataagtctaattttttcaaccaaatttccgcttggattaaggcttgactacgcttaatgccataaaatcctgcttggttaattaaaacgtcgatcactttttcaaactgattgaaattaaactcttggggaactaatccaatctgttgttttaattgaattttttgtttatcaagatcgtagccaaacacttttattgtcccacttgttttattcactagtgagctaataattccaatcgtcgtggacttgccagcaccattatgcccaagcaatgcataaaagtctccctgttcaacacagagatctatgcctttaagggcttgaacacctgttggatattgtttgattaggttttttatttcgagtgcgtacatattttctactccgccactgcccgaatagttgcttcgtccatttgagcatcaaaggcttgttgtaaaagttttaactttttgtctgcttgtagtgcttgtttagcctcttgcgtgagctgttcaaaaataactcgacgaatttctaatggggtttggaactcatcactttcgcctattcgcatttcactactaaagccttgttgtgagagggcattgtataaactttgggtcgcttcattgctgtttaaatgtgccattgtggggtttaaaaccaacaaaagatgattgttgttatggctttctaaatagctgtttaaagcgagctgacgagaaactccgcccagttttaaactgtttacaattcggctccatttatctcgttcacaaccaagctcaatcgtttttttaactagctcaggtgttcgctcttgcaaaatggctttcttaatttctgaaggcttcggggcttcctcttgattttctaactcaggattaagccaagtccaacggtagtcttcatcattttgtgaagcgatagttttttgaggtgttttttcgacttgttgccgttgatcttgagcggtcactaggttcattaaaccttgttgaacgctctttttattcaccgtttggggtggttgaatgggggttaaatcagactttttttttcgtcttgttgctcttgtttcgcttttaattgctgacgagcctgcattgcttttaaggctggcgatatactttctgcactcacttcagttggggtagctggttgttgagcgagattttttgcaaactgttgttcagtttcgaccgcttgtgttgtcacagtttgagctgaattttgctgttgagctaaacgttctcttaactggctaatactatttggcgattgcataggtgcaacgggcgttgttggtgtaggtgtagcaactgttgtcgtggttgccatatttttagggtggaaagccaaggctcttaaaatagtcatttccacgcctgaacgttgctcaggggcaaaaggcaactcttttttgcctgtaagcattacttgatagaaaaactgcacatcttctggagagatctgtttcgctaaaaaatgcagtggggtttcttcttgatgaggatgtttcaacaactgcaacatcgcaatttggtgcaaggtttctgccgtatcgcttaacagttgttgccaatcgacacctttttccgccacagactgaattactgccattgctttttcgccgtccgcatttgcaagggcttgcaccaattctaacggttgatgatcgtcaattaagcggagcatttggcttacaatcggcaaggtgatattcacattactgacagcaattgcctgatcggttaagctcaacgcatcacgaatactgccttgtgccgcttttgctagtttagcaagtgctgacaattcatagggaatttgctcttgggttaatataaattcaaggtgttgctgaatttgcgattgttccaacgcacgcaaatggaactgcatacaacgagaaagaatggtaatcggcagtttttgcggatccgtggtcgcaagtaagaatttgacatattcaggcggttcttcaagggtttttaataacgcattgaagctgtgacgagagagcatatgcacttcgtcaatcaaatagaccttaaaacgtccgacggttggtttgtattgcacattgtcgagcaattcacgggtatcttcgacttttgtgcgtgaagcagcgtcgatttcgatcagatcgataaatcgcccttcttcaatggctttacagttcgcacattgaccacagggatcagcactgatccccgtttcacagttcaagcctttcgcaaacaggcgagcaattgacgttttccctacgccacgcgttcctgaaaaaagataagcgtgatgtaaccgcccttctcgcaaaccattttcgagagcggataaaacgtgttgttgcccgaccacttcgctaaaccgctgtggtcgccatttgcgtgctagaacttgataggacatttgacctctttagatgttgcgtagctcttgaaatcccccctccccccccctttttacaaaggggggattgcaaagggagaaatataagattagtgaccttcaaagctcactaaggtataagaattgacaccgattttctctaagcgttctttaccgtcaagatcaggcaaccaaatcacaaaggctgcattctcaactgtaccacctaaacggcgaataagttgtactgttgcttccaccgtaccgcctgttgcaagtaaatcatcaatgacaagcacattatccccagcttgaacagagtctgtatggatctctaaggtatcttcgccgtactcaagggcataagattgcgaaattaccgaacgaggtaattttttcggtttgcgcacaagtacaaaaggcacacctaaagctaatgccactggcgcaccaaagataaatccacgagattcggtccccacaattttggtgatccctttatctctaaactcagccacaattgcaccaacagaggcttggaatgcggcaggcacttctaataaagaagtaatatcacggaagataatgcctgcttttggataatcaggaatagatttaatggaagatttgattaactcaagttgttggttcattttttgaccttttaaacaagaaaaacaacctgtggaatgtagcaaaatttgcaggaattacaaggaaaaaatgatagaagcggtcggttattgcaaaaaattttatattttgtagctgttccacaagaaaagaaatgtaggaacacaactcaccaagtattcctacaatatttaattagaaagcgccctatatttatatattatttacctcttccaacttgaccatcgctccttgaacagtatgttgaatttcaacggagatcaatcctctgatcaactcttcaatagattgaacttttgatacaatcgtattgccttcttcatcaaaatacccctgctctttcaatgtagcgctaaaagtcgagaacaatgctttatcaaagaactctggagcattaataccgtgtagcacagacagacgttgtgcaattgaacggctttcttgctcaagatgatttcgactaatttcaggttgttcaatcaaaatactcaagctgatgtaataacgttgtaataactctcgcacaccagaagagtgtaactgcaacgaacggatacgctggcggttaatcacaaacatttcactttcgttcttaatcagattttgagcaacaaattccgctaaaattgcctcaacatgcccacgaacttcctctgttttaaagtgcataaagagttctgcttgtaagaacggataaatgcgattaacactctggataatcaaatctttggataccgtctcgtgatgtaacacaatacttgcgaccaatgatggaaaaacaaataaatgctgaatgttattgcgataataggtcattaatactgcagattgacgatctaaacggataatttcaccaaagttgtctttttctgagataacacctgaacgaggtaaattaataacatgatctaacatcgcttcagctgtatccgttggcaaagtgacctccgctgtataaggtacatttttgaacagttgcatatagctttcaacctgctcaataagctgttcacgcgttaaagaacgttggcgtgaagcaagcaacacagagccaatgagatttttcgcattgactgcgacggcattattaatatgcaccatcacttgtttagataccgcttcaacggcactatttaaccattttggacgaccattttcatctgtaagcggttctttccattcaggaaaatactgattgagatagtgattaagtggaataggttcgccaaaattcacatagccttgccctagttttttcagtttcttaatcacacgtaacaccaagccagcattctctttctctttctctgcacctcgtaattctttagcgtaagtatctacttctaaaacgtgttcataaccaatataaacaggcacaatactgatcgggcgagttaagccacgttgcaatgcttgtaacgtcatcgacatcattcctgtttttggatcaagcaaacgccctgtgcgtgagcgaccgccctcaataaagtattctacggaataaccacggtagaacagctctgcaaggtattcacggaaaatcgtagaatacagacgattgcccttgaaagtacgacgaataaagaacgccccccaacttctaaaaataggacctgcaggccagaagtttaggttgatcccagcagcaatatgtggcggcactaagccttgatgatacagaatataagagagaagcagatagtccatatggctacggtggcacggcacatatactaactcgtgtccttctaatgccaatttacgcacacgctctgcatattgcacgttgatcccttgatagagtttattccacaaccaacttaacacacgatctgcacttcttaagctgtcgtgacgaacatttgcagcgatttcatccagaattttctcagcttctttgcgagctttttcaagcgaactttttggttttttcgcttcatcttcaatcgcagccaaaattgcaggggattgcagtaacttattgaacatcgcttgacgatcaggcagttgagggcctgttgccgaataacgctgtttagcaaagtgcatttttgccacacgagccaatttttgagccagattttcatcggttccgtgattggtaatcatatagcgtaaagaaaccgcttgtgaaaaacggataaaattatcacgcccaaaccaaagcattgtcactaagcgttggaaagttcccagcagacgtaatactggcaaacctttctctttacccggtgcgcgtccccacagcacagagacaggcacaacttgaatgtctaactgctcatcattacggtttaaatctaaataacgatagaaaaccaactctgtttcacttttcgcccctctggatttaaagaaacgacgcccttcatctaaaaagacaaaacgagacaaagataccccttgaatatcattatttaccagcggatcaggcaagttcagagcttggcagtttttttgcaaaattaacagatccgtttgtgaggtgtagggcaacacatacacaataggttgatctaacttcagccctaattcattcacaggatctgtaggaattgaacgtgttttcactaacagcgaaagcggtaggttcaatgctttacgatacaggtttaataacatagacatttttatatccttttatagttatgatcggattaaaacgatgcgcagtttagcataaatttcttaaggaaatctgagtttattcataaaagttgaggaataagaaagatattatatcgcattcgccccaaagcccattttaagagaataggtgtagggaacaatgccggaaccaactccaagaactgcctaaaaatccatcgtttgtcataaattccaacaaaaaaccgctgattacatcttgattgcattttgtttttttttgtacaattttgtcgtcttaaaaccatagtcaaaaggaaaacaaaatgacacttcgtaaaaccctactctctaccttattactctcttttgtcttcgttgggaatgtgtatgcggaagacgcagaagagaaatttaacagagcatatcaatatatcgaacaagaaaattatcaagtggcttttcctctttttaaggaattagcggagcaaggtgttgctcaggctcaagctattttaggtttaatgtataaagaaggggatggtgttaaacaaaactatcatcaagcattcaaatggtttcaaaaagcagctgaacaaggagataaaaatgctcaactttatttaggctttatgtactatgacggagaaggtgttagacaagattatcatcaagcagctaaatggtttcaaaaagcggctgaacagggagacgtaatggctcaaaataatttaggcgtaatgtacagcgacggacaaggtgttcgtcaagattatcatcaggcggtcaaatggtatcaaaaagcggcggaacaaggggacgcatcggctcaatttaatttaggcttaaagtaccaaaatggacaaggtgttagccaagattatcatcaagcactcaaatggtttcaaaaagcggctgaacagggagatgcacaggctcaatataatttaggtgtaatgtaccacaaagggcaaggtgttcgtcaagattatcatcaagcagtcaaatggtatcaaaaagcggctgaacaagggaatgcaggggctcaatctaatttaggtgtaatgtaccttggcggacttggagttagtcaagattatcaccaagcattcaaatggtttcaaaaagcggctgaacaaggatatgcagaggctcaatttaatttagctttgatgtacaacaaaggtcaaggtgttagcaaagattatcatcaagctgtcaaatggcttcaaaaagcggctgaacaaggagatgcaaaggctcaagctgcactggggtcaatgtataacctgggatcgggagttcgacaaaatagctccaccgccaaaatgtggtttggaaaagcttgtgataatggcgaacaagttgcttgttatttttatcgtaaactcagcgaagatggatactaattaacgtggaatctaataaaagtcatttttgggcggtggtcagtattctggctgctgcgttattagcgtttagtattgaagctgtttctaacaagtataaagcggaaggtgcttgggaagcagcgacttcagtgtttacgcttttgggggtattaatcacagcgggtacagttgtacctgctgtgttaagttatcaaagttttatcagagaatccgataatgcaaaaaaagaattggataacttaaagttagaatttgcaaaacatcaacgtaaaatcgaacaattatccgaaagagaagagcaaattattcaaacggtaacaagccgaaaagatgaacaattaattgaaaatattgcattaaataattcggtggatttagataattatgaagatttagagtgttcattaaaacgaaataaaagaaaacaaattttagccgaacttgctgaactttatttggagaaatttttggcatttaaagattgcctagatgaaggtgaattaactgaacgaggaaacgacaaatatttttcaagttggctaaaagaaataaagatttatcaacaattgggggctgatagttctaagtttcaacaaaaacatattatttcattgagtaatttattattggaattagataaaatgaagcgtaatagtgtgcaggaagatatttttaaccaagctaaacacttatttgcagacattaaagactttccccaaataagtttgtttaataaacagcatagtgtcgttgcagcagcaaaacaacgttttagtaagtattaaaaataaattacagaacattcttaaattatcaattaataacattactcaacattaaaggattataaaatgaaaaaaacaaccaaaattctaaccgcactcactttactcgctgctgtttgtggcggtggttattattacacacagctttatcccgaacataaagatattaaccgattagaaaccttaattcatcaaattgatttttatggtgataagttagctaaagcagaattagatattttcccaatcgatagattaaaacagcttgcggaaaaaaattatccgattgctcaatatatattgggtaggtattatcggaaagaaaaaaataaagaggaagcaaaaaaaatggtttagccgtgcagcaaatcaaaactttgcaccagcatatagatcattagcttatacctatgattctgacagttatgaaagaaaaacatttttagctaaagcagcatcacttggagatatgccggcaaaatatgactataaaaatatccctgtattagaagaattagctaaaatgggttatcttcgtgctcaggtggatttaatcgatttctattttaatgataaagataaccataactgggaaaaggcattttattgggctgataaatattatgaaaatactaaaagatataattttaatatttacagaaatagttaccagagacttgccatattgtattatttaggtattggaacaaccccagatattgctaaagcggaaaaaatcttaacagaatatattgctttactagagaatcatgctcgcgatcaatattccaaagaagtttttaaggatattgaacacttaaaaatggaattagttgttcttaaagacaaagatgagatacttgataaagttgcccaagataaaatccaacagattagagaagaattacaggctaataatggtgctgaacgctttttcaaacaggcaaatgttttttttctagatatggatttaaaatattatgccaaagcctattttggcatttcttgcgatatgggaagtcaagcaggttgtgataaatatgcagaattgaatacaaaataaacaaggacaccaagcgagctgtctttgcaatcatttcaactaatgaaaacgggcacacgcagtgtgtccgtgccgttaattaagctaactccattcttcatttcttacagaaatctaaaattatttcgttgcaaatgaaattttactgtatataatgtcataaatttctgtatataaagacagtgaggaacttatgaaacgtcagcacctaacggctcgtcagcaagaaatctttgaatttgtaaaaaatcatattgaaagtacggggatgccgccaactcgtgtagaaattgcacgcgaaatagggtttaaatcgccaaatgccgcagaagaacatcttaaagctcttgctcgtaaaggctatattgaaatgctttcaggaacttcgcgtgggatccgtattttagtggaagatgaagccgcaaatgatgaagagggtttgcctttaattggtaaagttgcagcaggtacgccgattgaggcgattgaacatattgaaaaacattatcctgtgaatggagcaatgttttcaccaaccgctgattaccttcttaaggtgaatggaaactcaatggagaaaattggcatcttagatggtgatttactcgcagtgcataaaaccaaatctgttcgtaatgggcaagtggttgtcgctcgtgttgatgatgaagtgaccgtcaaacgcttagagaaaaaaggtgacttaatctatttacacccagaaaatgatgaattagagccgattatcatcgatcctcgtcaatcttatattgaaatcgaaggcattgctgtcggcgttattcgtagcaacgcttggatgtaatccttcagatttcgattgaaaaaatgttcagaaaaatccaaaataacgcctttcaaattttggctttacgaagagattatttatgaatttagcagaatttcatcaagcgattgaacaagtgtgggaacatattgaagaacaacttgaagaacaaggttgcgatgtcgattgtgaaacacaaggggctgtttttactattacttttgatgatgattcacaaattgtcattaacaagcaagaagctatgcttgaactttggctggcaagtaaattaggaggttatcactttgcctatcgtgatggcgattgggtcagtgcggaagggcgttcattttggacacatttagaagaggcagtcgctcgtcacggcgaaaagatctcttttagctaatgtcagttataccgcttgccaaagctgaaacggttttacataacgttttcggctaccaatctttccgacaaggtcaatcagaagtgattgaagcgatcttgtcgggcaaagattgcttggtgattatgacgacagggggcggaaaatccctttgttatcaagtgccagccctctgttttgaaggcataactctcgtgatctcacctttaatttcgctaatgaaggatcaggtagatcaactgctcaccaatggtgttgaagcaggctatatcaattccacccaaaccattgaagaacagcaagcggttgaacaaaaagcgatttcgggacaactcaagctactttacctttcacccgaaaaggtaatgacatcaaatttttttcaatttatctcattgtgcaaaattagcctgattgcagtcgatgaagcacattgcgtatctcaatggggacacgattttcgccctgaatacaccttgttaggcggtttgcgaaaaactttcccaaacataccgcttgttgcactgactgcaactgccgatccgacaacccgttttgatattattcatcatcttaagttagaagatccccatacttatttaggaagttttgatcgtcctaacattcgctatacggtgcaagaaaaatttaaacctgtggatcaactgatcaaatttatcagcagtcagcaagggaaaagtgggattgtttattgtaatagccgtaaaaaagttgaagaactcacggaaaaactttcttctcgccgtttttctgtaatgggctatcacgcaggaatgacgatgcaacaacgggaaaccgttcaaaatgcgtttcaacgagataatattcaaattgtcgttgctactgttgcctttggaatggggatcaacaaatccaatgtgcgttttgttgtgcattttgatctgccaagaagcattgaagcctattatcaagaaataggacgagcagggagagatgatcttcctgcggaagcggtgttattttacgatcctgcggattatggttggctacacaaggtattactagaaaaaccagaaagtgaacaacgtcaaattgagcaacataaattgcaagccattggggcttttgccgaatcacaaacttgccgtcgccttgtgttactcaactattttggtgaaacacgccaagttgcttgtcaaaattgtgacatttgccttgatccaccgaaaaagtatgatggcttagttgatgcccaaaaagtgatgtccgttatttaccgcacaggacaacgcttcggcttacatcatattattgcagttcttcggggcttaaatcagcaaaaaatccgtgaatatcaacacgacactctatctgtctatgggattggcaaggataaatcgcaagaatattggattagcgtaactcgccagctcattcatcttggctttattcgccaaaacattgttaatcattctgccctacaactcacagaacaagctcgccccattttacgcggtgaaacagccttggcactggcttccccacgtttaagtttttcggcgacaacttatgtgcagaaacagcaagctagcaagcggtatgataaagatctttttgcccgtttacgctttttacgcaaacagattgccgataaggaaaatatccctccttatgtggttttcaatgacgctaccctacaagaaatggcagaatttatgccaacgacggcagatgaaatgctttccattaatggggtaggtgagagaaaactggagaggtttggagaggcgtttttagggcttattagagagcatttatatcatatagaaagtattgcttgtgattaactttaggggctgtattagattagccctaaagttaaaatcaaactcttgcttcacatattacgatactatagtcgtaaaatatccaattaactcgtcctcactcaaaattttcactcccaattcctgtgcttttgccaattttgaaccagccttttcccctgcaatcaaataatccgttttacttgatacactgccagatactttacaacccaattgctgtaataaggcttttgcttgatcacgggtgagctgtgttaatgtccctgttagtaccactgttttatcttttaatggattgtctgcaatctcttgtggcaccacatcttgccacttcaccccttgagcaatcagatcttccacgacttcaatattatgtggttcttgccagaattggaatagacggtttgccacaacttcccctacatcttgtacctgttttagcgtgtctaaatccgcttggcgaatcgcatcaagcgtaccaaagtgatttgcgagattttgtgcggtagattcgccgacatctcgaatacccaaagcaaataagaagcgggcaagggtggtattttttgccttttcgatactttgtagtgcgttattggcagatttctcccccattcgctctaaacgcatcaaggtggtgtgttcgagtttaaatagatctgctggggtacggatcagctcacgttccatcagttgttcaatcagtttttcacccacgccatcaatatccattgctttgcgtgaaacgaaatgctttaacgcctctttacgttgggctccgcagaataatcccccagtacaacgagcaaccgcttcgccctcgacacgcaccacagctgagttacacacaggacaagcggtcggaaaagcaattttttttgcattgtcaagacgacgttcagccacaacgcccacaatttgcggaattacatcacctgctcggcgaataatcacggtatcaccaattgcgatccctaaacgctcaatctcatcaccgttatgtaaggtggcattgctcaccgttaccccagccacaaagacaggttctaattttgccactggagtaattgcccctgttctgccgacctgaaattcaacatcgttcagaatcgtcatctcttcttgtgcagggaatttgtaagcaattgcccaacgaggtgcttttgagataaagccaagctgttcttgcagcacaatcttattgactttcaacaccgtgccatcaatgtcgtaacccagcgaactacgtttggcttggattttttgataaaacgcagtcaaggcttgagaacctgttgctaaggtaatttcagcattgacaggaatccccagggtttttaaccactgcaagcggtcaaaatgtgtcgtagggagttcatcatcactttcataaaccccaatgttataggcattcaacattaacggacgttgtctagtgattttcggatcgagctgacgaagtgaacctgccgctgcattacgcgggttagcaaaggtcttctcaccttttgccagtgctttttcatttaattgttcaaagccctgctgtggcataaaaacttcaccacgcacttctaaacgatgtggcggattactactttttagttttaacggaatattacggatcgtgcggatattggcggtaatatcttcccctgttgttccgtcgccacgagttgccgcttgggttagcactccgtcaacatacagaatactcaccgctaagccatcaagtttcggctcacaacaaaattcaatttgattactgttgattgcaatacgatcttcaatacgacgcaaaaagcctgtgaggtcatcatctgaaaaggcgttatccagagaaagcattggggtttcgtgggtaatttgagcaaatccatctaacggcttagcaccgactcgttgcgtcggtgaatcggacgtaatcaattcggggtgttgccattccagattttttaactcgttcatcaagcgatcatattctgcatcgggcacaagcggattatctaaaacgtggtagtggtattcatattcacgcaatttttcacgcaaatgttcaagttgggtttcaatagagtgtggcatctgtaaatttctcgataaaaaagaccgcttacaagcggtcatatttaaacaatgtactgcaaattaattggctactcgtagtagataattttggcgagattcctcgttaaaaatttgatgttgttcatctaagacaaaaccgccaacagattgagcaaagctctctacggtacgaatcattaattttaaattagctagatcattacctactgaaggtaagtgcataaagaatactaatcccactgtagaaaactgttccattcttgctaaatcaaagactcctggttgcatcatattcgccacgctgaacaatacaggacttgcaggattatctaaatggcggtggaagatctggtattcaccaaaatgaaaacctaacatttctaaattttgtacaatggcattaccttgaaattgaacgccttctggtgcaacaacatacaaagtgattatattatgctccgtagtttgttctattgtttcaacttgctctacttggacagtctgttcttgtatctgattttgttgatatgcttcagattgagattctggcatagactcttgatataaaggttgagatatttcttgagtttgtaaactaatacgaatatttttgacactattctcaacttcttgctgagattgaataaaatcagcaggtgtttcagtattgaatggttgctgagctacgacaccttgaggatttagcgttgttggaatatctgctgtaatttcattgttaattggagatgaaggcggacgagtggaaaaggtatttgaaaaaatacgagatttttctctgcgtgcagaccaaatactgtatccaattaaaacagcgattaataatcctgctaaaataaagaaaagaatatgagtttccattttgccctctttagctcataaaatcatcaaaattgaaatttaacactttgtgaaaatgtgtgcatagcttaccatatttcttctaaaaatttgaatagaaaggttaattatgtcttcgctattttctaccccagaaacacaaattggtgctggctttcactatttcatctatggttggcgattaatgttacagcgtcagttaatgccatttattatttttcctgtaattatcaatgcagtgttgatgattagcctaatttggctcttttttgccaatgtagggggaatgttagattcgctcttgccttcgtggttagaatggttgagttttatccttattccattggcttttttaatgattttagttgctttctactttgctttcaccactttagcgaattttattgctgccccatttaatgcgttactcgcagaaaaagttgagcaacaactcactggtgaaaatctcacggaaatgagttttaatgaaatgctaaaagatgtacctcgtatgctcaaacgtgagtggcaaaaaatgtggtatagcattccacgtttgattgccttatttttattaggttttatccctgttttagggcagactattatccctattttgacatttattttcggggcttggttaattgcaattcaatattgtgactacccttttgataatcataaaattcaatttcaacgtatgcgaaatgcattagcacaatatcgtacaatgaattttacttttggggctttggtgagtatttttacgatgttgccatttattaacttagtggtaatgcctgttgccgtgtgtggtgctacagcaatgtgggttaatgagtacaaaagagctctgcatgattaacggaaagccgacattaacagaggaactaatcttataaagcagtgcgtatgttttcttctcccaaaagactagttaagggagaggaaactttaagcatagactcggcacttagctattctaattctggctgctttcttccgaacctgaccaagtaaattaaagactactgcgagaagcccaaagtttcctcatagaaagacatctacatttatactgtagatgtcctaattatatgagcttatctcaaagaagacaagaaaaatgtctactataaatagctatttcttacagggaatagctgctcaacaagactttaacttataaattaatcaccgcaaaaatcactaatacactataaagtgcagataaaccatagaaaatccaaccgcctgcaggaacgtgaattttaaagtcgtgtaaacctaagtgaacacggtgcataccacaccacattgggaaaatcagtaatgcaagaattgctaatttaccgatccaagtgtgtgcaaatgcaataatattatctggtgtaatcagtccgaatggcagtaagaaacctaagattaatacaagcacagggaagaagattgcactaatagcaccgccagcaccgaaaagtagccatactgcaggttcatttgaacgtggaggattaagtttatccatttttatgctctccctataccaagattaaagctaaaaggcttacgaaagcagtaataccccaaaatacgcgagaaacgagtttaacgtcaatacgttcatttttcacgataacgttcatcatttgaggtgccataccaaagaaggtaaagctatttaataatactgcaccaagggtaataatatttaaaactaccactaatggattttgtaagaatggaatgaaattctctacaaatccgttctcttttcctaagcatgctaagccgtagaaaagcactaaacagaaccaaatggtaggaacagaggtactttcacgcaaaacgtagaatttgtaaaaatctaacgctttccaccaagttggtttcacttcacgcacatattttttgcgtttacttgctgttgttgtcattttactctctccttacttttgcggttttaacattgcaaagacataatctttagcactttcgatcttaccttggtttaccgcagaggctggaccaacatgcttcggacaaacttcagagcagtagccgacgaatgtacagctccatacaccgtttttgccgttgataattttcatacgttccgctttaccattatcacggttatctaggttgtaacggtgagctaaggttaatgctgctgggccaacaaattcagggtttaagccaaattgtgggcaagcggcatagcataaaccgcagttaatacacattgagaaggtacggtatttctcaagttgtgctggggtttgtttggtacggcttttcgcaagctctgctgatgggtgtggtttgccatcaagttcaggcgctttgttgtcaataatgtatggcttgatgctttctaaactttcgatgaagtggcttaaatcaacaactaagtcacgttcaatcgggaagtttgcaagcggttcaattcgcatataacccctgtaatcgcgtaagaatgttttacatgcaagctttggtttgccgtttaccatcataccgcaagagccacagatcgccatacggcaagaccaacggtacgaaagctctggctctaattcatctttgatgtagccaagtgcatcaagtaacgaagtttggctatcgtaaggtacttcatattttgataagtacggttcgttatcttgttcagggttataacgaagtacttctaccgtcattttactttggttagtcatcttctgttactcctttttcgctgctttttcttgagcttctgcttctgcaccataaacacgtttagccggttgtgatgtggtaattttcacgtcgctgtatttgattgttggtgcgccgtctgcattgtagaatgcaagggtgtgttttaagtagttcacatcatcacgttcaacgtagtctaaacgttggtgtgcaccacgagactctttacgttctaccgcagaagatgagatagattgtgctacgtcaaggatataaccaagttcaattttgtagagcaagtctgtattaaatacacttgagctgtctttcactttgatacgtttgtaacgctcttttaactctgcaattttcgctacggttttttccatactttcttgagtacggtagataccacagccttcttccattgagtcgcccatttcgttacggatttgtgaccaagactcttcaccctcttgacgggctaaggcataaacacgttctaagacatcttttgcttgagcgtcaattacggcttgattacgagcggtcgcttcaacagcacgttttgcagccatttcacctgcaactttaccgaataccacaagttctgctaatgagttagaacctaagcggtttgcaccgtgtaaaccagaagatgcacattcgcccactgcaaataagcctttgatacaggtttctgcgtgctgatcaacttcaataccacccattgtatagtgaacaactggacgaactggaattggtgctttcgctggatctacgccttcgtaggcttgtgctaattcacagataaatggcagacgttcgtgtaaatatttttcacctaagtgacgtaggtcaaggtgaaccacatcaacacctttggcagtttttaaggtgttacctttacgccactcttgccagaatgcttgggaaactttatcacgagggcctaattccatatatttattttctggtttgccaactggagtttctgggcctagaccataatcttgtaagtaacggtagccatctttattgactaagataccgccttcaccacgacaaccttcggtcattaagatacctgtgtttggtaagcctgttgggtgatattgtacaaattccatatcacgaagtggcacgccgtggcgatacgccattgataaaccgtcacccgttacgataccgccgttggtgttgaaacgataagcacggcaaccgccacctgttgcgataactaccgcatttgcattgatttgaacgaaagttccttccatcatattcattgcaacacagccacgcacttgaccatcatcaacgagaatatccacgacaaaatgctcatcaaaacggataatttgcggatatttgattgaggtttggaatagggtatgcaataagtggaaacctgttttatcggctgcgaaccaagtacgttcaattttcataccaccgaaacgacgaacgttcacatcaccatcagctttacggctccacggacagccccaacgctctaattgcgtcatttcaactggcgagtgttctacgaaatattcaacaacatcttgttcacaaagccagtcgccacctgccacagtatcgtggaagtgtttatcgtaagagtcttcctctttagcgactgccgccgccccaccttctgcagcaaccgtatggctacgcataggataaacttttgaaattaatgcaattttcaaattcgggttagcttctgctgctgcgattgcggctcttaaaccaccgccacctgcacccacaattgcaacatctacattgacagtttgcacgatttcctccttgggaaagtaaagtatataaacctaatatggaagcattttgccattaatttggatattttataatgaatttttacaattttgtaacacaaaaaaaatagttttgtgatctatctcaaaaaataattttcagaatgctatgtagtgataattaatctcattaagtaggtgatttttaaggatatttgagcatttaatacggaaatatctttcactttattctcagattttcgtttgatttttagcatttcatctacataatgatgttgtataattgatagcgttctaaaatggaagaggatataccaatgcaatataagtagacaaaagagttggttttaattatttttcctaattattaccaactctttttatttaaaaaatcctttataaacataatcttatgctttttcgttaatccattatgaaccgataatttctgcttcagttctttaaataacccttccaaccgatttgttgttttttctatatttaaatgagtatattcttcaaaagtgagcttaaagccttgtactataaggctttagcccactttttaccaacacttttgtctactatgcaaaatatcctatctaaatcaccgctttcattagatttccgcctattatttctaactttttggacaattgacaataaaagttgaaaaattcttgttattttatctttagttttgtgtcaatcattgttttttttttttttttacaatagcgtgcggggacatttgtgcatcctgaaaatgtaaataaaggtttacgatgttttattaggaaaagtagtagaaaagtttattatgaataaaatatttagagttatttggagtcatgctcaacaggcttgggtggttgtgtctgagttagtaaagtctcatactaaaacatccgcttgcacggataaaagagctcaagtatgcacctcagattattttttagataaacagcaagataaatttaaattaagtcttttaagtctagtattaataggtatattttttagttcagtaggttcagcttcatattttgtagatggtggagatgggagtagtaggggatataacaacgattctattgctattggttacagtagtcttgctgggtatggtggtgttgctattggtggtttagcaaaagctgaaggtaggcataatattgcgataggttatgacgctcaagcagtctatgaagaaaattccacagccgttggggcaagatcacgagtaggcaatcattctgcggcttatggttatcaagcaagtgcactaggagtaggctctgttgcagtcggtgaaaatgctattgcaaatatgaatattaatagaggcactgcattgggtaacaattcatctgttagcgttggcggtggtgttgcattgggttattactctaaagcagacacggcagggggtattgaaggagcaaaacaaactttttctgtgacagaaggagaaaacactgttgagaatggatttaaatctacacgacaaaatttaggtaataatgttggtgcggtttctgttggtgaccatactggtcgtaagggaggtagtagcataatcaaacgtcaaatcgtcaatgtggccgcaggtacacaattaactgatgcagtaaacgtggcacaacttaaatctttgacgatgaaaattgcaggcgatacaggcaattctaataatgagaaagtgggtatttgggatggtacgcttaaagtgctaggcacaaatggcgaaatcaagaccaaagcgtctggctcaaccattacagtatccctagatgatgcaatcaaaactcaactccataatgctcgagcaggaagtttgatattcaaaggcgaaaaaacaggtacaggtacaacaaatgatacttcgggtcaaaaatggaaggctaacgaagataagaccgttaccattacaagtaacgcaacataccaaaacggtggtgttcgatacaaaggtgataacattgaaatttatcgtaaaaatcttaatgatggaaacacagaattccatgtgttgatgaaagatgcaccaacattcagcagcgttcaatatagcaataatggacctaagattaccagcactgacggtaatctaaaagtaacaggtgcagacggcacttccccagttaagatcaccaatttacaagcaggtacacaaaataacgatgcggtgaactacatgcaattttcaaatgctggttggaaacttgcaattgctccaggaacggggggtcaagcaactccacctggggcacatcttatcagaatgaacgataccgtaacctttaccgctggaaataatattaaattagaacaaaataacggaaatattacgatttctacgattggtaagttaattaaagagacgcaaaccttagataatggcgatctaaaaattacctatacagataatacggatagcatcatcaaaaaaggtgaaaaaggagatacaggtcctagaggtgaaacaggccctgcgggtccagtgggtccagcaggtgctcaaggtccagcaggaccacgaggccctgtgggtccaatggggcctgctggtccaaaaggaaatgatggagctccaggtgctaggggagagaaaggtgaaactggcccagcgggtccagcaggtcctgcgggtccagtaggtcctagaggcgaaacaggtcctaggggtgagaaaggtgatacgggtcaaacggggccagcaggggctgctggtccagcaggaccacaaggtgcaacaggaccacaaggcccagcgggagagccaggcaagcaggggcctaggggggataaaggcgaaactggccctgcgggtccagtgggtccagcaggtgctcaaggtccagcaggtccagcaggtgcaactggccctgcaggtccagcagggcctagaggcgaacaagggcttccaggggtagcaggtcctaggggtgagcgaggcgaagctggtcctgctggtccagcaggaccacgaggaccgcagggtgagcgaggagaaactggctctgcaggtgcaactggacctacgggtccaatgggaccacgaggaccgcaaggaataccgggtactccgggacagaagggggataaaggcgaaccaggacaagcgggtccagcaggaccacgaggccctgtgggtcctaaaggtgatgcaggtcctagaggcgaagctggtccagtgggtccagtaggaccacaaggtgcaataggccctgcgggtccagcaggggctaagggtgagcaaggagaaactggtcctgcgggtccaacgggatcacaaggccctgcgggtccagtggggcctaggggtgaaccgggtcctgaaggtaagcaaggtattcaaggacctgcgggtccaacgggaccacaaggatcgcaaggaatagcgggtactcagggacctaagggggataaaggcgatccaggacaagcggggccagtgggtccagcgggaccacgaggccctgcgggtccagcaggggctaagggtgagcaaggagaaactggtcctgcgggtcctaggggtgaacagggtcctgaaggcaagcaaggtattcaaggacctgcgggtccaacgggaccacaaggatcgcaaggaatagcaggtactcagggacctaagggggataaaggcgatccaggacaagcgggtcctaaaggagaaaaaggagatacaggtcctagaggcgaacaagggcttccaggggtagcaggtcctaagggcgatagaggcgaagctggtccagtgggtccagcaggaccacaaggaccgcagggaacagcgggtgcaaatggtcagaatatttacaatatgagcgtgtctggagatttaagcgacattacttcaattagtaatggcgatactaaggtatctttaggtaaagatgagaaaggaaatccagttgtaaatatgaatggatcaagaattaccaatataagcgatggtagagaagagggagatgcagtgaatgtgcgtcaactaaacaaagtggtttcttctgtgaatacaggatttaatcaattatcaagagatattggtcgtgttgatgttaatgcaagagcggggattgcttctgctggggcgatggctaatttgccacaaatttatttaccaggtaaaagtgctatttctgtttctagtgcacaatatcgcgggcaatctgcctatgctataggttattccagaacttctgataatggcaaatggcttattcgagcgtctgttagcagtaatacccagcgggatactatgattggaggaggggcaagttttgtgtggtaatctagcacctataaattagaatttcatgctcaatgccattgttattttaacaatggcattgtttggcgtagtagacaaaagtgttggttttaattattttccctaattattaccaactctttttatttaaaaaatcctttataaacataatcttatgctttttcgttaatccattatgaaccgataatttctgtttcagttctttaaataacccttccaacctatttgttgttttttctatatttaagtgagcatattcttcaaaagtgagcttaaagccttgtactataaggctttagcccactttttaccaacacttttgtctactatgcctaggacaatcccaataaaaataaggcattatcttacaaaatattaaggctgtgaatcacagccttaataaattatgcttcttcaacagataaattttctataccgtcgtcttcaatttcacagattcgttcaaggctgacaacatgttcgtcttctgcggtacgaataatacgaacaccttgggtattacgtcctacaaggctgacttcgtttacacgggtacgtactaatgtaccggcatcggtaatcaacataatttggtcattttcttcaacctgaactgctgcaaccactttaccgttacgttcattcactttaattgaaaccaccccttttgttgcacgagatttgaccggatactcacctaaggcagtacgtttaccataaccgttttgggtaacggttaagatttcaccttgagtatgtggaattacaagggaaaccactttatcggtggttaagttaacacttgaggcttcttcggcttcttcgttttcaacagtttcaatatcgacttcttcagcatcatcgactgaaatttcggttgttgctaatttaatacctcgaacccctgttgcaacacgccccattccccgcactgcagtttctgcaaagcgtaccactcgaccttgcgccgagaacaacatgatttcactctcgccattggtaatgtctaccccgattaattcatcaccctcgcgaagttttaatgcaattagaccgcttgatctaacattactaaatgcatcgagcgaaacttttttcaccgtaccactcgccgttgccataaaaataaatttatcagcgctaaattcaccatttggaacgggaagaattgcagtgatacgctcattctcctcttttacaagtggaagaatatttacgattggcgtacctcttgcaccacggcttgcctgtggtaattgatagacttttaattgatataaacgaccacagcttgagaaacaaagaatggtatcatgagtattagcgaccaataatttctcaatgaaatcatcctctttcattttcgttgctgatttacctttaccaccacgacgttgcgcttcgtaatccgataacggctgatatttcacataaccagcgtgcgataaggtcacaactacatcttcttgagcaattaaatcttctaaattaatatcgcctgaagccgcagtaatttcagtgcgacgctcatcgccaaattcggctttgattttttcaagctcttcacggatgacttccattaaacgctctgagctatttaaaatgtgtaataactcgctgatttctaccaataattctttgtattcgtctacgattttttcatgttctaagcctgttaagcggtgcaagcgaagctctagaattgcacgagcttggtcttccgataaataatattgcccgtcacgtatgccgaattcagaggctaaatcttctggacgagaagcatctacacccgctgcttcaagcattggtgcaacattacctaacgaccacggacgatccaataaaccttcacgtgcttcatcggcagttttggaatttcgaatcagctcaatcacaggatctatattagctaatgcaatcgctagaccttctaaaatatgtgcacgttcacgtgctttacgcaattcaaagaccgtacggcgtgttacaacttcacgacggtgcatcacgaaagcttcaataatctgtttgagattgaaaatttttggctgaccatgatcgagtgccaccatattgataccgaaagtcacttgcatttgtgttagagcgtacaaattattgagtaccacttcaccaacagcattatttttgatttcaataacaatcgaaatcccttttttatcagaatagtcttcaatacttgaaataccttcaatacgcttatcacgcaccaattcggcaattttttcgattaaattctttttattaacttgatacggcaattccgtgacgacaatctgctcacggccttttgaagttgtttcaacactggctttggctcgtacatacactttgccacgacctgtacgataagcatcttcaatccctttacgaccattaataatcgccgccgttgggaaatcaggaccgggaatatgttgcatcaactcttcaatcgtaatttgttcgttttcaatataagctaagcaaccgtttaacacttcatttaggttatgaggaggaatattggttgccatacccacggcgattcccgaagaaccattaacaagcaatgccggaattttagtcggtaatacatcagggatcatctctttaccatcatagtttggcgagaaatccactgtttctttatccaaatccgttaacaattcttgcgtaatcttctgcatacgcacttcggtataacgcattgccgcaggcgcatccccgtcaatcgaaccaaagttcccttgaccatctaccaacatataacgcagagagaacggctgagccatacgcacaatcgtataatacaccgcagaatcaccgtgagggtgatatttaccgatcacatcaccgactacacgtgccgatttcacataaggtttagatgatacgttaccgctttgatccatagaaaaaagtacgcgtcgatgaacgggcttcaaaccatctcgcacatctggtaacgctcgcccaacaatcacagacattgcataatcaagataggaattttttagttcctcttcaatactgataggaataatatctttagccaattcactcattaaaatttcctaattgcgttgtaaacatacctaattatttctataagctattcaattattaagtgaaaaccttctatagaaagaaggttaattataacattttaaataatcaacttcaatacaaaagttaattatttttaagataaaaaacatataaaatatattacgaacttacttttaatagtgataaatttagaattatttttaataggaggatcaataaatataagatataatatttaatatcaattttttatcaaagtattttcaatcataagaatataaaaccatttaaattaaagcatattccattacctaagtatcattttacagaaggaatcatgtcatttccagaatacaaaactctatgcgattatttaaaggaatataatttacgttattactttattgtaaggttcttaggaagcactggagctagaataagtgaactagtaaaattcacaatacaagatttagaaaaaggatatgctgaatgccattctaaaggaaaatttagaagaattaatattcctcaaagcctgattaatgaatctcgtgaatttttcaaaatcataaaaaagaattattcctgaatagatatggagcacctatttcagctagaggtattgctcataatttgaaaatatacgcagaaaagtgtggcatcagaaaagatgttgtccaccctcataattttaggcatttctttgctatacaatttttaaagaaaaataataatattgctttattagccgatctgttagggcattcaaatgtaaatatgactgctttatctctaagactatctcattcagaacaacgtgaggctataaataattccgtgaattggtaatttattatatactacttcatataggcttatttctatataaaaaatggcaatatagatttatatattgccatttccaatattactattttaattagtctttgtagttgtaaatgtgagcaactaagtctaatactttgtttgagtaaccagtttcgttgtcataccaagaaacaagtttcacgaatgtatctgttaatgcgatacctgcatctgcatcaaatacagaagtttcaactgcaccgttgaagtctgttgatactactgcatcttcagtataacctaaaacgccttttaattcgccgttgaatgttttaccttctgctgcatctttgatcgcttttttgatctcttcgtagcttgctggtttttctaagtttacagttaaatcaacaacagatacgtttgctgttggaacacggaacgccatacctgttaatttaccgtttaatgctggtaatactttacctactgctttcgctgcacctgttgaagatggaatgatgttttgtgccgcaccacgaccaccgcgccagtcttttgctgatggaccatcaacagttttttgtgttgctgttgttgcatgaacagttgtcattaaaccttctttgataccaaatgtttcgtggataacacgagcaagtggtgctaagcagtttgttgtacaagaagcgttagaaacgatgtcttgaccagcataagcgttgaagtttacaccgtttacgaacataggtgtgctatctttagatggaccagttaaaacgacttttttcgcaccagcttcgatgtgtttacgagcagttgtatcgtctaagaataaacctgttgcttcaactgcgatatccacaccaatttcattccattttaagttagctgggtcacgctcagaagtaacacggatttctttaccgtttacaactaatttgccgtcttttacttcgacagtgccatcgaaacgaccgtgagttgaatcgtatttgagcatatatgccatatactcaacatcaattaagtcgttgataccaactacttcgatgtcatcacgtttttgtgctgcacggaatacgatacgaccgatacggccaaagccgttaataccaattttaattgccatagattttctacctatattaaagttaaacaaaatttgttctttcctagacattggaaaagcgagaggattataacacaatctttcccttttctgacaactaaagaacagagcaaaatatagcagataaattttatgtgatctatgtcaaattttttaaaaccctctcttgcttttaactaaaaaaagttagaataattggtaacaaaccaataagagaaaaggatttaaaatgattaaagatattagtgaattaaccgaagaacagattgaaatttgtttaaatgcaggtacagaaaaacctttcagtggtaagttcctaaaagaaaatagggtggggacatatcgctgtgttcgttgccataatgcgttatttcgttctgatgccaaatttgatgctggttgtggctggccaagtttttatgaaacgatctcggagtcttcattacgttatgtagatgattatagtttaggcagacatcgtgttgagattcgctgtggcaattgtgatgcccatatgggacacgtttttaaagatgggcctcaacctacaggattacgcttctgcttaaattctattgcattaaactttaagtgggatcaaaccggtgaagaaatagatgggtaaaataaagaataaaagtttctcggtataataaaaatgcccgcttttgcgggcattttttaagtttcttggattcaaaagtgattacatagaaacttcttttgaaccttgaacttggatttcaacacggcgatctggtgctaagcaagtgattaatgctttacgacctttaactgcgtcacatgtgttaccagttactgggttagcttcaccgtaacctaccgctgttacgttagctgggttaacacctttagaaacgatgtagtttgctactgtttctgcacgtttttgtgaaagagttaagttggcagcatctttaccaatacggtctgtgtaaccgtttacttgtacagcagggtttgctaaacctaaatttacgatctcagtgtgtactgcgtctaatgtttgtgctgcagctggttttaagtttgctttaccgaagtcaaataatacgtctgagctgaacgcgaagtttttagttacaacttctggtgctgctgcaactggtgctgcaccttgaccaaagcgatatgaaatacctgcggtcacagaatgagaatctgggctatagttgtaagttgctctacgattctctttcgcttcagctttagtgaagttacctacattgctcaaccattgatattcaacacggaaagctaattcaggaagaatcgcatactcaacacctgcacctaatactaaagaggtttttaagttatgagctttttgagtttgcactccagctgtttggctataacgtttgtaatcgttacgaactaatgcagcaccaactttaccgtaaacgtctaaaccgtttaatacttcatagcttggttttaagcttaagtgtgtaccgtgtgcagagtgtttgaatgcacggaattcttgtttgttaccacgaacacgaccgaaataatcgtaacctaattcaactgctaagttgtcgatgatttggtaaccaccaaacacaccgtaagttacagagttacggttaataacgtatccattagcgctagttgcataacgagcatcgttcttatatttagagtttaattggttaatatcattgtggaatgttgcccaaccagctttagcacctacatagaaagtgttagcttgtggagcagcttgagctacagaagcaactgctaaacctgatactgctaatgcaattaaagattttttcattttgatgatcctctattatcgtcatctaattaaacaaaattcttagcgtaatcattacgctaaggctttaactacgctttctattcttcaatacgaaaagaaagtcgaaatttcgcctacattttactaaaaaaaatccgaaatacaagcgaactttttcaaagaagccgtgtcgaggctgaaatttcttacattcctgtcttttctttcttaaagaacgaggcaagaatgcaactattatcccattaatataaaagaaatcaatttataagcactcaaggaaatgtaagtaaatgtaataaattgcaactttttaaatgctttgccaatttttttgtagtaattttcattaaatgaaaatcttgctaagatctcgttaaaattttaacagattaaaaaaactatgatcccacgccttgcaaacatacctcaacttaatccgcttgttcagaaatatttagctgaactcaaacagcaacatttcagtggtgatattgcgtcaaactatgctgatcgcctttctcttgccaccgacaacagcgtctatcagcaactgccccgagcgattttgtttccgaaatccgttgctgatgtggtgattttaaccaaactggcacaaaaaaccgcattccaagccttaacctttaccccgcgtggtggcggtactggcacgaacgggcaatcgctgaacaacaatatcattgttgatctctctcgtcatttagctcaaattttggaactgaatgtacaagagcgttgggtgcgagtgcaagctggcgtggtgaaagatcagcttaatcaatttctcaaaccgcacgggctattcttttcccctgagctttcaaccagcaaccgagcaaccttaggcggaatgatcaacacagacgcatcggggcaaggttcgttgcaatacggcaagacttccgatcatattttggcgattaaagcggtgttgatgaacggcgatattttggaaacacaagcggtcaaaaccgatgatttttttgcaaatgtcgatcaacttaatctcacggcgaatggcaaaaaattgcatagcgagatcttccaacgttgccaagcgttacgcccgaccgtgctgaaagaactaccgcaactgaaccgctttttgacgggttatgatctgaaaaatgtatttaacgacgttctctccgaatttaatttaacccgtattctaactggctccgaaggttctcttgcctttatttgcgaagctaagctcaatcttcttccgcttcctgaataccgcacgctgattaacattaaatataattcctttgatgcggcgttacgttccgccccttttatgttgcaagcccaagccctatcggttgaaacggtggactccaaagtgctgaaccttgccaaacaagatattgtgtggcattcggtgtcggatctgctcactgaagatgaacacaatccgattttggggattaacattgttgaatatgcttcaaatgataaggctcagaatgaagcgcggattgccaagctgtgccaagctctagatgaaaaaatccaagacggcacaagcggtatcatcggctaccaactttgcaacgatttggcttcgattgaaaaaatttatgcaatgcggaaaaaagcggtcggtttgctaggcaacgcaaaaggttgggcaaaaccgatcgctttcgtggaagatacctgcgtaccgcctgaacatttggcagattatattgtggaatttcgccaactgctcgacgatcacggcttagattacggtatgttcggacacgtcgatgcaggggtgttgcacgttcgtcctgcccttgatttatgcgacaaatcacaagttgccaaattcaaggcaatctccgaccaagtggttgaattgactgcaaaatacggcggtttgatttggggcgaacacggcaaaggtatgcgttctgcctatggtgagcggttctttggtgaaaccttatggaaagagttgcgttatatcaaacagcttttcgatccgcaaaaccgcttgaacccaggtaaaatctgtacgccgttagatagccaagccagcctttattcgattgattcgcaaatgcgtgccgatctagacagacaaattcctattcaagtgcgagaagcctttaaaggggcaatgaattgcaacggcaacggtttgtgcttcaattttgatgtacacagtacaatgtgtccgtcaatgaaagtgtcgggcaaccgcctattttcaccgaaaggaagagcaactttagtgcgtgaatggctacgtttactggcggaacaaaatgtttcccctgatgagttgatctttgaaaaacagcaaacatcggcgaaattagtcgattttgcgaagaaaatccgcaatcagtggcgaaaatcacaagagtatgatttctcccacgaagtgaaatcagcaatggatacttgccttgcttgtaaagcctgtgccagccaatgcccgataaaaattgatgtgccgacgttccgctcacaatttaacgaactctatcaccgccgttatctgcgtccgctgaaagattatgtggtggcgaacctcgaatttatcgcaccgataatggcaaaacagccgaagttgtttaacttcttcagtgccaacaaactggctgaaaccgttgcaagcaaaaccatcggaatggtcgatctgccggcgttatccgtgccgaccttacagcaacagttaattgaaatcggctatcaaggcaaaaccttagaagagctggaacagctggcgacaagcggtcaactagacacagaaatttgcaaatatgtccttgtggtgcaagatcccttcacctcttattatgatgccaaagtggtggcagattttgttcagctcgcccaaaaacttggcttcaaagcgattgtgttgccgttcaacccaacaggcaaagcacaatatatcaaaggctttttgcacaagtttgccaacaccgctcgcacacaagccgaattgttaaaccgtgttgccaaattaggcattgcaatggttggcgttgatcctgccttaaccttgatttaccgtgaagaataccgccaaattttaaaagacgactgtggcgaatttaaggtgttgctggctcacgaatggctgttggctcaactgaaaaacggcactctcgaccattgcaaaaaatcagccgaaaccgatcgcttaccgtggcacttatttgcacactgtaccgaaagcacctcgctgccaaacagcttgaaagagtggcaacagattttcgcccatttcggcgaaaccttaacggcggaaaatatcggctgttgcggaatggcaggcacattcgggcacgaaaccaaacaccttgcaatgtcaaaagagatttacgcacaatcgtggcaagtgaagttacaaggcaaaaccttatcccgttgccttgccactggctactcttgccgtagccaagtgaaacgaatggaacatcagctactcaaacaccctgtgcaagcgttgttggaagtgatttgacctagataaaaaataggcataaaataaaaacaggaacggcggtcaccgttcctgctcggtttcactgcttagcccgcactacccttaagtaacaggcatagcagaataacaattaaccacaaaagaatgcgtttcattgtttttatctccacggataacattaaacgtaaagatctactaaaacagcccgctaggtgcttactggcggactgatttttcgcagatccgcctctgttttattatgtttaaacaataaaacattgggaaaaattatacataaagcctgtttatttgaacaggcttttgttttatctatatacggaaaataaaaatgatttggaaaaaaaacacaacgattgagcaacttaatcaactctgccaacactctgccatttcgcatttaggcattgaatttaccgctcaacaaaacgatagtctagaagcgaccgtacctgtcgatcatcgcacaacacagccattcggcttattacacggcggtatttctgcgactttagcggaaaccttaggctctgcagctgcattactttgttgtgaagaaaatcaaatccctgtcggcacagaattgaatatcagccatttaaaagcgataaaaagcggaaaagccacgggcagagcaacaccgttacatttaggtaaagagagccaagtgtggcaaatagaaattcgagatgatgcgcaacagttatgtgccgtggcaagattaagtactaagctactctcccaaagataaaacaaccccccaaacctttcgatttggggcttttcatttctcataatggtgggggaatccccacctataaatgattactcttcatcaccatcaaacccagtatttggcatagtagacaaaatagttgctgattcctcaaaaactatgccaagtggacaaaacagttgctaatatctattttctctaaatgttagcaactctttttatttaaaaaatcctgtataaacataatcttacgctttttccttaatccattatgattatttaattttcgtttaagttcactaaataatccctctaagcgatttgtcgtcttttctatatttaattcagtatgtttttcatagataaaaataaaatccatataacgctttaaactggcacaagcacttcttacattgcgatgtttataaggaaaatagcctttttcattcgctttatcactcctttcttttaaaaatgcttggtgttttatgaaccaagagtgtaatcgccgataaaattcattttttgagctttttgtgagtgtttttgcaattatttttaattctttacccgcttgtgattgatgttttttttcttaatttccgcatcacaattgccaccatatgaaattgacgcatctgtactggcgtattaaataaatctttcatcaaaccacgtctaccatcacaggtaatcgattgaattatatagcctttttctcttaacctattcagggcaagtttgtagtaaatatatttttcggttcgcacaaaataatgggaaatgacattatttgaaagcgtatccattaacactaatacgccaaaataacgacagaaaaacgttgtatccataatgatattcaggtatcgatttaaaggcggttttaaagctgttttagggactttatcaatatatctttgaatagttctgactaaacaatgatatttaacggcaagttgttgataggtttgttttccagatgtgtaatcagtccaaatcttaattgggtctaatttagtttttaagataaaggttttatggcatttatgacaaaaatatcgttgaatattatttgatgtaccacatttctttattttcagactttggcaaaatgggcagttttttgttcatatttcaaaaagaggcttaaagccttgtagtatagggctttaagccactttttagcaacaaatttgtctattacaccagtaaatatcgcataggacattaaagaaactgcaaccttattgaggaaaattaattatccctcttatacagtaatgatttgattttttaatgtctgctattaatctcacggttagagcaatctaaccgtgagatgttaatagctatactcaggaagactctaaaatataggagtttttaatatagaaactaagatagatgttctaaaaatgctggcaaattttgagcccctacttgttgagctacgacttctccatttttaaaaatcaataaaaatggaatactacgaacaccaaattctgctggaatctgctgattttcatcaacattcatcttcacaatacgagccttatttccaagatttatggctaaatcatctaatactggaccaattgctcggcaaggaccacaccaaggagcccaaaaatctaataatactgggacatccgattttaatacatcttgttcaaaagatgcgtcagttgtatgaattactgtactcataatttttccttaactaaaataaaaaagaaacgcttctataacatctaaagcgttaagacgtgcacaagatagtgctttattcctgacttttcaagtaggaattaagtattaatgtaattaattttacctagcgtgctatgaagttttatacttagggaaatttccactatgtataagaatactaaacggcaaatcctcatatagttcagtgaataactaacacattgatacattatatcttatttacaacatttttatgggacatatctgttgatgcctttgtctaccttacaaatttaggagaatatccataggctaaataccccctcatacaccaatttccccccaaataaaataaacactgccccagcaaaattatctagatagcggttatatttggcataaaaatggcgaatagctggtcgagaaaatagcaaagcgacaagccagaaataaaccactgcactgcccactaaaatggcaagtaccgcaagtaagtccgctaatgccgagagattagcaacataaccagctaaaacactgctgaaaaacaccacaattttagggttggcaaggttaatcattaatccttttagaatttctttaacggttgaagttgcttgtgatgtcgatgttgccgagccaatttccgcatttttcgtgatttgcaccatttgaatgccgctataagcaagatagcttccgccacaaatcatcagcacaaattgaaatgaagggaaatgtttattgagaaatgccaagccaaacaaagtgagcaatgcccaaaatgcaacaccgatagagataccgatagcacctaaaatcgcatttcggcgagtatctgccattgctttacggctgacatagaaaaaatcaggaccagggctaattaagcccagtaattgtacgaaaaaaattgtccacattttaaatgcaccaagagatcaaatagagagtaataatcgagtagattgccgctaaaatatcatcaaacataatgcctaatccgccttgcagatgttcatcaaaatagcggatagggtagggtttgagaatatcaaacaagcggaaagtgacaaaggtcagcagataatagagccagttgtgttcaggcagaaaaccgaagatcacaaacaccgcaacgatctcgtcccagacgatccgcccatcatcgtgtacgccaagatcgtgactggttttgtcgcagatgtagcacccagcaacaaaagtgatcaagctcagtaacacaaaaaagagcgtgctttctgtgatgtgccacaacaagatcgccccccctaaaccagccaaagttccccaagtaccaggggcaggtttgattagccctgaaccaaagccgaatgcgagaaaatgaataggattttttaaatttatcttcattgttaattaaaatgatcaaagccaacttgattaggctgtggataaacagtgccgtgttttagtaaggttaaacgaccgcttgtttcggtgattttaccgatacaatggcaagaaatgcctaaatctgcaacggcttgttccattgcagaacgattgtcttccgatacggtaaaacagagttcataatcttccccacccgttaaagcaaattgttctgcctgttcttgtgaataagtttgtaacaatggtgctgaaaatggtaacttatccacattaatttccgcaccgcaaccacttcgttctaaaatatgccctaaatctgctaacaatccatcggaaatatcaatcgcacattgtgcatagttgagcaaacactgtcctaatgtcactctaggtgttgggcgtaaatggcgttgaattaagtagtgttgagcgtcggtcaatgtggctggcggattgagcaacagggctaaccctgccgagctatcgcctaaatgccctgaaacatagataagatcccccacctgtgctttatggcggaataatcctttgcctttaggcagaaagccttgtgcggtcaaggtgatcgccaagtgacctttggtggtatcaccgccgattaaagcggtttgatgctcggctaaaatagcaaaaagtgattggctaaagctatcaagccattgatgatcaacgtcggataaggttaatgccaaggaaacccaagcgggttttgcccccattgctgcgagatcgctcagattaaccgcaacggacttataagctaaatcagcaggggaaatcgtaggaagaaaatgtgtaccaagcactaaggtgtctgtggtaatggcgagctgatgatccgttggaatttctgtcaccgcacaatcatcgcccacggaaagtaaaatatcgtggcgatctaaccgcttgtcacgactaaaatagtgctttatcaaatcaaactcgcccattgtaatccttatttgcggttcaacgcaggggctaatttatctaatacgccattgacatatttgtggctatcgtcagaaccgaatacttttgccacttcaatcgcttcattaattgccactttgtaaggcacatctaattcaaattttagttcataactggctaaacgtaagatagtacgttcaatcggatctaattcattatctgcacgatctaaatatggacgaagaatatcatcaataacatctacattttctaccgtaccgcgtaacaatttacggaaataaggcatatctacgccttgcatatcttgatcggtcacaaaggctaattcaacttgttcaatgctattttgcgaaatgtaccaagaataaagtgcttgcaccgcacattctctcgcacgacgacggggagaaactttcataaaacctcaatttatcgaaataaaaatagtcggcaattctaacacattgtagccttttcccgcaaaataaaggtgaagttatttctgcttttccgctcccattttttcagattttacaatataaggcgtaacaaaaataaccagctcccgtttagagattttatctcggttttggctaaataagcgtttaatcacggggatactgcctaacagcgggactttatcttcgcctttggcgatcagatgttgaaaaataccgcctaatacgatggtttcgccgtgtttagcaaggacttgtgtattaatttcttgtttatcaatcgttgccatcatattgttcatctggttatttggcgaattttggctaatggcaagatctaacaaaatctgattttgtttagaaatatgtggcgtgacttctagccccaaaaccgcttcacgaaattcaatatcggtgatttcctttttcttactgtacattgcataaggaatctctgtaccttgtttgatactcgctggttttttatctgttgtgagtaagcgagggcttgcaatgatctcaatgttattttcgctctctaatgcggtgagttctaaatgaagtacacggctgttgatagcggcaatttgtaaggcaacggaagcggacggatttactggaaaatttacgtttaagttgttggtagttaatccgttgccctctaagtttcctgccaatttgtagtgattttcgttaggggaaaataagccccaacgcacgccaagttgttgtaaatgttcactgctgatcgtgacaattcgggcttcaattgcaatttgttccgttggtttatctaggctttcgataagttgagtaaagtttttaactgaggcggcactgtctttgacgataatactattactgcgatcatcaaaatgaagataaccattctctgatagcaagttgccttgcccttttgtcaaagactctattacttcagaggctttggaatagtgtaacttgattgttttggtgattaatttaggcagagcattaactaattgtgccgtagtatgttgtttatgttcttgggcttgatgaatatagtaaatgccattttctttttttaaatttaattgatgtgttttgattaaactatttaatatctcatcaaaatggcttttttctactctgaaattttttgtatctttaatttcatccgaaattgtaatattctttccagtttcctccgccaaataactaataatctctgccgttggggcatttcttatcgaaagtgaaatttgttggtttgctaatacaggaaaagtagcaaagaatagcaggaataaataacgcataatatactcctaaaattttgaagtaaacaatttaggggattggcaattttctgttttttgccaattaatataactaacagatttaaaattaatttctttaatttgaataaaggaatggcttaaatagtcgtcagggtataaatctataagctgttttttatcatctataaaaatcgctcggattttatcgtcgatctgaataatgccgataagctgtaatttatcaaaatctgtggtgaggtgaatttcgttcaccttctctgttggcgtacaagcggtcgttttgttttgatcttttgccgtttgtggctgatcttgggcattttccttggcataaaaaggatctgccatagtaacagcacttagaaagacaaaatagaaaaagcataatcgcattacggttctcctgtgtcagcttgaaaaagtaaagtggcattgagttgaatatatttctgttttgtttttttagttaaatgaatttcctgaaatttaactgttgttaattgattaagctcagcaatcacattaaatatcttttgtgtagattggctaattaataaatagatttttctttcttccatattccattgaatactgtcaatttctacgctatttttatctaaaatcagctgaatttgttgatttattttggttaataattcacttttatcttgagcaagttgatagcgttgttgtaataattttaattgttgctgtttatgctcaataatctgtttaacttcagtgagctgtttttgttgttgttctattttctgattaagataaaaataatttcctactggaaatgccacaatcaataaaaatattcccgatagaataaatcctttattttggtttaaataatataagccacgatataatggatgttctggcattaaataatacttggctaaggacaatttcattctttttcctttaaatcaatatgtaggctaaattcaatctcgcttttttcacgcgtttcaaattgttctatttgataaatgtaattcattgcttttaattgttgttcaagctggctaaattgagtagggctagacaccttgcctttgagtttaaagacggtattttctgcttggtatagttgggctatctcaataatccctgataattgaatgcctaacagataattcaaaaatgcggtaatctgtctgttctctaggctttgtgtgcttttattttgtgattgcaaagtcagttgttcaatctgctggcttaatgcggtttgttgctcttggctttgttgtcgctgttgagccaaagtgtgaaattgatgttgttgctgttgattttgccaactgataagtaacgccagtagtgtgctaatcacaatgcaagcggtgagatgcttgaggtttttttgcgactgtttcaaccattgctgttggcgatagccgtttagattgataccttgccattccataagctcgctcctaatgcaataagataaggataaaaatggggaaagtgttgagcttggggcaagccgtccacttcaatgattggtttggtgctattattctgcttttcgacgataattcgttgattttgaaagtgaataaatttgtcttgaatgtggaaactgtgttcaagaatttgcgtttccgttatttttgtcagaaatcctaccgctcgtagtaggcagtagagttcgcaatctaaaatagccgttgggtcaaagctgttgctttttcttagagcatatagattaagctggcaaaggtggctttcggctaaaggggtaatgtggtaatcaatgtttacttcagataaagctaaaggtaggctctgtttgagtacacgaatgatttgctcagcttgttttaaatgggaatgtagctctggcagtattaaggtttttcgccagatatgctgatgagaaatgccttgaataagctgatagttaaagggaaattgttgtaggaaactatccgcttctactttgcttgaaaagtaaaaggtgtgaggttgttcttgctcaaaatagacgatacaagcggtattttcttgccagaaaaagccaacttgaataggtttgagttgcggtgttgtacgaaattgaaagaatttacccatatttccctcgaataaaaaatagattatgaggtcaattaaaactataattactcgtttctacctcactgatgtataagcagagggcagttttcggatttaggttatcttgacctagaattatcctttcgtcatttagcaaaagagaatttttcgatgaagatcgtaaaaatcatatttagtgctttacttacactaataattgtgggtctagttgctgtaggttttctttatgttcatttaaaagaagatttacctgatgtagcaagcctaaaaaccgttgaacttcaacaacctatgcagatttttaccgctgacggtaaactcattggggaagtcggggagcaacgccgtattcctgtgaaacttgccgatattccgcaaaccttaattgatgcgattattgcgacagaagatacccgtttttatgaacataaggggatcgatcctaaaggcattatgcgtgccgtttggcgttcaagccaaggggatacgcaaggggcgagtaccattacgcaacagttagcgcgcaactttttcctttcgccagaacgcaaacttgagcgtaaattaaaagaagtaattttggcgttagaaattgaagaaaatctgtctaagaatgagattttagagttatatcttaataaaatttacttggggtatcgctcttatggggtggtggctgcggctaaaacctattttggtaaaaagctagaagaattaaccttatcggaaatggcgatcattgcagggctaccaaaagccccttccacgatgaaccctcttttctcgcttaaacgagcagaagcacgccgtaatgtagtgcttgggcgtatgttagaagtcggaaaaatcaccaaagctcagtatgaacaggctaaagcagaaccgattaaagccaaatattacggtgctgcgttagaatttcgcgccgactatgtgacagaaatgatccgtcaagaaatggtaaaacgttatggtgaagaagtcgcttacaccaaaggtttccaagtgtttgcaacagtgttatcagctgaccaaaaagaagcacaagatgcactacgcaataacttgattgactacgaccgccgtcacggctggcgtggagctgagaaactgtggaaccctaaagagaaagcgtgggacgaagaaaagatcatcgatcacctaagcaaattgccaagctctgagccatttacgagtgcggcagtattggcaatttcaaaagataaagcgaatgtgatgttgccaacaggggagcgtgttgagcttaaaatgtctggaatgcgttgggcaagaaaatttatcaatgactccgcccaaggtaaagcacctactcaagtaaaagacgtgatcaatgttggtgaacaaatttgggtgcatcaaaatagtaagggtgaatgggaattagggcaaattccagatgtaaactctgcactggtttcactaaatagtgataatggggcgatagaagcgattgtgggcggtttcagttttgaacaaagccgttttaaccgtgcaacacaatctttagtgcaagtaggttcttcgattaaaccttttatctatgctgcagcattaaataaaggattgagcctttcaaccactctaagcgacacgcctattactattacaaaagcaggacaaaaaccgtggacaccgaaaaattcaccgaatgtgtatgaaggtccgttacgtttgcgagtaggcttgggtaagtcgaaaaatgtgatgatggtgcgtacagttcagatggctggcgtagagtatgtagcggattacttacaacgctttggcttccaaaaagatcaatatcaagcgacagaagcattggcattaggggcagcgtccttcacgccgttagaaatggctaggggatatgctgtgtttgataatggtggctatttgattgaaccttatatcattggtcgtattttagatagtacaggcaatgaactctttaaagcaaaccctgcaattgcctgtttagagtgtgatgataagccagtcatttatccagagccaacctattttgattttgtcaaagtaaaggaaactacagaagaaactgtaattcctaaagatgatgaaagtgatgttattcctgaactggatattgccactaaaaccaaacaaaatgccccaagcttgatggcagatgccatagctgttaatcgagaagtgcattatgccccaagggttatcagtggggaaattgcattcttaatgcgaagtgcattgaaaacagctattacaggtgaagctagtcaaggttggaaaggaacaagctggcgtgtggcaaatgagatcaaacgcagtgatattggtggaaaaacagggactacaaataacgccaagatcgcttggtacgcaggctttggctcaaacctcgtgacgacagtttatgttggttttgatgataataaacgtgaattgggacgtggtgaggctggcgctcaaacagcgttgccagcgtggattaagtatatgaaagtggctctttcggataaagaagagcgaaaagaacagttgccacctaatatcatagaattacaaattgagcctacaagcggtctattagggggaaatatgagcgaatatttcattaaaggaactgaacctaagaaacgttatattgtagagaaggcacttgaacaacctctaggtacaaatcctgaaggaactgaaaaaatcagtaaagaattattctaaaattcgataattctctttgttccagttgaaaagtagggcgatttattgagataatatcgcccatctttattttgggcgatttgtggtaaatttataagataagtgttttaattttaatcacttttacaaaattcaacataaaacagaccgcttgtatgtgcaagcggtctgttttttctaaaaattcacaaatcaatttttcactctatttttatttatagaacaaataatggcagaaaaacgtaatatctttctaattggccctatgggtgcaggtaaaagcacgattggtcgtcaattagcacaaatgttaaatatggattttttagactcagacgctgtgattgaagagcgtgctggggcagatattgattggatcttcgatattgaaggtgaagctggtttccgtaagcgtgaagagcgtatcattaatgagctgacacaatctcaaggtcttgtgctttcgacgggcggtggttcggtgttgtctaaagataaccgcaatgtgctttcagctcgtggtattgtggtttatcttgaaactacggtggataaacagtttgaacgtactcaacgtgataaaaaacgtccgttattacaaacggaagatccatatcaaacgttagttgaattggcaaaaattcgtaatccgctttacgaagaaattgcggacattattttgcaaactgatgaacaaagtgcaaaagtagtcgcaacgcaaatcattgatatgattgataatttacagtaatcagggaagtctatatgttgcaagttaatgtggaattaaaagaacgtcgctatcctatcgcaataggggcagggttattaacggatccgatgagttatcacccgttaaaatcaggggataaggtgatgatcgtctctaatccaacggttgcttcccattatcttgcaacagtagaacaaacgctaacagctatcggttgtaaagttgattcggttttaattcccgatggagagcaatataaaaaccttgactcactcaatcttatttttaccgcattacttgaaaaaaatcacaatcgtgattcggtattaattgcgttaggtggtggtgtaattggcgatgtggctggctatgctgctgcgtcttatcaacgtggtatccgttttattcaaattccaaccaccttattagctcaagtggactcttccgttgggggaaaaacggcggtaaaccacccgcttggcaaaaatatgattggagcgttttatcagccgatttcagtcattgttgatacaaataccttaaaaaccttgcctaaacgtgaagtgagtgcaggcttagcggaagtgatcaaatatggtgcaatttttgatattcaattttttgaatggcttgaacagcatattgacgatctcgttgcccttgaacagtctgcattagagtattgtattcaacgttgttgccaactgaaagccgatgtggtggctcgtgatgaaacagaaaaaggcgaccgtgctttgttaaatttaggtcacacctttggacacgcgattgaagcacatcttggctacggtaactggttacacggggaagcggttgcagtcggtatgcttgaagcagctgccttgtcccatattctaggcgatcttacggaacaagatgtggctcgtttagaaaaattgattgctcgtgcaaccttgccaaccatttcaccagatggaatgatgcctgaagaatatctaccttatatgtggcgagataaaaaagtactaagcggtcagttgcgtctggttttattaaaatcacttggcacagcttatgtcaccgctcaagcgaccgaaactcaagtgttagatgctatccgtcgatttactcaatcctaagttttaacaatgaaacagcgagcctttttaaaatgggcaggtgggaaatttcgcctgaccgatgaaattaatcggcacctaccccaaaaggcttgcctagttgagccttttgttggggctggctcagtttttcttaatacacattttgaacgctatattcttgctgacattaaccctgatctgattaatctctttaatgtgattaaagctgatgtggaaagctatatccatcaatcgcaagccttgtttaatgatccacaagcaaatacggcaaaattttattatgagcgacgtaaggaatttaatgcttgccaagatctgctacgtcgttcagcactgtttctttatctcaaccgttttggttttaatggtttatgtcgctataaccaaaaaaatgagttcaacgtgccatttggcgattataaaacccattatttccctgaaaaagagttacgcttttttgcggaaaaagctcagaaagcggtatttatctgtgccgattttcatcaagtctttcaatatctattagataatcctgatgattatgcggtctattgcgatccgccttatgccccgttgaagcaagaaacgaattttacccattatgctgggggcggtttttcccttgagcaacaaattgctttagcagacagagcaaaacaagctcaacaggcgaaaatccctgtcttaatttcaaatcacgataccgagtttactcggcaaatctaccgtggagcaaaaatcaaaaaactgaaagttcagcgtcacatcggtcaatccattgattctcgaattaaagtcgatgaactttttgctctgttctcttaacttccttttgtatgcagtaggaaaaaatatgaatacacaaccccaagaacgccaatcgtggtcaaatcgattggcatatattatgaccgtagcaggtgcaaccgttggttttggtgcaacgtggcgtttcccttatttagtcggtgaaaatggtggtggagcttatgtcgcgctattttgtatcgcaatgatcgtgatcggtattccgatgatcttggttgaaaatgtgattggtcgccgtatgcgagtaaatgccattgatgcctttacgggaaaagcgaatggtaaggctattcacccggcgtggaaaatcttgggctatatgggattattaggatcttttggtatccttgcttactatatggtgcttggtggttgggtattaaactatatcggcagtcttgtaacgggcggtttagatctatcatcacctgttaccgtagaaactacatctacttattttaaagagagtatttttaacagcccagttaccattttggcttatactggcttgtttgtcttagtaaactacttcatcttagtcaaaggcattgttgatggtattgagcgttcagttaaatatctgatgcctctactctttatcttcttgattgttatggtgatccgtaatgtcactttaccaggggcagcggaagggattaaattctatttaatgcctgatttctcaaaaattacaccgcaattatttgtctttgtattagggcaagtcttctttgcacttagcttaggtttcggcgtattaattaccctttctagctacttagataaaaaagaaaatctagtgagaaccgcgacaatcacaggggtattaaataccgtgattgcagtcatagcaggatttatgatcttcccatcactctttagctttggcattgccccaaattcaggctcaactctcgtcttccaaagcctaccaattgtcttctctaatatgtggagcggtacgatctttgctattattttctttggattattagtggtcgcagcattgacgacctcattaaccatctatgaagtgatcatcaccgctttacaagaaaaaaccaaaatgagccgtaaagcagcgattttctggacacttaccctgattttcatttttggaaatattccatctgtactaggcgataatgtctggaaagatgtcaccattatgggcaaaagtatttttgatgcctttgactatatcagcggtaacattttatttattctcaccgctcttggcagtgcaattttcgttggttttgtcttaaaagatgaagcgaaggaagaattaggggcagggaaaacattaacgaatttgtggtttaactatgttaaatatgtgataccgcttttgattttagtggtattttttagctcgctttaatttaaactgacttaacaagtgagcatttacataataaaattcacaactcaagcagtaatcaatagggttactaatctactccactatttttattttaagaggtcttactatgaaaattatcttattaggagcacctggtgcaggcaaaggtacacaagccctatttatgatgaagaaatttggtattccacaaatttcaacaggggatatgttccgagctgccattaaggaaggaacagagttaggtaaacaaatcaaagcattaatggacgagggaaaattagttccagatgaattaaccgttgccttagttaaagaccgaatttctcaaccagattgtgcaaatggtttcctgctagacggttttcctcgcactattccacaagcagatgcactaaaagaagctggtgtaaaaatcgactttgtattagagtttgatgtggcagatgaagtaatcgttgagcgtatgagtggacgtcgagttcatcagccatctggtcgcacatatcatgttgtatataatccaccgaaagtagaaggtaaagatgatataactggcgaagacctaattattcgtcaggatgataaaccagaaactgtactagaacgtttaacgatttatcataaacagactaaaccattgatagcgtactatactacggaagctgaagcaggaaatactcaatactaccgtttagatggtactcaatctgtagaatctataagcgatgaactcaataaaattttagggtaatttcctttctacatatagaatcaaaaatagttgctaagaaccaatacgatcttagcaactatttatctcaacgttttattatttaatatgtctttcttgataccccgtataaatttgtcttggacggacaattttgaggctctcttcgcacatttctttccaatttgcaatccacccgactgttctgcctaaggcaaaaataacagtaaacatggaagttggaatgcctatggcttgtaaaataatacctgagtagaaatcaacattaggataaagtttgcgttcaatgaaataaggatcgcttaaggcaatgcgttctagttccattgcaacttcaagtaatggtgttgttattcctaattctgcaaggacttcgtggcaggtttcccgcataacttttgcccttggatcgtagtttttatatactcggtgaccaaatcccattagacgaaatggatcatttttgtctttggctcttgcgataaattcaggaatacggtcaaccgtgccgatctcctgtagcattttgatacaagcttcgtttgctccgccatgagctggcccccacagtgatgcaatccctgccgcaatacaagcaaatgggtttggaccagaggaagcaacgcctcttactgttgatgttgaagcgttttgttcgtggtctgcgtgaagtgtgaagatgcgatccatggctcgttctagtacagggttaaccacataaggttcacaaggtgttgcaaacatcatgtgtaggaagttgcctgcgtaggataagtgatactgcggatacataaatgggcggccgatgttgtatttgtaacacatggctgcaagggttggcattttggctaagaggcgaatggcggttttttctcgatgtgcttcatcatcactgtctagcatgtcattgtagaatgcggctaaagcactacttgctgcacacataaccgccattgggtgcgaatctcggcggaaaccttgaaacaagcgggtaaattgttcatttaccatgtaatgtgaacagatctcttttttgaactcagccaattcttcttctgtaggcagttcgccatttagaagaagataggcgatatcaagataggttttatttaaagcaagctcgtcaatcggatagccacggtgcaataagacaccttgttcgccgtcaatgtaggtgatactggattggcatagtgcggtagaggttagcccttgatcgtaggtaaagagttggtgcttttgtaatgcctcaacgccaattgcatcaaaacctaagttactctgataaacgggcaatggaattttacgcccatcgttaaggtgaagttctgcagttaaagtcgggtgtagtttaggcattttgtcctccctgttatcgtaaattttatgcaaaatcaaaccgctgtttgaaaaatgaggttatccgctttttgggtataacgttgaatttggtcaaaattcatgtagcggtatgtatccgttttatctgcctctaggcgttgtacataatctaaatactctttccatgtaggaatgcgtcctagtaatgcacagactgccgcaagctctgcagaagcaagatagacaaaagagcctttacccatgcgatttgggaaattgcgtgtagaggttgaaacaacggttgagccgtcggctacacgagcttgatttcccatacaaagtgaacaacctggtatttcaattcttgctccacttttgccataaatgctgtaatagccctcttcactaagtagtgttgcatccattttagttggtggagcaatccataaacgtgttgggatcatgccttgatgctggttaagcaatttacctgcggcacggaaatgacctatgttcgtcatacaagagccaataaagacttcatcgacttgttgaccttgcacttcggaaagtgttctagcatcatcagggtcatttggggcacaaagaataggctctttgatgtcatttaaatcaatttcaatgatagcggcatattcagcatcactgtctgcttctaataattgtgggacagccagccactcttccatggctttaattctgcgttcaagggttcgtttgtcgccgtaaccctcagcaatcatgtattttagtaagatgatattagactgaagatattcgatgatcggttcttgatttaatttgatggtacaagcagcagcagaacgttcggctgaggcatctgaaagttcaaaagcctgttcaactttaaggtgctctaatccctcaatttctaaaatgcgacctgagaagatatttttcttacccgctttttctaccgtcaataacccttgtttaatggcataatagggaattgcatgtacgagatctcgtaaggtaatgcctggttgcaattcgcctttaaaacggactaaaacagactctggcatatctaatggcattactcctgttgcagccgcaaaggcaactaagcctgaacctgcaggaaatgagatgccaatcggaaaacgtgtatgtgagtcgccacctgtacctacggtgtcgggcaatagcattcgattaagccaagagtgaataacaccatcacctggacgtagtgaaataccgcctcggttcataatgaaatcaggtaaggtatgatgtgtcacaacatctacaggtttagggtacgcggccgtgtggcaaaatgattgcatcactaaatcagctgagaaacctaaacaagcgagatctttaagctcatcacgggtcattggacctgtggtatcctgtgagccaacacttgtcattcgaggttcgcaatactgccctgggcatatgccctccacgccacaagctcgcccaaccattttttgtgcaagtgtgtagccgactgttgttttagcctgtatttgaggtttaacaaacacttcactttctggcaatcctagtgccatgcgtgctttatgtgtcaaacctcgaccaataatcaatggaatacgtccgcctgcacgaacttcatcaagaagcacattcgttttaagactaaactgggctaatacttcgtcactgccatgcttacaaattttgcactcatagggatagaggtcgattacatcgcccatatttaattggcttacatccacttcaatgggtaatgagcctgcatcttccatcgtattgaaaaaaataggagcaatcttaccgcctaataccacacctccagctcttttattaggaatgtaaggaatgtcatttcccatgagccataagaccgaatttgtagccgatttacgtgaagaacctgttcctacaacatcgccaacataaacaagtggaaaacctttttgtttaagggcttcaatctgtttcattggaccaactacaccagcttggtcaggttcaataccctcccgttcatttttaagcatagccagtgcgtgcaatggaatatctgggcgtgaccaagcatcttgtgcaggcgaaagatcatctgtattggtttctcctgtcactttaaacacggtcagtgtgagtttttcggctaattttggacgagataaaaaccaatcagcattggcccaagaggttaatacttctttagcaaagcggtttccttgcttcgctttttctgccacatcatgaaaactgtcaaatactaagagcgtatgagagagtgctttgacggcaataggagcaaggcttggatcatcaagtgcttcaacaagcggttcaatgttgtaccccccttgcattgtgcctagcaagctgacggcttgttgtggggaaatgagcggcgaaactgcttgcccttttactaaggctgctaaaaagctggctttaacataggctgcttcatcaacccctgctggtattcgattttcaaagaggtgcaagagtaatgctttatctgcatcagcaggttctttaagtaattcaataagctctgctgtttgcgctgaatttaatggcagtggcacaataccttgtgcagctcgttcaaaaacatgtgtttggtattcagttaagaaagacataatgatgatccccacttcaatatagataaaaaatgagcgatgagataatcataacagagagagtaaaaacgacaagcaataaatttaacagattttacattttgttaacaagatcacaaaattgcatgattatctctatgtgtataagtggttacatattggcgacaatatcttgggcaaattccgaagttgtacggagtgttgccccctctaatgtttccgcaaaatcaaaggtcactgtcttatttgagatggttttggatactgcgtttaccactaaatctgccgcttcagtccaacctaaatgtcgtagcatcatttcgccactgagtatgatcgagcctggatttgctttgttttgacctgcgattttaggcgctgtaccatgcgttgcttcaaaaatagccgcctcttcccctatgtttgcaccaggtgcaataccaataccgccaacctgtgccgcaagtgcatcggatatgtagtcaccattaagattaagcgttgcaatcacatcgtaatcacttggatgtaataaaatttcttgtaaaaaagcatcagcaatgcaatctttgatgatgatctctcgtcctgtatttggattttttaaacgatgccaagagccattatctattggctctgcaccaaagtctttggcaacttggtatccccactctttaaatgccccctcggtaaatttcatgatgttgcctttatgcactaaagtgagtgatttacgatcattatcaatcgcgtactgtaatgcagcccgcactaaacgctgagtcccttcttttgaaacgggcttaataccaatgccacattcttccgtaaagcgaatttttttcacgcccatttcctgccgtaaaaaagcgattactttttcagcttcataggaacctgccgcccattctaccccagcataaatatcctctgaattttcacgaaagatcaccatatccactaattctggatatttcacaggacttggcgtaccttggtagtaacggattggacgcaagcaattatagagatctaactcttgacgcattgctacgtttaaagaacgaatccccttgccgacaggggtcattaatggacctttgatcgcaatatgatactgtttaattgatgctaatgtttcttcgggtagccatgtgttttcaccgtaaagtcggttagctttttcccctgcataaatctctaaccagtcaatttttcgttgaccttgataggctttttctaccgcagcatcaattacaaaacgcatggctggtgtgacatcaacgccaattccgtctccctcaataaaaggaataattgggtaatttggaacagacaatgaaccatcatgatttagttgaatagcttgcccttttggtgtagtgagttgagatagcattatttcccccttaaatgcgacctgataccgcttaattgagtttgaaaataaaaacagcagatgttgtattttttacaagcaacgggataataccatcagataacaaatttaacaaaaaatttacatttaaaaattttcatcattatctgcaagttacataaattaaattcatgaaataatgaaaataattttattgacatcatatcgctggcattttaaagttttagccatctaaacgtctaaaaaagacggcagtatgcaaactaaacattatacaaataacaacaatagaagctcgatagaggtgttgaatgagttatgcaaaagagattgatcttttaaatcaaagtgttgccgacttaaatggcaaaattaatgtgtcttttgaattttttccgcctaaaaatgaaaagatggaaacgttgctatgggactctattcaccgtttgaaagtgcttaaaccgaagtttgtttctgtgacttatggtgcaaactctggggaacgtaatcgcacgcactctatcgtaaaaaccattcaacaagaaacagggattgtcgctgctccacatttaacaggtattgatgcaacccctgacgaacttcgtgctattgcaaaagattattgggacagtggcattcgtcacattgtggctttgcgtggcgatgagcctactggctatgcgaagaaacctttttatgcgtcggatttagtaaaactgttaaaagaggttgccgattttgagatttctgttgccgcttaccctgaggttcaccctgaagcaaaatcagcccaatctgatttgctctatttgaaacagaaaattgacgcaggtgcaagccgtgctattactcagtttttctttgatattgatagctatcttcgcttccgtgatcgttgtgcaacggtggggattgatgttgaaatcgtgcctggcattttacctgtgtcgaacttcaaacagttagaaaagatggcaaaaattaccaatgtaaaaatccctagctggatggcgaaaatgtatcaaggtttagacgatgatcaaactacgcgtaaccttgtaggggcaagtattgcaatggatatggtgaaaatcctctctaaagagggagtaaaagatttccacttttataccttaaaccgttcagaattaagttatgctatttgtcatactttaggggtaaggcctgaataagctattcactatagaccaacccgatcttcgcagatcgggttttctctatttggatgcttatctttctgtattcaaaaacgtaactttcttgtaaaatccaaccgcttatcacaacattttatagaggatttatagtgacattaaaaattggcgttgtcggtgctggtggcagaatgggtcgtcagttgatccaagccgtaaataacgcagagggcgtggaattaggtgcagcatttgaacgtaaaggatcatcattagtcggggctgatgctggcgagttggctggtattgggcatttaggcgtgactgtcacggacgatttagcttcacaggtcaatcattttgatctgttgattgattttactcgccctgaagggacgttggaacacatcgctttttgtgtcgcacataataaaaaaatggtgatcggtacaactggttttgatgatgcgggcaaacaggcgattaaatctgcgtcggaaaaaatcagtattgtctttgcttccaattacagcgttggggtgaacttagtatttaaactgttagaaaaagcggcaaaagtgatgggcgattattgcgatattgaggtgattgaagctcaccaccgccataaagttgatgcgccatctggcacagcgctttcaatgggcgaacatattgccaaaaccttaggtcgtgatttaaaaacacacggcgtatttgcgcgtgaagggatcacaggggaacgtaagcgtgatgaaatcggttttgcgacgatccgtgcaggtgatgtagtcggtgaacacagtgtttggtttgccgatggaggcgaacgtgttgaaattgcccataaagcttcaagccgaatgacgtttgctaacggtgctgtgcgtgcagcaaaatggcttcaaaccaaacaaaacggtctttttgatatgaccgatgtgttggatttaaacaatttataataaagaaaagcggtcagatttaatcaaaattttgcaaaaggatagatatgaaatataacaacattgaaagtactttagtccaactaggtaatcgtactgatgagcgtaccggtgcggtggcgaccccgattttcctttcgactgcctatggacatatggggatcggcgagtctactggatttgactatactcgaaccaaaaacccaactcgtagtgtacttgagcaaggcattgcggacttagagggcggcgatgcaggttttgcgttagcctcaggtatggcggcaattcaactggtgatgtcgctctttactgcccctgacgagtggattatctctagcgatgtttatggcggaacttaccgcttgttagattttagctataaaaataacaatactgtgaagcctgtttatgtgaacacggcagatcttgatgctattgagaaagcgattaatccaaatactaaagcgatttttgttgaaacaccgtctaatccattgatggaagagtgtgatgtcgcagcgattgcgaaaattgctaaaaagcataatttactgctgattgtcgataatactttcttaacaccagtattattccgcccgattgaacttggggcagacattgttattcacagtgcaaccaaatatttggcaggacataatgatgtgttagcaggtttggtggtagcaaaagggcaagcgttatgtgaccgcttgttctatttgcaaaatggtgctggggcggtgctttcaccgtttgacgcttatatgattattcgtggcttaaaaacccttgcgttgcgtgttgagcatcaccaacaaaatgccactgaactcgctaaattcttatcggaacaaccgcaagtgcaagatgtgctttattctggtaaaagcggtatgttatctttccgcttgaaagatgaaaactgggttaatccattcttaaaagcgatcaagatgattacctttgcggaaagtttaggcggtacagaaagttttattacttaccctgcaacccaaacccatatggatattcctgaagcagaacgtatcgctcgtggtgtgtgtaataagctcttgcgtttttcggtggggcttgaacacgttgaggatattaaagcagacttgctacaagcctttgctcagttgaagtaaattggtgtaatagacaaatttgttgctaaaaagtggcttaaagccttatagtacaaggctttaagccactttttttgaaatataaacaaaaaaactacccattttgccaaagtccgaaaataaagaaacatggtatacaaaataatactcaaccttacttttgtaatgaatgtcataaaacgtttatcttaaaaaatgaattttattagcgattacgtccttagtttataaaacgccaaacgtttttaaaagaatgaagtgataaagccaataaaaaagaccatttcccttataaacgtcgtaatgcaagaagtgcttataccagcttaaagcgttatatggattttatttttatctatgagaaatattctgaattaaatatagaaaatacaataaatcgcttagagggattatttagcgagcttaagcaaaaattaaataatcataactgattaacaaaaaggcgtaatattttgtttatacaagatttttaaataaaaagagttgctaagaataattaaaaatacccattagcaagtattttatttattatacctatcaattagacaatctgtttttttgcaatgcgcgatgttttacttgatgtacgatatttgtaatcaccccagcgatatttacatcactccattctttaatgcgtaaattaggttctgaggtgtctaaagaaaataaaatcttctctccattaatctcactgaaaaattggtagaacttatactcttgatttttctctaataccaaaagatcgttaacttcagcagattgattattctctacaattaacaaatcatctaattcgatcccccatgcaattaaattagggtttttcacatgaaccagaaaggtttcagaaggacgacgaacataaagagaatagagatccagtttgattgggtgctttatattagaatctcgataaaggggtaaaggctgatgggattgtgccaatgttagtgatctaagatacgccataaaaatcctctaaaataaatctgtgtgtttatacagttattttactgtttaaacacacagtgtcaataggaattttgcgttttagtgtaaatttttacaggtaaatcatcaatcaatattttttagctgttcttcagataatgtttcttgctcactattttctgttttaccatcttttactttaaactctaaattttgaaaataagcttctcggaaagtaatgtaaggatcttgagattgcttcaataacgcttcttgtcctataagctgtgcacgggaatctactccttgtacgacatattttgtgatactccaaggtgtagcgagtaaagataaaactggataactagtatctactaatcgacctaaatcttgacgaggcgttgcgggtccatacattggtaacatcacataaggtcctgtaggcacattatacgcgcctagagtatccccaaattctctacgtttatcaattttaagatcattggtcatactcgcgaagtcaattaacccgcctaatccaaagatagagttaaaccaaaagcgagtaaagtgaaccatcgctttttgtccttccccttcaattaatcggtttacaaagctggcaggttcatcaaggttatttgccacattgactaaacctgttttaattgggctaggtacataatctcgccaaccttttgccacaggttcaagaatataagggtctagatattcgtaattgactttccacatggcacggttaaatccttccaacggatctgaacgggtgccagtttcaggatcaatagaagcagtacaagcggttagaaaagcggtattgagaactaaaaatagaagtttaatttttttcatatgactactttaaaaaagggttgtgttgtttttcacgtcctactgtggtatgagatccgtgtccaggaataatgataaaatcatcttctaaatcaaatagttgtgtttttattgtataaatgagctgctcaaaattaccttggtataaatcggttcttccaatactatctttgaaaagcacatcgccactaaaggcaattttattctcaaaatcaaaaaagccgatatgacctggtgaatggcctggtaaatggcgaatatggaatgttaaagccccaatttgaattttatcacctgcatttaaccagtgatctggtagaaaagcgggcgatgcaggaagcccgtagctctgacaaatattaggaagttgttcaaaaagaggttgatcgttttgatgagagccaaagacatcaacattaaaatgttttctcagttgatcgacagccataatatgatcaagatgaccgtgagtaatcaacaatttctgcacatttaattgctgttcttccacaaaccgaattattttgtctgcatcatcaccagcgtcaataataaccgcattcttttcgttatcccaaacgacagaacaattttgttggaaaacacttacagggataatttgcaaattaaacataaaatcaaaccgcttatgaaccacgccaagtacgaacagggccagtgtcgacgtggacaaaattactgtgaggataataaccaactcccccgttattcaggctttctgctgccgcttttatgcgggcaagaggaacaccttcaatacggaaatcaatggctttacctaaaatatggtagctattgctagcaacgcctcgactacgacggcgtaatctagcatttgtttgagcagaacgatatccgcttacaataagaatttcagatttacgaagacccaagcgagcttgaatttgagttaattttacgaatagttttgggtcaattcgcttaattctgttgatatgcacatcgcgcataatatgatttaatttgttaagatcctttgcagcaaatccgttagtgtgataattagcagataaggtctcgcctgtacttaagcgttttaaacgtagaataagaggttttagggttgacgttaccgcatgaactaaattaggtaacaaggttgcacccaaaactattccgcctgatgcaagccatctttggcgttgtaaatttgtttgttccattttatcctcgcatttgggttatttaccgacaatctctcctttaatctcttgaaggtaaatatattcagcctgacttcgacattttatcaaaaaggaagttctaaaaaatagcctatcgttttcggaaattttttattttgtggactagatcacactttttactttttcccaatctaagttgattttaggtaatgatttatcaaattgataaatatcaggtaaggtgtatattttaccgccttcaatccaggatgttacataatataaataaacaggattatctgaacgaataggtgcagaagttgtttttttgcttgcaagaacgtcctgttttctctgcgctgaccacccagcttctgctaataataacgtagctagttcatctgctttagctacacgaacacagccagagcttaacgcacgattttttttactaaataaccctctatttggtgtatcgtgcaaatagattgcatcggaacttggcatattaaatttataacgccctaaagcactatcatctcccgctttttgacggatatgatacgggaaattattttttccttcataagctgcccagttgatactatgagcactgaatttattccctttcccatctaaaatttcatagcctaatttatcagcaaggattggatctttacgaagttttggtactaaatctttattcttaattgttgatggaacattccaatgcggattgacgacaacgttgctcagtttgctgtacatgacaggtgttttgcgatcatttcttcccacgattactttagactgtaaaacaagtttgccctctctgaaataatagagctgatagcttgggatattgacaaaaattccattattaaaacttggaataagacgtaaacgctgtgcattaagtgctaattgagtaaatgaaggcgtgtttacactacctttattctcttttgtagattttgctgatttattaccaccctgattgagagcatcattagatgatatttcaaataatttttgtacggtttcttggtaaatatggtttttaggtattagatccgtgacaaactgagcgtagcgatcttgcttaatcgcttccaaccaagtagcaatacgatattctgttggtgttttaattgaataacttcctaaatgatataaccattgatttgcaaattgatcgacattttctgtgtaatagagatagtctaagaaactatctgtgagtagaatatcgcgagcaaatccctcattcatatttagaatttgttgtaacgcattagccgatttaggcgaaacgccgcttacagcgaatactgcatattcttttaaaaactgtttttctgccactttatctttccacaaaggggcaaactcattattgagatagacttttgctgtcgtattggataatagtaaatgatagcctaatgtttcttgttgaatacgttgttcggcatgaattaatttttcggcttcaatgcgttttctttcagccaattgaaattgatattctgcatcttgtgtcagttcagcaatacggactaattgcgctttaaaacttaactgaggcaaaatttgttcatcaggaacaggcgttgcagcattatgttgagaactaacattcaacgcacttccattttcagcaaccacagcactagaaaacaatattactgacaaaaaagttaaacttttcattcaatttaatccattaggaaaatgagtaataaatcagaccgcttaaacagcggcctgataaacttccacattataaacgtatttattattttttatcaaattgtaaccaatcaaccatcatctgctccgtttcttttaagaagaaatcaggagcttcatagtcttttggtaactgttcaagatctttgatctgttttttaccttcacgtttaaagcgggcatttaaatctttcaaacgacgagcttcatcagatttactctcttcttgacgagaagccaaattaagtgaggtaaatttacgatcatctctttccttattaattgcgatagtttcatttaaagcaataaattcaggatttttagcaatacgtttttcgtgattttcagtgagttgtgcaactacatctctagcttttgcgacttctgaataagttgctgcaggaattttatcccaaggcaaagcattatcttcaaatccttcccctgttttttctgcattgataatttcagggaaacgaatatctgcttcaacccctttaatttgggtgcttccaccattaattcgatagaatttttggattgtatattggataaaacctaacggctcttgatccaaatcataaaccatatttaaagaacggttttgttgaacagtacctttaccaaaactttgctgcccgataataatcgcacgattgtaatcttgcattgcagccgcaaaaatttcagaagccgaagcactatgacggttaatcatcactaaaatgttgccatcatataatgttgtactatcggtatcttcgtgaacacgaatacgattaaaagcatctctaacctgaacaacaggaccatctttaataaataatcccgttaattccactacctcaggcaaagaaccgccaccattttcacgcaggtcaataatcaacccatctgcttttttggttttcatctgttcgagaagtttacgcacatctgcagtcaaaccaatatagaaacttggaattttgatcacagcaatattttttccgtctactttatcaacagttaatttcgccgcactgtcttcaagacgaattttatcccgaactaaactaataatcttggttttgccgcctttagcaggttcaatttcaagataaaccgtcgaaccttttttacctttgatattatcgacaacatcatctaaacgccagccaatcacatcttcgattttatcttttgattgccccacaccaacaattttgtcacctgctgcaatttttttactacgcgctgctggcgcaccaggcactaaagatttaatgatcgtaatatcatcttccattgaaagcgtcgcaccaatgccttctaaagacaagttcatactctcttggaaacgtttagctgcacgaggtgaaagataacttgtatgcggatcaatttctcttgcaaaagcgttgagataagtttgcagaatatcatcggctttattttgtgttaaacgacgaattgccaagttataacgtttagtcagtgttttcttgatttcaggccatttcttatctttcaaataaagattaataatatcgttttttactcgttgcaaccaaagctcatcagcttctgtggtagttttcgggaacggtgctttttcacgatcattttcaatttgatcctgcccttttaaatcaggctctttatctaacaaagacaaagcatatttataacgttcataacgacgttttgtcattaactcatacatttcaaaggcaatatctagtttgccttcatagagttcttcatctaacttggttgcatacttagcacgcaattcatcaatatcagactgtaaaaaggtattgtgagaaccatcaagccaatcaatataacgattaaagattttctcagaaaaagcatcatctagttgaaacttatgataatgcgattgtgttaaacgagctgtaacacgtttagttgaaatactatgttgttctgttggttttggaatgattaattcactttcttttatttgaggttctgcagcaaaactatttatgctacaaacgcccaaacataacccaagtaatgtggtgaatttattatatttcatatcaatcctataaatgcgactatttcttgcctttggcaaatttgctttctaatgcggacaaactttctaaagatgcttttggcatttcttgttttttcgtttcagcccgttttttggcatgtgcttcacgtgctttttgtttaaagaaagttttacgctcttccttgcgtttctcttttaattgtagagctttacgttctgcataagctgcttttgcttcggctaaagattgcgctgcatgttctgcttgtgcagcttcaacaacacccgcttcttctccttgaagaccgacacgtacagcaccttctttacatgcgtgtaagtaacgccagctcattgtataaacgcgtaatgcttgacgaagccccgttttactgattttttcatcattactcagcgcttcaactaaatcttggaaaagtccaatttttagaggtttagcttcgccttctaaactaaagcaaagcggaaatttttcagccaaataagcaatgatttcttttgtagataaagcggtttttaggttttgaatggtattaagttgttgttcagacataaaatgttccaatctaaaaaatgaatgttaggtaagcgaataaaaatgctacctactatattttatttagttacagtagtccatagactttccaataagttccttattctttagtaaaaattttattttttaaaataatatttgccttatacagtgataaatgttgtaatgctgcccgttgaaattttcaaccatttttaggggctgacgtagattagccctaaatttcacaccattttctcaacgttttaagttgctcttttggtgttccaaagtgaaaccgaaattcacattctttcaagaataaagggaaactttttcggtcaatcccattatattttcggagtatccgcttggcttgattccaaaaattttcaatgtcgttgatgtgattttgtttcactgcaaacaattccgaatggttaatgcgttcgtggtgaaattcgcttacatcaagggcatcataactacgataagtatctgtataaacccagctatcaggcttgattttccttgctataacaggcattagcgttgttgtcttcgtatcattgacgaccacagtaaatacttttccttgccgtttcaatatccccaaaacagccacttttcctgctgctccacgacctcgttttcctttacgaggtccaccaaaatagctttcatccaactcaatttgtccgtcaaatacttcatctgcctcaagggctaaatgattactgatgacctcacggatttttcggtaaaacaggattgctgaattgggctgaataccgagtaaatctgcggctgatcgagcagttacttctaacataaaaaattcaagtagctttttctgtatagatttctttaatttacaatgagttatcttcatttttgtaggttagcatgctagctaatctacgtcagcctctaaatctttcatcaaaccacgtctaccatcacaggtaatcgattgaattatatagccttttttctcttaacctattcagggcaagtttgtagtaaatatctttttcggttcgcacaaaataatgggaaatgacattatttgaaagcgtatccattaacactaatacgccaaaataacgacagaaaaacgttgtatccataatgatattcaggtatcgatttgaaggcagttttaaagccgttttaagtgctttatcgatatatctttgaatagttctgactaaacaatgatatttaacggcaagttgttgataggtttgttttccggatgtgtaatcagtccaaatcttaattggatctaatttagtttttaagataaaggttttatgacattcattacaaaaataacgttgagtcttattttgtattccatgtttctttattttcagactttggcaaaatgggcagttttttgttcatatttcaaaaagaggcttaaagccttgtactataaggcgttaagccactttttagcaactatttgtctattacacctatttaattttcgcttaagttcactaaatgatccctctaaacgatttgccatcttttctatatttaattcagaatgttttgtctgttacatgaatttcctactctgccaacccctgatcccactctaatgcttcttcaggtaatttacgttgtaataaaaatctgcggttagcttctgcctgaggttgaacaaccttacttgatggggttgagaaactaattccgccgttaaataattgagacattgtgcctgagttgatactgacaccattgaggctaatatccattgtatagcctgacgaagcccagaactcgctatttttacggacaaggtgtttatattggttggctatgcgtaaatggatcagcactcggtcgccgagttcgcttaaactgagctgttgtaccatacccacttgcattcctcgatacattacaggggcttgaggggtgatgccatttgcgtctgtggtttccacaatgattgggaagccgttgccgtattgtgtatctgcggtgtccgttgcccctaatttgaactgtgtttttcgtttgccatttccggcttctacgctgatgtagttttgaataacggcatcaagatttttgaagcctgttgtgtcaatttcaggggaaacggcattaaatttgctacctgctttggcaacgatggcataatattgtccttcgatgtaagcggtggctttaacctgtttttttgcattgtctagctgtagcgtttcaacattgccgatggttaatcccatatacttaatcggcattcctttgcttaatttagaagcatcttgagcaatcaaggtgatataagtattaccagaagtcgctttcgtataactgctgtataaggttttgttacctttagttccttgattatcaaagctaatcgcccctttgagtgttcgcatgagtgaacccattttgagattaacaccgttggtagacacgtttacatctaccgcaggctcaacccaaaatcgactagtttccgtcagcagatggcgatatttaggttcaataaatagatcaacttcaaacttcgttttttgtgggcgaatattaagtacttcacctatcgggaagttgcgataaagcacttgtgagcctttatcaatgccggataattctgtagcagacaaactcagcgttgcctttttctcaccgcttacaataccagcttcagcactctcaagatctttgtataacggatattgttttttcgcttccccttgagctttatctgagagaatacgaataccgccagcaagccattcagatggagaagcagattgtactcttagaccatctaagccaacagcaatatctaagtgtgaaatcgccacaaatttgctgtttcctgcgacaagggtacgataaggcggatagatgatgccttgaaattctacgccgttaagcgataactggcgtttcacaatttcgccaatttgtatatcgttataataaatgccctgcccttcgcttacaccataagattgcggcgatgaaagggtaattgctaaaacgttaggacgagtgagcaaataatcagcttctttttgtacattaaacgtcagtttaggctcgccatcacccttttcaatttcaaagtaagcccctctcaatagctcacccactttactcaattgttctttattgagtgcaaatttaggttctttcaggagaatttgactgcctgagcgtaataaatccgtatgtgcagggtcgatcaataatttaccttgaatagtcgccttggttggtttggtttcaaagtaatcttgttcggtttcattcagttcgaggtgtgaaagtacgccaacttgcaggttttggaaatataccggcgtttcatttacttttaaattcggcattattggcaaggtgatattgacttccgttcctcgttgagccaattttaagttatcgaaaagttgaaaacgttcgccctgtttggcatttgttgccatctcaggcgagtcaaaagcaacagccccttgcaccattgaagcaaggctatctacattgagatttacgccagtaagattggcattaaattgaataccgctaatgttccaaaagcgactttcttttttgacgagattggcgtattttttatcaataactacgtcaatttcgacattcttttgatctggagtaaagcggtaatcggcaatgcttcccactggcacttttcgataatacacgcttgcccccacagtcattgagcctaaatctgaggcaactaatttcaccaataaatcgccatcagcaacagttaccgcaggcggttcatcttcagccacaaattcatcttcactagaggcatcttcatcatcattcggcaataaagtgatgtagttacctgaaacaagtgcatctaaccccgacaccccagctaaagaggcactcggtttgactagccagaactttgttccttcttttaataccgatttcgcttcgggattaacttccgcctccacctcaacctcttttaactcattgataaaatagactttttttacttgaccaatttgcaagccttgataacgaatagcggtttttcctgcagtaatcccatcgcctttactaaaacgaatggtaattttctgtccttgctcttgaagaatttggaaaaaaaagcaaacaaccaatcacaaaagcgacaattggcaataaccaaaatggcgaaattttacgaggctgtctaattttagcaggaatactgtttggcatattttcagacatcattttatcacttttaaatacaagcaagcggcgagattttgcaaaaggtttgcgaaatctcaccgctcttgtgtttattaactcattgaaaaagaagaattattttttgtctttctcatcacatttttgaatattgctacatttaccatacaaatataagctatggtttgcaagctcaattccgtgttgttggctgatttcacgctgacggcgttcaatttcagagtctttaaattcaaacactttaccacaatccatacagataatatggtcgtgttggtggttcatatttaattcatagacagctttattcgaatcaaaattatggcgagttaaaatgccaacttcttcaaattgatttaatacacgataaactgttgctaatccaatttcagactgacgttctagcaataatttataaatgtcctcagcagaaaaatgctgcatactatcacgggtgatttgcattaactcaaggattgttaaacgtggcccagtaacttttaaacctacttttttcaacaatttcatattttcttcagacatatatcctccaatagatatattaagctaattccgctaaatacatttcatcaaaaatttgtttacaccaacggtttacacgttcttcggtgagttctggctggcgatcttcatcaatacataaaccaacaaaggtttcatcatcaattaatgcttgtgaagcctcgaaagtataaccttccgtaggccagtgaccgacaattgtaccgccattaggttcaataacatcacgcacagttcccattgcatcacagaaatattctgcatagtcttcttggtcgccacaaccaaagatacccacgatttttcctgtaaaatcaatttcttttaatgtcggcataaaatcgtcccaatctgcttgagattcaccgtaataccacgttggaataccaattaataagaaatcgtaggcttcaatatcttccttcgtgctttttgcaatatcacgaatatccactagattttcacctagttgtttttgaatcattttagaaatgttttctgtgtttccagtatcactaccgtaaaataaaccgacaactgccatttgaaatacctatttacttaattcaatggaatctccattgagataatcgtttaaaatgagttcaattaactgccctctagacagcccttttaccgcagcttcttgttccaatgccgctaccaaatccgaatgcaatttaagctcaatccgtcttaatcctgacgaacgatctcgcctgagttgattacgtttattaattctaacttgttgctctccgcttagaggatttgtgcgaggtcgcccaacctttggcatattttcaaacagatcaagcgtaatacaatccgaatcttgctttgccattactacaatttttgggctgagtgcttcttactcagatgcgaatgagaagctaattatcaaagtgcgaactatagcacaatatagaattattggaaacgccctatcaaaatattcattataaattgagattacctaaaacataattagctattattctgctgccatataactaaataaaaaatgtaaactaattttagttagtcattacttaacctatgtcggtaataagccacaaccataattaccaatcccccgatgatcattggtaatgaaagcaactgccctcgtgtgattaaatccgctgccgtatttacatttggatcgaactctcggaagtattcaacgataaaacggaacaccccgtagccaactaagaacaagcctgccaccgagcctgtcggtcgaggcttacggatatagccattgaggataaagaacagcactaagccttctaaaaccgcttcgtaaagttgagaggggtgacgaggcaaataaccgccacttggaaacattatcgcccaaggcacatctgtcacacgtccccaaagttcatcattaataaagttaccaatacgtcctaatcctaaaccaaaaggaataagcggtgcgataaagtcagcggtttgccaaaagttgcgattttgacggcgagaggtccaaagcattgcgacaatcacaccaagtaaaccgccgtggaacgacattcccccttcccaaatacgaaataaatagagaggatcttgtaggaaacggtcaaagctataaaagaacacatcaccaattcttccccctagaacaacgccccagaagccattaaacagcagttgatcgacctgttcgacactccatactccattagaatttttcgcacgtttggtaccaagccaataggcaaaaccaaaaccaagcaggtacataatgccgtaccagtgcaaagaaactggacctagctgtaacgcaactggatcgatattaggaaaagttaaaaactgttcagacataaatttcctttattttaaaaacatattcacggcaatacacatcaagaaaacggcaaaagcacgttttaaaatcggcactggcaatttgttcgctgccgttgcccctaattttgaggtaaaaatagaggtcagcgtaatccccaccaacgcaggtaaatacacataaccgaccgcatattgtggcaaattaggattatcccaaccactaatcacaaagctaatggctccagctaatcctaacaaaccaccacaaaaagaagaagtgccaatcgcttttttcagctcaatccctctgctatttaaaaatggcacaataaaagcaccgcctgcaatgccagcaaaactggataacaccccgattacccctccagcaatcaacgtagattgagtagtcagaggcttaggctctgcttgctttggcttgagcgataaaaacatcttcagcgaaagatacaggatcatcaccgcaaagatttttgtcattacactttttggcagatcactcacaatcaagcctgaaataaacaccgccaccatcaacgcaggcacaaaaaacttcacaactgaccattgtacattgcctaacttatgatgacgttgtgccgctgaaaaagtggttagcacaatcgttgaaaacgacgtacccaatgcaatcgacatcaacaaatcatctggcacaccaatttgaggcaacaaatacacaagggttggaacaataatcataccgccaccgataccaaacaaccctgctaaaaaaccagcaactgagcctaaaatcaagcaacagacaaacatttccaccatcattttttccccttaaacacccgatatggtttacgaagctcacgttttggctgagtacgaaactcttttctctcgtggctaaattctttggtatctcgatttttctcgctttcgacttttttctgcttacccatcaacacctgagcaaactctttcatcaccttgcggtacacatcacgtttaaacgacaccacctgtcgcacaggataccaaaagctcacccaccgccagccgtcaaactctggcgttttactggttttaagattaatagccccctcgtctgccactaactgcaacagaaaccaacgctgtttttgaccaatacatacaggttgagtttgctcattacgaactaaccgttttggtaatttatatctcagccaatacttcgatgcccaaagcaatcgcacatcttttttcgctaagccgacttcttcataaagctcacggtacattgcttgttcaatgttttccccctcattaattcccccttgaggaaattgccaagagttttgaccaaaccgcttcgcccacagaacttgcccttgcttattacagataacgataccaacattcgggcggtaaccatcgaaatcgatcaatttagaccgccttatttaatcaatttgaaaatggtgtgattgtttcatatttcggctatttgaacaactggcaaggcaaaaacaagcggtgagatagccaaattttttcgcaaccgtggataactctgtggataacttgaaaatttgttgataacttttttgggataagttatctaaccgcttgatcttaattcagatcttacttcctgccatcgatcattttcgatcccttttcactgtataagcacacatttaatcgctcattttattttctttctaggataacttaaccacttttcagactaaattgccattctattcacatttgatgtgcttttatccccattccctgtggataaaattgtgatagatcgggataatgatcgtgtataacctaaaatcagcccagatattttgcttttttcctttaaaaaacaatatgttatttcattcttcttatcgaaaaaaacaagtgctcatttattaaacataatataaacattaacaactatcaaaatagtgaatttgtgggaaaatcatgtttaatgttagaatccagcccgtttttctaattgttctacaaaattttcgtttaaatttagcttctcggctaagtgggataaaaatacgatctcttttctagagagctcttgacagaccaagcgtgcagcaaggtaaacttgtgccgctaaagcggtgtcgtttccgacagtttttgcaatttcattcacggatactggctcgtgcatttcatgcagtaaccattgttgtaattcagggtcattaccgccctcttttaagattaaagcttcttcgttctcatccagctcaccgtctgctaatgcagctgcaagcattgtacgtaaaataattgctcccttctcttccgaactatccgcttcaaaagctgtttggcttagttctgtcgtttggcttgttgcctggttcttttgataatcttgataggctttgtaagccaatccaccaagtgcggctaaagagccgagcttagtcaaattagctccgccgtttctgcccaacaccattgatagaataccgactaatgccgcaccgccaccaactttggtaatagtatctacgttgccagatttgatctcaccggcagtatttttggcagaacccaatacagagcttaatacgttacctaagtccgatttactttgattagcggtgttgccgacagattttaaaacgccgtttaaaatgctattaaaattcatattgctttccttttggttaataaaaaatagttaagagtagacattatgttatcaaaataattcaatttttttctgcaataaatttctttgccaacgccgacagtgcatcggtcacatagactaacagcaaataacagagcagataaagggtaatttcagagtaatggaaaaaactcatcgccagtttaaactgcatacctaaaccacttgccccaacaaaaccgacaatcagcgttgcccgaataatgttttccatacgataaagaatgtaattgagaaaagtacgcatcacagcaggatagatcccgtaaaacaaaatttggttttgtgaagccccattttgcattaaatggcgtatcggtttttcatccatatcttcaaccacttcgccgcacagtttgcctaatacaccgaaattgtgaatggctaatgctaatgcacctggaatgatccctggtttgaagataaagactaaaatcatcgcccacatcaattccggtacggatcgactaaacagaaatagcccccgactgatataataagcgacacgatgataccagtatgttctgtggcgaaagtgtccctgtgccacgttgcgagcggacggcagaaccaaaaggaacatcgccatgcctgcaatgcctgttgccagaatactcatcacaaaggtttcccacgagagccatagggctttttgccacatttcagggtcaagataggcaggtagctcttcacccacaccagccattccaactaaaaattccgtaagataatcccaattttccgctcgaaacagttcactaagtgcagtgggttgatctttaagaatatagccccacgacagcccgataagtcctaatactatccaaaaagaatagcggataaaatagcggtcgatatgttttctcattttactcggctcctgacagcatagctccagcggtcaaccaaaacgattaacccaacaagaaagatcaagaatgtccaaacctgatcgtatttcagatcttgtagggaaagctgaatttgcataccgatccctcctaacccaacaaaagaaagtaccgatgaagagcggatcgcacattcaaggcgatacatggtatagctcaacatcgtcggcaaggcttggggcaaatagccataaatcagacattgtaacggcgttgcccctgcttcttttagtgcaaaaatcggcttagaaggcaccgcttgtaacgtatctgcatagattttgcctaagtagccagaataaggaatagcaagggcaaacactgcacctatcggatttaacccgacagccgcaacaaagaaccatgcccaaatcaattcgtgaatagcacgtagaaaacccaatatcgctcgagctgccccctgcaaaatgagtgaacgaaacagcacaccggatgcaaaggtgcttaagcaaaatccgccaagcatagacaaagagagtgtaatcaaggcataagcaaaagtgagccaagtggattgcaaggcgagtttcagtaaatcagtagaaaagtcaggggacaataaactggaaaatagtcgattaagcgttgcccaaccaccagaatgcatcaaccctttgtcgttatcgacggcaaataggctcaacaaaaatgcaagcaacaacatgcccgtcagcaaatttcgccgttcatttagtccaagcggtcggttatgtttcattttttaccaatccgtataagacattgaattgctcttgagtgacttgttctgtttgcaaatcaaacacaatttttccctgtttaatgccgatcatacgatcaaaataggctttggcatattccaccgaatgcatactggcaatcaatgttttcccctgctctctcaccagcccagtcaataatgccaagacattttgtgcattaacaggatcgagtgcggacactggttcatcagctaaaatcaatttagggttttgtactaacagacgagctattgcaacacgctgctgctcaccacctgacagctcggcagttggctgatcgattttatccaatagcccaacggcagcaagtgcttgctcggcaagatgtctttcttgcggtttaaccaaagagaacaaggattgccaaaatccccactggttcagcctgccagccaagacattgtggataacttccagttgtttgactaaatcatactgttgatgaagcataccgacttgttgagcaaactgtttgttatctgggtaatcttgaatattgcaattttccagccaaatctcaccgcttgttaaaggcacggaacgcataatgctattcattaatgtcgatttccccgaaccgctcggcccaactaatgccacgatttcacctgaatgaatggttaaacagatgtcgtctaaaacggcttgcttgccgaaatgtttggtggtgtggtggaatgataagagagattgcataatggaattattgtctatattgcttacaggtcaatattgtagggtgggtcttgacccaccacatgaatgcgattttaaatggtgggtcaagacccaccctacaaaataacattatttaatcaacttcagctctttcgccactttctcaatatcttgatagttgctgttttgcgttgggataaacttctcggcagagagtaaattcatcacctgcgagcttgacgcatcggcttttaataatgcagctttgactttctctttggtaccgtcaccaaattttttatcaacaagattaatggtccagttgtaatcatagtaatccggtgtagtgtagaaaagctcgactttatcgtgattaaccttgccttcttttgccattttatcccagtactgcttattcactgcaccgatttgtactgaacctgcttctactaagccgtaggttttatcgtgcgaaccactgtaagtcggttgagcgtctaagtctttttcagggttaattccagcttccgttaagaaaaagcgaggcattaaatgacctgatgtcgaactttcgctaccaaaagcaagggtgtgacctttaacatctttaatctctttcacattatctaagcctttttgcttgataaagacggacttaaatttctcatcttgcggacgttgtgcgatagcttcagcaccttgtactttggcacgagcttgtacccccgttaaaccaccgaaccagactaaatcaatttcaccacgacggaatgcggtgactacggcagcataatcggtgacaggcacatattgcacctttaaccctgtttctttgcctaaatactcagcaaaactgtcgaatgaacgggtcatttcggcagcgttatagtcaggaatagcactgattttaaaggttttatcggaaggtgatgcgatagcaactgagctaaacagcacgctgagagcggtgaaagcagttgcaaaacttgcaaaaagcggtttcatggtgttctccaaaagaaatgtaaataaattgtaatgttcaaaatgaacgtgcaaaagatacgctattttttataaaaaacaagagatttctgcaacagatagaaattatagaaaaagttggcaaatggcgacagtttctctataatccgcagagttatactttgtataattttaaaggaacctatatgcaagtggctgtcaaaaaatggggaaatagcgtaggcattcgcattcctgctttattatctaattcattgaaattacaggcagagagtttagtcgatattcaagaagttgatggtcgcctaattattgagccgattaaacctaaatataatttagagcaacttctttcaggtattactgaagataatttgcacaatgaagtcgattttggcaagcctgttggcaaggaaatgctatgactactcaagagtatatccctgacgttggtgatattatttggcttgattttgatccgcaagcaggacatgaacaagctggccatcgtccagcattagtgttaacgcccacgatttataatcgtcaaacagggttgttaatttgctgcccgctcacaacaaaagtaaaaggctatcctttcgaagtcaatattgcaggtaccccccaaaatgttgtgctttccgatcaaattaaaagccttgactggcgtattcgtcacgctaaatttaaaggtaaaattaaccatcatcagttaagcgaagtaaaagctaaaattgcgactttgctacaaatcagtgaataatttctatggcattaatcgaatacaatccccctgttgaaccttggcttgacgaagtttattgtgataatcatattttagtgattaataaaccaagtggcttactttctgttcctggaaatcgccctgaatatcaagacagtgcgatggtgcgtgtacaacagaaatatggttttactgagcctgctcaccgtttagatatggcgacaagcggtattttgttgtttgcattaagcaaacaggcggaaaaagaactcaaacgtcaatttcgtgaacgtgagccgaaaaagcactatcaagcgttagtttggggcaaattaggcgaaaaagttggcgatacggggacaatgaattttccgttaatttgcgactgggaaaatcgtccacgccaaaaaatttgctacgaacggggcaaacaagcggttactttctatgaaattcttgcacattatcccaataacaccacaagggtgacattaaccccttatactgggcgttcacaccaattacgcgtacactgtttagccttaggtcatccaattgtaggggataaattttatgcaaatccgttggcaaaaagtctatcgccaaggctctgtttacacgcagaagcattaaccattacgcacccagttacgcaagaactgatgacatttgaagcgaaacctgaattttaaaaggtagatagaatgaactttcaatggcagaaatatcctgaaaatacgcaaaaattattcaaactttcgatcccgattttcatctctcaattagctgcttcgggaatgggactggcggatattattatggctgggttagtcagcgatgatgatgtgtcggcgatagcggtcagtaattcgatctactttcccttgtttttatttgtgttggggatattaaatgcgattactccaacggtttcttatctaaacggttcgagccaacgttccttgattgcacatcaaatccgtcaaggcgtttggattgtgttgatgctcagcctgccgttaatttttatctatctcaatgcccatttgattttagatctgatggataccccaaaagtcttttcaggaaaagcacaagattatcttaccgctttaagtgtcgggattattccagccttgcttgcggtgaacttacgctgttttaacgacggactatccaaccctaaaccagcgatgtacatcacctttttgggcttaattttaaatattccactcaactatatttttattttcggcaaactgggtatgcctgaattaggggcggtcggttgtggtgtggcaacggcaatcgtaaactgggtaatgtttgggctgattttacactattgttataccaacccagcacaaaaggatattcgtctatttgaaaaatggatcgaaaaaccctgtaaagcaaccttaagcaaactgttcaaacttggtacaccgatagggtttgcactgtttaccgaagtgatgctgtttgcggcatcttccttgattatctcaccgcttggctcacaagtggtggcaagccatcaggttgccttacaaaccagctcgctcttttttatgatcccactctcatttagcattgccacaaccattttagttgggcaaacgttgggagaaaagcgtgttgcagaaacaaaatatctgacttatcacgccatttttacgggtgcaatggtcgcaatgggactggcaatggtgattttactgctcaaagatctgatcccctatgcctttaccagcgatccgacttctattgcaatcgcatctagtttattgatttttgcagcgatctatcaaatccccgactctatccaagcggtatgcaatggcattttgcgtggttataaaaataccaaacctattttgctgacaaccttaatttgctactggttaatcggaatgccactaggcactattttggctcgcaccgattggatcgttcagccgatggcggcaacaggattttggctgacattctgtgtctgcttaagtttagccgcagggctatttttctactttatgcggaaaattcaggctatgccagaagagattttaattaaaaaactagagtctattaaatagcacttaaagttatgtctatcctttattgtaccagatagggatagacacaactttactcatgtcattttatattaggtattcatatatagctgaattatccagcttatctctttatcatttatccgatacccctctttcaaattcggcccacaagagttcgaaccaataccactcattttataatcgacacacagaatgtgatacggcgatttttctagctcgtaatgatgttttttcagggtcaattcttcctgtgtataaggggaaaaattgaagctgaacggctgtggtgcggtaatctcgagatcttgggtgtgaagatattcacaaccgtagtgactgccgttttcctgtggtttgacgtagtcttgatgattttgctcggcagtggtttggtatagacctagtcggcttgcgtggtgtttgtcgatgtaactttcactctcgccatagccgaaatgtcctgatccatcaggaagatatggggcgtggtcgcaccattcccagataaaaccaccgcaagcccctgcatatttttcaaaggtttggaaataatcttctaaatcaccgttagagttccccattgcgtgcgagtattcgcagagtaggaatggtttggtttgtggctgttcaaaatagcgatccatatcttctgtgctggcatacatttcgctatgaaaatctaacggggtaagatcattgcgatgttcagaatgttgataaatggtactttcataatgaaccagacggcttggatctcgctgtttgatccattttgcactggcttcaaaattttccccgtaacctgcttcattacccagcgaccagatcagtaccgatgggcgatttttatctcgttctacattagcgtaggtacggtctaagattgcttgtttgtagtctgggtgtcgggcaaaatagcagaaattatctatcgtttgttgctgaatacgttggttatcatcttgttttgctacattcagtaaaatgctgtgttctggcgttggaacgtattgcatactggcaccgtggctttctatgtcactttcgctaatcaggtagaagccgtagcagtcgcataattcgctaaaccaaggggcattcgggtagtgggcggtacgaatagcgttgatgttatgttgtttcatcagcctaaaatcctgttctgcttgctcacggctgataacataacccgttaggggatcgctgtcgtggcggtttactccgcggaatttgatcgggtggttgttgagcaagagtacaccgtctttgacttcgatccgacgaaaaccgaccgcttgttcaatcacttcgtttccataggcaaggtgtaaggtgtaaagttgtggctgttcggcattccagagctgtggtttgtcaatttttaccttaaagtgatcgcttgtctgttcggcgattaggcgatgttgtggatcaaacagttggaaagtgagctgttgtggcgattgcagaaaggtacattcgaccgataaatccgcttgatctaatgcttcagacaggctggttttgataaagaaatcttgtagataatttggttcacgttccagcagataaacatctcggaaaatccctgacatacggaatttgtcctgatcttccaaatagctaccatcacaccatttaagcaccacgacattgagctgattttccccagagattaaaaagtcggtgacatcaaattcgtttgtgcaatgactgacctgcccatagccaacaaattgttgattgagatagagataaaggcaagcgtccaccccttcaaaattcagtaaatagcgttttgtcgatttaggctcgtagtggaatgtccgttgatatacaccgcaaggattgtcgtgtggcacataaggcggttcgaaagggaataggtagttgatatttgtatattgatgttgttcgaagccttgtgtctgccagtttgatggcacaggaatgcgatgctcaaaaggctgagaaagaaaatcttcaggcaaatccatcacgctcgtaaaatagttaaattgccattcaccattgagtagggtaaataggctagattgttcacgctcaaggggggcgagcttatcttgtgtcgcaaagggaataaaataggcgtgatggggtgtggtgttaatgtgaaataaagtgggatcttggtgataatttggtaacggcataacatcaattccattgctaagaaatggcaaaatgctatgagcctctcccacaatttgtgtaaataactgtttctgagataatacattcagacacaggtattttattatgaacgaaaaacaacttcacgccttggcagcggaatttgccaaaaacctaaaaacaccagaagacctcaatcaattttcacggatgctcaagaaaatcaccgtcgaggctgcgttaaatggtgaactgaccgaccatcttggttatgaaaaacatcagcctagaaaaggtaaaaatgcacgtaacggttacacatctaagaccgtcatttgtgatgaaggtgagatagaaattgagacgcctcgtgaccgtgattggattgctgaaaatgaaggtgcgaagttctgggcaaatgtgctgacagagcttcaaaatcgaggcttaaaagacatttttattgcctgtgtagacggtttaaaaggcttcccagaagccatcaatgcagtctatcctaaaacgaagattcagctttgcattgtgcatttagtgcgtaacagctttgaaattcgtttcgtggaaagattacaaagccgtcaccgcagatttaaagcaggtttatcaggcctcgacggaagcacaggctcgcgaaaatctgaccgcactttcgcaaaaatggcaggcaaaatacccgcttgtggcgaaaggctgggaagataactgggcaaatattgccacattttttgattatccggctgacattcgtaaagcgatttataccacgaatgccgtggaatcgcttaatagcgtgattcgtcgcgtgattaaaaaacgaaatgtattcccgacggatgattcagttttcaaagtgatttggcttgcgattaaagatgcatcaaaaaaatggacaatgccgattcagaactggaaactggcgatgaatcgatttatgattgattttggtgatcgcctagacgatcaccattaagttgaaatgggtgtttacacagaatttgggatagggtcaatgctatcactcgcaatccctgacttcaatccattgcaatgtaacattttagaaatgtgatgaagctcacaattatttttatgttcatttctaaagttatagtttacaaccacattttaccaattcttaaactcatatatacaactgctttcaatacaaaaaaccattaatttcttaatatttggtgatcacaatctcaccgcttgcaaagctgactttaagtgtattactgcgacattctaccttaaatatctgttcattttggcggatttcgttttcacagggcttccctgccattagtaacgcaatctgattttcggcaatttgtagggcttgctgttgctgaaaaataagcgcgctttgcttattttgcgtatgttgccaacggctataagctaaatatatcactgaaaaaatcaacataacgaccattaatgatgtcaggctttctgctttaatgagcttattcatttgctaatatattccgtgaataaggcaaatagtgccaagatgaaaatttattttccagatgttgaataacttcttttttataactgagatttctttcttctcgtaaattatcataggtggaataaagtgtaccatacattctttttcttcctgtaagatcaaataaataatcggtaatgacaataccgtaaaaatctttttctaacttttcattaatatcttgtaatgcaatcacaatttttggattctctagactactttctggcaactccgctaaatgattgattttatatatttccgattgataaggtaataaattcaaccagttttcaattttatccacttgaatatatttttctttggttggtttaaaaggatcaaaaatagatgaaaattgacaatgaaaactgtatttcattaccttaaactcaaaaataacattagtctgtttctgattttggcattctatttcaggatctattgctaacttttcaataagttgatatttatcggtaagatattgctgataatagaataggctcactttttcttgttttaataagctatctttattgagaaaaatgactgcaaacagaccgcttaataatatcaaggtaattaataaaatactggctggataataacgtttcatttatcacttccatttaataggtaactataagcggtagctttatatcttagttggttatctttgctagacgagagagccagttctattttcaataatctattctgctcaagccactcaaaagataaattttcgacattataatcagacatatctgacatttttcgccagttgcctttttgacaatttgttaggattttttcacaatctgcttggtgacagaactgaatttgactatcttcataaataaaaatcgcttttttctcaaatttaaaaccaaaaaattctcggcttacctctttggtattatttacaccatttatttcgcaagattgttttttatttcgattacctacacagccatcactacttaaatcatagaaaaacattagacaatttggattgttcagtgaataacgcttattatcgtttacaaataaactataattggtttcttttctattttgtccttgataattaaaatgttgaatatgttgttgaaaatactcaagtaattggtgagtatgcttttgtaaattcaataattcccgttgtttgatttgattgcgatagctatcactataaaaagaagataaactccataaaataatgcaacctaaaaataaagataataatatttcaaccaaactaaaggcgtgattaacaactggtacgtttgcctttttgaataacattaatcactccattttgttctacttgtaagatttcatagattttatttaccgtaacccttaagcactttgactctaatcgcccagactttccatcaacattaataaaaactttgggatataaactattatttttaactacggcattttctgtttgatagagataataacttttttgaatatcacaacttgcgatattcaaacagttacaagcgatctgtttatcactgactttttcaatggcgaccatacaccattttttatctgctacattttggctgatagaaatagaataattctgtttttgatagcgtgctttagcttgaatttgataaataaaagattttatctgatcgatttcattatttaaaacgatatgatcttgtaaataaaataaggtgggggaaaagaaatagagtgcgattgccattatgctcatcgcaaatagagtttcaataatagtgatcgcacgaaacataatatctctcccaaagtgagagagatattagatgttgaaaggattttgtaaataggcaatttttattttttcgacatagatcgaaaaattagaaagatgttgtatcttggaatagacctacttttaagtctgtggcagtatagataattctgccatcaacttcgacttcgccatcagcaagccccatcacgagcttacggttgatcacacgtttcatattgatacgataaatcacttttttggcagtcggtagaatttgccctgtaaatttcacttcgccaacccctaaggctctgcccttgcctttaccgccgacccagcctaagtaaaagccaaccagttgccacattgcgtctaagcctaagcaacccggcattacaggatcgccgataaagtgacagccaaagaaaggcagatcttggttaatatctaattccgcttcaatataccctttctcaaacagaccttctttgtcggtgattttggtaattctgtccatcatcaacatcgacggtgctggcagttgtggaccttcgctaccaaaaagttcgcctcgtcctgacgctaaaagatcgttgtaatcataacttggtttgatgttaggtgtacaagtgttcattattttgttcctgtaataaagtagaaaagtccgttattgacggtttatgttacgtttgcttgataaagacatcttaacagacttttaaaatagctaacagttgtaagctgacttgtcggatcagtgcccctttaacagtttgcgaattttttggaaaatcgaaccgcttgtatcttcattttcgctctgttcgatcccttgatgaactaacgcaaaaatggattttttctcactgttttcaggcagatcttcatcataaaacgggtgttgcaacagaatttgtaaggcttcaaagacatcttcgaccgcccaaatatgaaattttcctgcttcaatcgccgataataccgctggttttaagctcaaatgggaaacgcatatcgccggaataataaccccttgtttccccgttaattcccttgcttcacaaacattgaagaagccttcaattttctgattaacgccccctacgcttaatacattcccaaattggtcaatcgcccctgtcaccgcaagggattgtggcaacggcaacttggttaaggcactgataagcacgcagaaaatggctaacgatgaactatccccatcaatttcaccataagattgctcaaaggcaacggacgctgaaaacggaagctgtgtcggtaattccagtaaatttgccaagcaagattgagcgataataatccctttagagtgaatattgccccccagctccactttgcgttcaatatcgtgaatttctccatcaccatattgcacgttacagctaatgcgtaatggctcaccaaaactatggggaacaccatcaaactcgaccacagataagccgttaatttgcccgatggtttcttcttccgtttcaatataaagctgatgatttaaaatatcatttaaaacaaatttatttaatacaccagattgtttttctaaataatcaaaataatcttgaatatggttaaattgggtttgttttggataaaaatgttgtaatcctaataaatgtttttttaataatgtcggtgaaatagaaattaatgtttggttttcactttcacgaatataataatgtaaaagctgatttaaacctgttttagaaaaggttctatttagatattttttagctgaagattgaatatagcttccccattgttcgctattttcttcatcaatattcaaatacgactcgatttcagcatattggcaaaattgatataaatcttcatcataattatgtaacgttgcaatatcatctcgactacctactaatatcaatttgaattgagattgaataggcataattgcttcaggtaatttacctgcaataataggatcaaactgcccaaataacagagcttgttttaatttatcccattgtacaatatctaataataatgcactcacatttaaaataagaataccctgatgagcttgctcaatcgcccctgccaccgttttaatctgattttctttttctaaataaagactatatccaaataaactttggcgattaaattctgtttttagcaccgtttggcaatgtaaattttcaaaatagtccgtgatttcatttaaaaattcgggaaataattccgttttcaaaatgagtgccgaaccaaattcactcagggcaaattgttgcattgcctgctgtgtatttggttgaaaatccaaaaatctcaccgcttgatcggtctgtttaaaaggatagtgaacgcttaatgattgcaacgataatggggatacttgcacaaatttgcctctttatagaaatttgcttcattatacctataattacgctatacttcacaaataattcggaggtaaaatgcgataccaaaaacttgaaattcaagaagcaagttggaaatggaaatacttgctgaaaaaatatcgtgaaggcgaaaatatcaccaaatacgacgaacagagcttgatcgaattgaaagttcaactattaaccaccttacaaaactcgcccgaagagatcgagcaatggattaaggcggaaatgacatctgagcaacgcaagaaaatgcgtcaatctattcgagcaagacgcaagcgttttttcaatgccgaaaagcaatctacccgtaaaaaatctatcgatttagaatacgccagctggcaacgcctgtccaagcaagccaaagaaatggatctgaccttgtctgaaaccattcattatttgattgatgaattagagaagaaacagatttatgcagagcaagtggataagatgaaagcaaatttgaaggcgttgttgggatagcgtcatttaaaacatagggagtaacaggcaaaatggcccctaaaaagtagccttaaattgtgctttgtgtaattacttccctttcacctcaataatcatcacttccgattgtgaacctaaacgcatcggaatcccccaaaatccgtatcccgaagtgacaaaaaaatgtccattgccgattttttcataaccgtgagcaagtcggtaaataaagtgagtaatgatattcgctgggaaaatttgcccattatgggtatgtcccgacacttgaatatcaataggcagttgagcgtgttgctcaatttgtgttgggcggtgatccattaggaatacaggtaaatttgtatccacctgatccaataactctgctgtttcagggcgatttttcactaattcatcattacgcccaataatggtaaattttccgtctaaggtgaccgcttgatcccatagcaccgtaataccagctttagtgatttcttgatagatttcagcttcagccccaaaaagatcgtggtttcccattgtggcatataccccaagcggtgcttttagctttgccaaatgcggttgcatattttcagcaagataggcttcgacattatcgtccataatgtcacctggaagtaaaattaaatccacttgttcttgattaaagatagttgctaacttatctagctgtttaccgccaaaaaatttccctaagtggaaatcgcttgcaacaccaattttgagtggctgtatgggtttatctaatgtgacttgatagtgaaccactttgggtgaataggcattgtaaatggtcagtccaattaaccctaataaaacaggtacatagcttattttaagccagcgattaaggttatttggcgagaatatctgtttgccgacagtataaattcccccaaaacagaagctgataaaaaagataaatagaagtaatgtgagtattaaagcaattaagcggaagtttggcaaaatgcgtgtaacgtgcaatatcatcaatagatttgctgcgatatagacagaaaatgtgatgatcttgcgacttttatttgataaatcgcatagcaaagttactgttttagaaaaactaaagagcagaaattgaagtgcgataactgaaacggcggtgataatgtaatagcgatattccatatttattctttccaagaaaaaaagcccaaccaaaacggctgggcttaaagtatagcaaatacaagtgtaaggagaaaataggtctttaattagcttattttgctaatttttgacgaatcgcatttgctaattccgggctaactttttcaaagtgagccatttgtctttctacgatttcagggatagtcacacctgataaacctgcagcaaagttacctgctaagcgatctttttcttccgctgtgaacaagttgtaaagtgctgctggttgtgagtagtaatcttcatcgtactcacggaagttaaagtgtgcagcttcacgctcaatttgtaatggtaattgatcgtgggttggcacataagtatcaaaacggttcggagcgtagttagggtggttaccaccgtttgcatctacacgcattgcaccatcacggtgagtcgtgtggtatgggcattttggtgcatttacagggatttggtggtggtttacacctaaacggtaacgctgtgcatcttggtaagagaacagacgaccttgtaacatacggtctggtgagaagccgattcccggaacgatgttagatggtgcaaacgctgcttgctctacttctgcgaagtagttttgtggattgcggtttaactctaatacacccacttcgatcacagggtaatctgcgtgtggccatactttagttaagtcaaaggcatagttatgtttgtgagcatctgcttctggcataatctgcacttgaacagtccaacgtgggaattcaccacgctcaatcgcttcatataaatctttttggctagattcacgatcttcacctacaactttagccgcttcttcgttagtgaagaatttgtgaccttgttgtgttttgaagtggaatttcacccagaaacgctcgttgtttgcgtttacaaagctataagtgtggctaccgtaaccgttcatatgacgtaaagtcgcaggaataccacgatctgagaacaatgtcataatttggtgcattgattcagggtgacgtgaccagaaatcccacgctgcattcgcgtcacgcaagttagtttgtggattacgtttttgtgtatggataaaatccgggaattttaatggatcacggataaaaaatacgggtgtattgttacccactaagtcccagttaccttgttctgtatagaattttaatgaaaaaccacgcacgtcacgctctgcatcggcagccccacgctcaccagcaacagttgagaaacgtaataatacttcagtttgcgctcccggtttaaatactgcagcttttgtgtatttggtaatatctgcagtgacagtgaatgtaccgtaagctgctgaacctttagcgtgaaccacacgctcaggaatacgctcacgagcaaagtgtgctaatttctcttgaaaccatacatcttgtaaaagaagtggaccacgtgggccagcagacattgtgttgtcattatcaacaacaggggcgcctgctgctgttgttaaggtttttgatccgtgatcaaatggacatttatacatagtgaatttcctccaaaaatagcttattaataggttacgagtattatcattgatagttataagtttgtaaaactattgaattaataaaaaaatactattaattttcaacgccaatctttatttggtttatttataaatccgcctcatcaccacgatcttgtaaccattgtttgcgatcttcagcccgttttttagcaagcaacatatccattaattcaaaggttgaaacctcttcatcatcgctattatcttctaaggttagctgaactagacgtcgtgtatttggatccattgtcgtttcacgcaattgacttgggttcatctcacctaaacctttaaagcgttgaacatttggttttccttttttctttgcaagacgagctaaaatagcctctttttcagattcatctaatgcgtaatgcacctcatctttaccaatatcaatacggtaaagtggcggcattgcaacataaacgtggccattttttactaatgttgggaaatggcggaggaacaaagcacacaataatgtggcaatgtgcaaaccatctgaatccgcatcagcaagaatacaaactttaccgtaacgtagttggcttatatcttcattgtcaggatcaatgcccaatgcgacagcaatgtcgtgcacttctgtagacgcgagaacttgatcaggtgatacttcccaagtgttgagaatcttacctctaagcggcaaaatcgcttgaaactctttatctctcgcttgttttgcagaaccgcccgcagaatctccctctacaaggaatagctcagtacgcgttaaatcttgtgaaatacaatctgccaattttccaggtaaggcagggccactaaccaatttttttcgtacgacttttttttcggctctaaggcgattttgtgcagaactgattgccatttcagccagttgttcagcaacctgtacgttttgatttagccataaactaaaagcatcttttacactattttcaacataactcgccgcttgtcgtgatgataaacgctctttggtttgccctgcaaactgtggttcttgcattttaagtgatagcacatagcaacaacgcccccaaacatcgtcggcagttaatttgacacctttaggcaacagatttctaaaatcacaaaattcagccattgccttaaataaaccttggcgcaaaccattgacgtgtgtgccgccaagtgcagttggaatcaagtttacatagctttcattaatctgctcgccaccctctgtgagccagcttaatgcccaactcacagcttcagtttccccaatcacttcaccaacaaaaagaggatttggcagatattcatattctttcaatgcatctgttaaataatcacgcaagccatcttcgtagtaccacgtttcttgggtattattgatatggtcggtaaaattgatcgttaatttcggacaaagtaccgctttggctcgcaatagatgacgtaggcgactaaccgaaaacttcggcgaatcaaaatattttggatttggataaaagcgaaccgttgtgcctgtttggcgttttggacaagaaccgatcactttcagctcttccactttaacgccatttgcaaaagcaatggtataaatctcgccattacgtttaatggtgatctcaacactttcagaaagggcatttacaaccgaaatccctacaccgtgcaaaccgcctgaaaaggtgtaatttttattagagaacttaccgcctgcgtgcagttttgttaggataagttccacccctgaaattttttcagtcgagtgaatatccacaggcataccccgtccattatcaacgacttcaagggaattatcgctatgtaagataacatcaatttgattagcaaaacctgataacgcttcatcgacactgttatcaattacttcttgccctaagtgatttggacgagtggtatcagtgtacatacctgggcgaagttgcacaggttcaagatctttgagaacggtaatttcatcagcaccgtagcgtttttctgacataagtatctctttacagcctataggaaaacagagaaatcactctagtaaggttgagcgattagattcaatgaaaagattctttatattgattaaatgaaagaagatctatatggaaaatcaatcacgaaaattattaaattgaagaggctgccctaattcagcatttttcacaagctgtattgtcgattgtaaatcatcacgggattttcctgttatgcgtatggaatctccttgaatttgagcttgtaccttgattttagagcctttaataagtttaacaagctgcttagccatatcggacttaatcccttgttttaatttaatttcttttgtgtaaagtttaccatgatgttcactttcagaaggaatatctagggaagtatgttgaataccacgtttaatacagcatcctattaaaatttcaattaactgttcaagttgaaaatcagattctgtagtaacccgtataagttcatttttttcattaagttctattgtggcatcaactcctcgaaaatcataacgtgtacttaataccctatttgcattttctactgcattgcgtacttcatgtatggtaagttcagaaacaatatcaaaagatgacatcttattctccttctatgaaatcaaatcagagttttttcgcaattctaccatagcattccacaaactatgaaattaattcttataagatttcttgatgtattttattagattgaagaattgttgacgtccaagtctttaaagacgacggctccaactagctccgattgattgttataggctaccctcggtgagctctttctgctgaacgcttattatcaagtaatcacaaacttaacaagattgaaataacttacgctatttgtaccttatatctccgcccgaaagggtaagttttatggcacatagctgataaaagccaaaagccacctcaatttctcaaggtggctatattcaataaatcaacgcaaattacgcttgacctttcacttctttacgaccgttgaaaggtgctggtgtacctgctgcagctaatgcttcttcgatacggattaattggttgtatttcgcaacacggtctgaacggctcattgaacccgttttgatttgacctgctgctgtacccaccgctaaatcagcgatagttgcatcttcagtttcgccagaacggtgtgagataaccgctgtgtaacctgcatctttagccattttgattgctgctaacgtttcagttaatgaaccgatttggttgaatttgattaagattgagtttgcgataccattttcgataccacggcttaagatcttagtattggttacgaataagtcgtcacctactaattgaactttgtcacctaatactttagtttggtacgcaaaaccttcccagtctgactcatcttgaccatcttcgatagacacgattgggtactctttgcataagccttctaagtagtgagtaaattcttgagaagtgaatgatttaccttcacctttcatttcgtataaaccgttgtctttgttgtagaactcagaagacgcacagtccatcgctaaagtgacatctttacctaaaacatagcctgctttttctactgcttctttgatacacgctaaagcgtctgcgttagaagcaaggtttggtgcgaaaccaccctcgtcacccacagcagtatttaagcctttcgcttttaatactttagcaaggttgtggaatacttcagcaccgatacgaagtgcttcttttaatgttgatgcacccactggttggatcataaactcttggatatcaacgttgttgtctgcgtgctcaccaccgttgatgatgttcatcattggtaatggcatagagtacacgcctggagtaccgttaagctctgcaatgtgagcataaagtggtaaaccttttgatgctgcagctgcttttgcgtttgctaaagaaaccgctaaaattgcgtttgcaccaaatttagatttgttatctgtaccatctaagtcgatcataatttggtcgatttcagcttggttagatgcatctttacctacgattgcattagcaatttcgttgtttactgcagaaacagcttttaatacacctttgcctaagaaacgtgctttgtcgccatcacgcaattctaatgcttcgcgtgaacctgttgatgcacctgatggcgctgctgctaaaccaacaaaaccaccttcaaggtgaacttctgcttcaacagttgggttaccacgtgagtcaatgatttcacgaccaattactttaacgatttttgccattgttaatatcctctatgagagttaatagttaatgttgaaaagacttgcatatggtaatgggattttacaaatttgtcttgtaaaaaagtgatgagcttcacaaaaatttaaaggatatttgatcgaaaagggatttttctaaattaagaccaattatatattcgagtattaaataccgatatagacttttttctatcatcattaatatggactaagctatataacatctaatctacttttacgatcactggcacaaattcttccttacgtaagaaattttgttctctaaagttaatcggaaaatggcaggcaaattcgtgttggcggaatttgcgtagcggtggtttaacgacacattttttctgcgcaaaagggcaacgaggtccaagacggcaaccaataggcatatcttgtaacattggagctgagcctttaagggtattcaagcgacctttaaaaggcaaaggtttagaaaaatcgggtacgctatgcagtagtactgcggtataagggtgataaggggtttccataatggtttctttctctgcaatttcaacggtttgcccgcagtacaaaacgttaaatgaatctacccacttgtaaatactgagcatatcgttactcactagaataatagacgtaccaagatttttgttcatactggaaagcaagcgataaatttgtagctgtgtagttgattccattgtattggttggttcgtcagccacgagcaagcgaggctgatttgccaccgccattgcaatcatcactttctgtgcttcaccttcggtaatgtccgttggatagctttgcataatgtctttatgatcttttattcccactttatgcagcaattcaatggcttttttctttttccaaccaaaacgttcccaccacttgcctttaaagcggatagtttcgattaattgtttaccaatacgttcgcttgggtctaagcaagagagtggatcttggaaaatcattgaaatctgatcactaaccagttttcggcgctgatagggggaaagtttcagtaattcaatatcgttaaagcgaaagcggtcggcagtaatgatccactcgtctttgactaatccgcagatcactttagcaattaaactttttcctgaccctgattcgccaactaaaccacatatctcaccgctatcaagggtaagattgatattatctaccatttttatacgcccgtttggcgtatcaatttcgatacttaaatgtctaatatccagtaatgccattgtttcccttccctaataacgatatttttcaagcacccgtacaatgctgtttccaagcattgtaatgataagtagagtaaaaatgatagcaaatccaggaagaatgaccgtccaaggggcaacataaattaattcaagagaatcgcggatcatcgctccccattctggcgttgggctcgttgcccccagtgaaataaagctcaatgcactgatgtctaacacagcaataacaaaaatatgcgcaagttctttgacggcaatcacagttaaattaggtaagatcacttcacggattaaatctcgttttcttgcaccctctaattttaaagtgatgacatattctctcgccagctcccgttgggtcgtttgataaattttatggataaagtgaggcaacatagcaagaaaaatggccaacattgcattaatgagcgagacctccattaaagttgcaatgatgatggcaatcagcaaaatcggcgtaaataaaaaggtatcaaaaagatgactgagaataaaaatagatccactccgttttgtccctgcaatcacgccaagaatgccacctaaaataccgatagcaatagtaatgaccaatgctgagccaacggtatagtagaagccgtagaggacgcgactgaaaatatctcttcctagatcgtctgtgccaaaaaaatggctaatctgaccgctatcactccacgatggtggcattaattccattccgctaaattgccgatcggctgcataaggggcaagtaaatagccaaaaaaaaccaatcccatcagaagaataaagagattaaggctgatgagtgcaaaggtgtctttcctcaactctatccaaaattggcgtaaatacgcagattctcgaaactgttcggggtcttgtgcgagtagcattctttattacctttttactaatactgaatataacaataacatcttttactcttaattcattgtttgatagacagtatagcattctattcttgttctaacatcgccaacaaatgttgtttcaacatcgcctgttcttcctccgccaaagccccattttgctgattgctcaccacaaaaaaatcctccacccgttcaccaatggtcgtaattttagcgttaatcaaattcaacttaagctgcccgaaaatatacccaatttgagccaacaacccctctcggtctaaggtaaatagctcaaaagcggtctgatttggctgggaatttgctaaaaaacggatcttggtttttcgcttaaacgcctgatgtttaacggattttttacttggattaaacactttctccgtattcgcaagcaaggttttaaccaatgccgactgaatttgttcacttcgctcatcatcgagtggctcaccgttcatttccgtaataataaaactatccaacaccaaaccatgatcgctcgtaaggatttgagcatcgtggatactcactttcttctgacttaacgtctgtgcaattctcgcaaaaagctgggcttggtcttggcaatgcacaaaaatttctgtcgctccccgtgcatactgattgctaatcaacaccatcggcaacgcaggatcttttaaataatgcaaggcgtgccaataaagctgtgtcgggctgtttcgcacaaaatagctttcaggacaggattgccaaaattgcaacagccgtgttttttgttcagccgaaagtaacgcctcaagttgtacataggcttgctgttgatgggcttggctcagttgctgatgattaatcgtttcctcactgcctaactgcaactgctgttcggtaaattgaaaaagtttaaggaaaagcgaccgcttccaatcattccaaagggtttcattcgtcgcacaaatatccgcaacggttaaacaggttaaagcagctaaagcggtcggatttttcaccacatttgcaaaagttttcaccacatcgggatcgtgaatatcccgacgttgtgccgtaattgacatcgtcaaatgctctgccaccaaccacgccatataatcactttgctcttgagaaaagccgtgttgttgagcaaaagcacgcatatcttccgccccaacttgagcgtgatcgccctctctgcctttagcaatatcgtggaacaaggctgacaaatagagcaacggacggtctgccagtgtcggaaacagacgacaacaaagcggatgtttttcggcattttcctgttgcagaaaactttctaatttaagcatcacctgaaccgtatgctcgtccaccgtataaatatgaaaaagatcaaactgcatcaagccttgaataccaacccattgcggtaagtaagcggttaaaacgcccaactgatgcattggcataatggctcttttaaccacatcaggctgagaaaacagccgaataaagcgatgtcgagcttgaggcagttcacacaacggctggtttaaggtctgtaacgccagccgaagttgtcgcaacgtcgtactggctacacacacctgcgtatgctgagtgagatagaagaaaagatccaaaatccgctcaggttgttgcttaaaaatcaaagtgttactacaaattagctgttccccttgcaaataaaaatagtcatcaagcggctgtttttgctgtacattttgcaaagcctgtagcacctcttgatgaaaatgattgagcaacaattgcgttaattgcgaaatagattgcgtcgcctgaaagaaatctttcatcatcgcttccacaggctgattaccctcgccctgatagcctaactgctcactcagttgtaactggcgatcaaaccgcaagcggttatcgtaacgctttaattgcaaatgcaaggcaaaccgcattctaaataacgtatgttgagcctgctgaagctcaataaattcttcaggatagagcaaaccccgactaaacaaactctctaggctatatagcccataatggcgtaacataatccaagagagcaaatgcaaatcccgtagcccccccggactatgttttaaatcaggctcaaggttataactggtattatgataacgggcataacgttcatttttttccgccatttttgcttcaaaaaaggcttgaatagaccaaaactccgcgtggaacagcttgctcatcagctgttgccacaaggcttcattgccaagcaaaaaacggctctcaaacatattcgttgccacagaaatttccgctctgcccacctcaacacactccgccaaggttcgcacactcgcccccagctgaaatttgcaatcccacaagaggttaaacagttgatttaattgattttgcgtctgttcatctaaaggctgttcactcaacaccaaaatatccaaatcagacagcggaaacatctccctccgcccatatcccccgactgccactaaagccaagtcctgccgctccatcaacccaaattgttgccagagcgttgtcagtaaatcatcataaaaatggctacgttgttcgagtaaatttttgatatcttcagtactaaaaagggatttttgtgtgctattaaattgctgaagttctgtttttaaagtttgtgtatcaatcatagcggtgagttttagcattattttacgaagaattgtaatggatttctgagcgtccaccaaagaggatttttaaagtaaattgtatgaataacaaaatttctttttaggctgaaattcccaaaatctcaccacttattctatgttagaattctagcaaattttcagacaaggattttcaatgagcaaacagggtaaaccatttattttacattcccccttcaaaccctcaggcgaccaaccgactgcgattgccaaattagtcgagggattgaatgatggcttggcacatcaaaccttgctaggtgtaacaggatcgggcaaaacctttaccattgcaaatgtgattgcgactttaaaccgtccagcaatggtgcttgccccgaacaaaacccttgcggcacaactttatgccgagatgaaagcctttttccctgaaaatgcggtggagtatttcgtttcctactacgattactatcagcccgaagcctatgtgcctgctagcgatacttttattgaaaaagatgcctctattaatgagcagatcgaacagatgcgactgtctgccaccaaatcttttttagaaagacgggatacgattgtagtcgcatcggtgtcggcaatttacggcttgggagatgtagatgcctatatgcagatgatgttacatctgcaagtgggggaaatgatcgaccaacgcaaaattctctctcgccttgctgaattacaatatactcgtaacgatcaagcctttcagcgggcgactttccgtgtgcgtggtgaagtgattgatattttccctgccgaatcggacggtgtcgctctgcgtgtggaactgtttgatgatgaaatcgaaaatctgtccttattcgatccgcttacagggcataatttagggcgagttccccgttatacgatctacccaaaaactcactacgttactccgagagatcggattttagaagcgattgagcagatcaaaaaagaacttgccgagcgtcgaacttactttatcaaagagaataaattactcgaagaacagcggatcgcccagcgtacccagtttgatattgagatgatgaacgagttgggctactgctcaggcattgaaaactactcacgttatttatcgggcagaaaagagggtgaaccgccaccgaccttgtttgattatatgccgtctgatggcttgctgattattgatgagtcccacgttaccgtgccacaaatcggcggtatgtttaggggcgaccgagcaagaaaagaaactttggtgcaatacggtttccgtttgccatctgctttagacaaccgtccgttgcgttttgaagagtttgaacgcttatcgccacagacaatctatgtatcggcaacccctggaccttacgaattagagaaaaatcctgatgtaatcgaccaagtggttcgtccgactggcttgttagatccgattatcgaagttcgccctgtggcaacgcaagttgatgatttattgtcagaaattcataagcgtgtggcggtagatgaacgagtgctagtcaccacgctgacaaaaaaaatggcggaagatttaacggactacctagacgaacacggcgtacgagtgcgttatctacatagcgatattgacacagtcgagcgggttgaaattatccacgatttgcgaatgggaatgtttgatgtgttagtggggatcaacctactgcgagaaggtttggatatgcctgaagtgtcgctggtggcgattttagatgccgacaaagagggctttttgcgttccgaacgttctttaatccaaaccatcggacgtgccgcccgaaatctcaacggcaaagcgattttatacggcgaccgcattaccaactcaatgcaaaaagcaatcaccgaaaccgaacgccgccgagagaaacaacaaaaatacaacgaagaacacggcattgtgccacaagcattgaacaaaaaagtcggcgagttgcttgatattgggcagacggataaaccgaaacgcagtaagaaatctgcaaaatcaagcgatgatcaaaccgcttacattccgaaaactcgcaaagagttagaaaaagaactgaaagtgcttgaacaacagatgagagattttgctaaagatcttgagtttgaaaaagcggctgcggtgagggataagattcatcagttgaaggcgtatttgttagaactttaaaagtaatttaaattactcataaagaatactaaccatattgagatttatacagtatcaatcacaaactcaaaccaatcaatcacatctttttcgtgaatgccgttggggattaacacccctgctcttttcactgaattaggatcttgtgaaatcagtgggtgccaatcaaacaacggcttgccttcataaatcagtcgataggcacaggttttcggcaaccagccaaaatcggataggttctttttggtgagcttggtacaatctttttcgattttgcaacgctccgcatagttgctacaccgacctgtattcacatcaagcaaattacaggcaacagaggtgtaatacagccgttcccgcttgcctctgccttgaatatatttgcggtagcaacacttaccacagccgtcgcacagggcttcccactctgcttcattcatttcaagcagtgttttagtttgccaaaaaagcggtgtgatttgaagatttttttgcaacattagcgaataacaaccgctgtgccggtcgcaaccacaataaacattcctttatcaccgcccatagactgatattccatagacaccccgacaacggcatttgcatctgacacgacttcaccaaagactaagcctttgtactcaacgatttgatgattttcaatatttggagttgtggtaataatcataatgttcctatttcaattgctgtttcagggattgtaatgcaatcgctctatgggagatttttttcttctcaacagtttcaagttctgcaaaggtgcagtttttaggcggatagaagaatagtggatcgtagccaaaaccgtttgaaccacgttcctcacgtaaaatttgtccgtaacattcgcctatggcaatttttggagtaggatcggtcgggtgctgtaacatcacaatgcaactgacaaattttgccgtgcgatcttcatcggcaacatttgccatttcagccaataatttttggcgattggcttgatcgtttccttcttcacctgcataacgagcagaataaagccccggttcaccacccaatgcttcaaccgctaaaccagagtcatcggcaatcgccggtaaacctgtcatttgtgaggcataacgggctttaatcaatgcattttctacaaaggttaagcctgtttcctctgggctttgaatgtcaaattcactttgggcaatcacgtcaaagccaaattcagctaacacatcagccatttctttcacttttccttgattgcctgtggcaaggacaattttggttttgttcactatctctttcgtcatattgaaatttctgaaactatgagcattcacaaacacagttgctaccttaaaaattgttttctaggacgccaagcgtggcgtccctactaggtttaatgtcggcggtttaatacaaactcggatcgctctcattcggtcgggttttaaaacgacgatgtagccacatatattggctctgagcttgcataatctcgctttctacgaccttgttcattaaggttgcagtatcaacgtcatttttgcactggctaaaatctactgcaggcctgattttgacggtataacctgaaaaatcgtcgtttcgcattggggtaaatggcacaacgatactatttggggcggaacgtaataacattctcgttccagctgttgtacacgcttctttcaccgcaaaaaacggcacaaaaacactgtttttgcgtccgtaatcgtgatcgggagcataccaaatggtttcccctgcacgaagagctttaatcataccgcgtaaatctttgcgatctagcatggctttgttagaacgtactcgcccacgaaattgaatccaatctaacagcggattatcattcggacgatatacgccaatcccttgatgatgaagcccgacaattcttgccccaagttcaagggtcataaaatgaacaccgacaaaaataatccccgaaccctcaggctgatttttcagatgttccaatccttctattttcgaccatttaagaatacgttcatctgaccaaaaccacgccatccctgtttcaataattgccattccgacagattcggcattttgagctaaaatttcatcaatttgacaagcggtataatctgggaagcaaagttccaaattctgtttggcaattcgcatacggcgtttacccaaacctaatcgggtaaacagtttacctaagcccttaccgactttcgctaaaatagggtaaggtaagcataaaatcagtttgaaaattcccaatcctagccataaaccccaatactttggatgtaaaaaggctcgctgaaaaggaggaagtggtttatctatcattatgttgtttccattgatttcactgacaagcgaatccactccagtgcgatttctcgatgagcaatgaataaattatacacggcatcttcacttaatacgcctcgaatcatctctgagggaatttcccctcgttcatcagcattataatcttcttgccactgttcagcataataattttctagctctcggatttttggtaaaagaactatccacgactgttgaagctgttccattttattcattaggctatttgcttcatttaaaatctgttccatttcatgaatttttgccaagcgagtttctgataacataaatacctctcacaaatatcgttggaattatagtcaaaaaaaccagaaaagtgttaagtagatcaagtttttgaaaattgtttaactttaggggttgaaattttagggggaaaggcataatttgaagtcatccattcaacgaccaacaaggtcataataaaagaggtacatgctatgacaatcaatatttcaagcaaacaaatggaagtgacccctgcaattcgtacgcacattgaggagcgtttggctaaactgaataaatggcaaactcagttaattaaccctcactttattatccacaaattaccaaatggttacgaagttgaggcttctattggaacccctgttggcgatttatttgcaaaagcacatgatgaagatctctataaagctatcaacgaagtagaatcaaaacttgaaacccagttaaataaacaaaaacataaaggtgaagcacgcagagcagatgatagtattaaaaaagcgaatgaagcattatagatggcgtaaatatttgtatctgagataacatatccaagcgctgttatttgtacatctatctctaattctaagtatcttcattttaaacttatggtggtcgcttaggcgatcaccaaaatcaataagctggctgtttctagtttagagttagcatgcttcatttttgccatctcattaattgcggcaagtaggcaaatttgtttgctgatctgccaaaaactatgctatttaaaatgtcacatcatcaattggaaatacatttctttccttaattactcgacggattacatcacctagagattcaataacacttgtcgtatgatatgccgaattcctgctcacctataaaaatacctgtatctagatgtattatcacagaaacaggtatttacacaaatttattctatactctatagaaagttagaacttcatctctactgaaaggacataatttctaccaggggctgcatatcttgcgtaatctttcacattagtgtgctggtgaatagcgttaagtgaagattgacgtacggattcccaagtggtgtaacggtaattcatcaggttatatacgccagctcgtaccgttatgtgtttccaaggggtgacatatcctgttaagtcaaaggtatgccaagagcgtgttctttttttcgtagcagttcgttcataattggcaaaaccgacttgttcattacctcttaactcatctggattttttccgctagagtgagtcattgttagattcacgccccatttttcatctggttgatcgtaaccgatgcctacaacatagcgagcaggctgaatggtgtctaacaatggagtgcgaatgttcatatacccaggataatttttcacctctttcactcgcattttgctataagctaatgttgtgtaaatgccctcaggaattttatcaaataccccattccaatctagcttaccaataagattaatgccgtccaatttaatatcttgcacattaaaatagttaatcattgattgagtttggtgcattttttctgctggagcaatcaactgcttatagtcatttttgaaataactgacttcaacgataccaaaatcacctttgagtgttgctgcaatctcttggtttaaggatttctcaggagataatttctctgctttttggtaagcatcgctcgaacctgccattgcaccatcatagcgtaagccaaatagctcttggaaacttggcactctaaagcctgatgatgctcgataagagagtgataggaatgaagttggcttagcgactacgccgacattccacgcactgtttttataatcgccttgatttgcccagcggtgagtactgcggaatttatgcttatcgaaacggtagcctaaaccaatatccaaatacttggttatggcaaaattatctcgcagagcgatgtagtgattatgtcctttgattttgcttgtagcacaatcagccctgcctgcaatagtgccactataattacattcatttttactataaattgcctgatcttttagctcatagatgtaaggtgtatttttatgaccgttaccactgatacgatgccaagttcccacagaaaacttactcaaaatttcgtggcgttttaaggtggaattgaaacggtctgaacctaataacatatttaattgatgtttgcccaatcccgtttgtacggttttatctaacgagagctgaatagtgtcgtgtttttcttcataagaactttgctcatttttagttgaggaccaaagtttatcaagagttgcacggcaattcttatctatggttggatattcggaacagttgttctctctcaagcgggtagataaatcaattttttgctgatcgaaactcaaagagaggctatcaatcagacgatctttatcttgattggtatagcgatataaagcacctaagcgatcacgagtgtgccactcatcaataaaacgagcttttgcccaacgtaatccttttgaggatttcacaccatcttctgtaaagtaatcaatagcaacaccatctaaagcattactacgatataaccctttagcattattcattggataccacgtattaccattttttaaatctgatagctgccaataagcaggataggtcatatcgcgagtatcatagcgttgcttgctatgttcataaacaccagccacataatgttttggtgaaaggctataacctaatttaaccaaccaagaatcagatttatatttcactggatcaggcaaagctcgttcttcacctgtatattctttagcactaagttgctctgttagatacttttgcccatcataagacactttagcctgctgacgtggttcgcagttcaaacttggacaatcattcttaactttaaaccaattgctatcttgaggattattgtctgcgagatccactctttgaatacgcttagaacgactttccgcatccttatgagctttcgtttctttaccatcacgatgagtgtaaatcacaagtgcatcaaagccattatgggtaccagcaaaagcaagtgagtttagccattgctgatttttactactgtaagcacttttgctatccaatccccaagattgccctggcttaataatgtcgcttacctctttggtacggaattgcaccgaaccgcctagcgaaccactaccaaactcagaagagctagcccctttactaatttggattgaacgcagattttcgtattctatttcattaatggcaccgcttgaggaacgtgaatattggcttacataggattgaacctgtggcaaaccatctaacgccaatccaacacgattacgatctaccccacgaatggagtagcctgttgttgcacctcgtccttgttctactacagaaataccggggtcgtagcgagtcagatctcgcatccctaacacttgctctttactgagtgagtctggcgttttcaccactttccctaagcctgtcacttcgttctcttttttatgcactttctttttcgtacctgtgacataaacatcgttcaattgtaccgcttgttctgcatagctttgtgcggcaaagagactaagaagagcaaggctaataagatttaatttatttttcatagcaaattccttattatttttttacttgttgttttgcaccaaagacagcacctacactgccattgtctgatttatggaagaattgtccgccaagctctgctgccgttggaccatagaagccaccattaactgctacatcgctaaatttcacattgtcataacgtgaactgcctgagtctagagcgaagccagtatctgaggttttagcttttccggtaaaaccattaccattaatttttgcatctacggtaaacacaggatttacaccgcctttatcaaataacttgccgcttacttttttatcaccaaaattaacatcaaattctgagcgatagcccgattctcgattattatccgcttccgctatccagttcgtccctttagatacgagtgcatcccaagtaccaatatatttatagtttccgccttttggcatcttatccgttgtagtacgttcaccttgtaggaataaactattatctttggctgtttcaccctctttttgccataattgaccaaatttcatatattccaaattactacagcaagctacagctaccattgttttaccgttgatctcaatcgttttactgtttttaaaatcggtacctgccagatccatttttttcccatcaataattaaaacggaagcatcgccaaaattggtaagttctgaagaattaaaatgagttaaatcaatttttgaggcatcaataatacgaacggtgtcaacattagagccattgtgttttgctgaaaaaacggcaaaaagagatttgtcatttgtgataaattttcctgcaagttcttctgccttaggtccatagaaaccaccttcaagataatcagaagacttacctaaaattgcatcactagtgtctttggctattgctttacctctaaaacgatttcctttaagttctgcttcaatactgtaacgctctaatgattctgtatttgctgttttgctatttaattttccttttaatttttttgttgaaaaatcaacttcaaattcagatgtataggttctacctttagcatttgcagatgttgttgcaattctctgccctggaccatacccactaaattcagggttactattaggtcttttggcatctaaattagcatccgaggtaaaatcccattcaccttgataggtaaggactggtccctgcggtaattcttttgagggagtgatgcctttataaaacacataacctttatcacgagtaccataatgatctacatcaattgcataaccagaacgaacatacttcatcgttttatctgctgttttatctactaccaagccataattttgataagctacacttttgatagtctcgtgatttggtattttattaagatcttcatcagtaattgcttctggatttgagatttccgttcttcttgctccactttgactcaccggaacctttacaacataccccaaagcaggttccatcaattcccctaactgttcttttactttcttatccgtttccacatcctgatactcttctttagacacgcccgttgtcttattaggctgaacatcttctaaatcaaaacttccttttccgccagagcaggcaacaagaaacagagaagtaaacgctaacgcacagggattaagtttaaaatgcatatttgcctccgatataaaacactgcatttatttagttggttgggttacaaagccaattttggttagcccaacattttgagctaattcaaggactttcacgatatgttgatattccacggaaatatccgcagaaatagcaataacggtatttttattttcctgaaattttgtcagaaaagattgttttaattcttcttcatttactagcttttcgcctaaataaatgccagtaggattaatcgccaccctgaaaatatcttttgcttcatcttttttctcaacattggcggttggtagttcaagcgggatagattgcgttaatataggcattgtgatcataaaaacaattaataacaccaacattacatctactaatggcgtgacattaatttctgacattaccgaattttcatttttatcaaaacttccaaatgccattatttattttctccatagtgatgtaataaatagataaataactcgtttgcgtaatgatctaaatcttgagaaagattacgattaaggcgagtaattaagttataagcaagcaccgcaggaatggcgacaaataatcccattgccgttgcaactaaagcctcacctataggggcagatacggttgcaatactgacttgcccttgctgactaatatccataagtgcattaaaaattccccagactgtgccaaataatccaataaacggcgcaactgcaccaatagaagcgagtgcaactaaaccgccatcatatttacgcaacgattgagtgatggcatttcgcaaatgcaatgtcaggaaatctttaaatggaagttgatgagataaatggttcttttctttagcttgatataattcacattgtttaaaagttagctgtaaaatatctgcaatttcagaccgcttgttttgaatatattgctctgcttgagtaagattttcagcagatttgactaatttaaaactttgttggttattttttcttacaccaatcattttaattaaacgaattaaaataatagtccaagataaaatactcattacaactaaaattccaaaggaaatggaaagtacaatatcttgttgttgaagaagttgaattaaattcataaattacctcaaataatttaggctgctgccccacatttaaaatgaatactaaaaatcacactgcctacgactgcactattatttactttagctggttgataggtgtgtcccgatgccattctgcttgcttgattatccaaacgtttaatacctgaagaagataaaatctctacatttgtcgctttaccattcgttcctattgttacctttaatttcacactgcctacatcatcagattcatcagaaatatctgaacaacgccctcgcattgcattgccataacccgcaccaagagaagcatctactttggcgtttccagtgacagacttactcccttcaacaccattttgatttccttgttgatgattttgggcaacttggcttgtgtttgttttttcatctgagtgtgctttaggcgataacactttctttttctctacttttttggtgagcttttctggggatttttttatctcttttttcacttttacttcagatttctccccttttttaacgagatctgcttgtgaaacatctgctacttctgtactgagtatttgctctggctcttgtgtcacctctggctcactttcacttttcacttcaatgggttcttcgcttcctaaatttacttcaaccatttgtaaattttctaagtccccaaaatgattgagatctctatcccaagatagttgtgaaatcatatatgccaacccgatatgaacaagagttacagataaaaaaatcgaaatgttataaaacctgttataaaaccattgcaacataatatatgagtatattagaataaatccagtaatcaaataaaaatcattatcaatatgatatctgataagtttgacaattacaacattaattcaaacaatgtaagcgccagttaagttattgttaataaaaatcaacagtcttgacattgcttcatgcttttataggaacgttatgaatcactcgtttattagcgcaacacttttattagtcttagctaactactctatagcaaaactatctcaggatagtattactgaacatctaaatgataatagagtccaagcagaaaaagccgatatcctcattcacagccatcaatttaaggttcatcaaatcgctaaggaggaaacggataagagtagtattacaatgacttcaaaagagttggtaaaatatccagatttagtgataagagcattattgcctgcggtaatgcaaggtaatattgacaatgtcgaattgctttatcccatttaccaacagcttcctgcacaatttcacgacccaattcttaccaaatgggcatcggcaattgtggcaaagaaaaatcagcaacatacggaagcgatcaagttatatcgtcagatccttgccgaacaagcagatattcagcctgttcgcttacaacttgcggtagctttatttgaaaataacgaattggaggcttcggaagatcagtttaaaaaactgcgttcagaaccgcttatccctgaaattacccaacttatcgatcaatacattaatgcgataaatcggcgagatcgttggacgttttcaggtgggcttacttatcttaacgatcctaatatcaataatgcaccaaaagcaggaacaacctacggcaactggcacgcaccaaaacgagaatcggcagaaggtgtcggttttaatttcgatctcggtaaaaaatggtcgtggggaaatggcttctttaatgaactacgtcttgccaccaacggcaaatattattgggataataaaaaatacaacgaaatgagcttacggggcagtgtggggctaggttttcaaaatgcaaaatataacctgaggctgttgccatttatggaacaaacactttatgcaggtggctctaatcaaagtgatacattaagacgtttttctaaatcaggcggtttaacccttgaaacaaactattggttatcacctaaatggcaactcaacactaactatgaatatgccgaacaacgttacgcaagtcgcttgcacctcaatggcaattatcactttatctctggtgggttagtttatttagccaatgcaaaccaatattggtttgcaaatttaaactacaatcgcaccgctactcgtgataaagatgatagctttttccgtcggggaattagtttaggttggggacaagaatggggcaaagggttttctactcgcctttccgtaagtgtagctcaaaaacgctataaaaaagaggcgattttccgcattattcaacgtaataaagaatatggcttcaatgcatcaatttggcatcgtgccgtgcatttatgggggatcactcctcgtttaacctacaattttactaaaacgcaaagtaaccacgttctttatagctatgataaacatagggtgtttattgagttgagtaaacaaatttaaacttattgtttgttatacctctgcacctcactctgcaaatccaaccctttcaaccacgccattttttctttgatctgcttttccattccacgttcggttgggaagtagaattgggtgtctttcagttcaggggggaagtagttttcccctgcggcgtaggcgttaggttcgtcgtgggcgtagcggtattcttcaccgtagcctaaggatttcattaagttagtcggtgcgtttcgcagatgttcgggaacatcgtaatccttgccttcttgggctaggcgtttggcttgtttgaatgcggtgtaaacggcattactttttggggcaacggcaaggtaaatcaccgcttgggcgatagcccgttcgccttcgtaagcccctactctggtataacaatcccacgcagcaagggcgaattgcattgcccttggatcggcattgcctatatcttctgaggctatcgcaagtagtcggcgagcaacatacagtggatcgcctccagcggttaaaatacgagcataccagtacaatgcaccgtcaggggaagagcctcgaatggatttatgtaaggcggaaatcaggtcgtaatagcggtcgccacctttgtcaaaacgggcttggcgttcgcccaacacttcggtgagcaaggctttatccagcaattttccttgtggtaattgttctgccatatcgcacattaattcaaggcagttgagagaaaaacgtccgtcgccattgacgtagtccgccagcagttgaagcacatcatcttgaatgatgagcttttcattgcctaatccacgttctttgtctgcaatggcattttgcaaaatttttagaatatcgaccgcttgtagtggcttgagaatgtaaatccttgcccttgatagcaaggcgttattcagttcaaaggacggattttcagtggttgcaccgataaaaataatggtgccgtcttcaatatggggtaaaaaggcatcttgttggcttttgttaaaacggtgaacttcatcaacaaaaagtaacgtgcgtctgccagattgtcggttgagtttggctttttcgatggcttctcggatctctttgataccgctagtaacagctgatagacgttcaacttcggcatcaagttcatttgcgataatttcagcaagagtggttttgcctgttcctgggggaccccagaaaatcattgagtggctatgcccagcttcaatggctcggcgaaggggtttgccttcgccgatcaggtgtgattgtccgacatattcagctagagtgcgtggtcgcattcgagcggaaaggggacgaaaatccgcagaaaaatcgaaagataagctgttcattagcgtaaatgtagccctcggcgtatatgtcgcatcagtaagaaaatccacggccataagatgccgcttatgatcgccccgatgatttcttgggtgttaaattctgcactatgtagcactagttcgataaagaagataaagaaacgaataagtgcgatatatgccatcacaagtaagctctgtaaccataacgagagattacgcaagataagatgatatttggcaacaaaatagatcgcaattgacaatactaacgcgtgaatgcctaaaattgagcctaagatcagatcccaaacaattcctgctaaaaaagcggtgccgacactaactttatcaggcagagctaatacccagtagataagtactaatacaacccaagttgggcgtaatccttgtaaatccacaggccaaggcataatctctaggacaaaagcgatgacgaaaatgaaggtcagcactaacatttggaagatcatattttcacgcattattctgccccttgctctgtgctgtgattaataccgttatcgacttctggctgtgttgctggatttacagtttcttcaggttcgacagtttcttctttttgttcatcactacttacttgttcttttttactatttttcaagcggtctaatgggtttagacttttacgtctttcttccacagcatcacgcacatcttgcggtgaaaggcttgatgcattgcggatttcttcgcttgttggccataacagtaataaataacgcaggcgatcaagtgaggcgagcggtctagccgttgctctggcaaaatggtttgaaccatcattttgtacggtttcaattacggcaacgggatagccttcagggaaacgtccgcctaagccagaggtgacaagcacatcacctttgccaatatccacggttcttggtaagttatccaaaatcaattcattgctgtgtccgttgccattggctattgctcgaacatcgttacgcaaaatttgtacgggaatggcgtgagtgacatcggttaaaagtaatactcgactactgtttttcccgacagaaatcacttgccccacaacgcctcgttcatcaattacgggctgaccaacaaaagcaccgtcactttgtccctgatttattactacttgttggcggtaagcgtccatttctgcggtcagcacttcagctacttttttatattcatcttggcgtaaaggggaactaagtagtaaacgtaaacgttggttttccactttgagttgatcgagtagcaataagtctgcgttcttttcacgcagttgttcttttaatactcggttttcaacttgcagtttttgactgtcgataaagttgttacttacaccgtctaatacggtgcgaggggtatttgcaaaataatacaagccgctgaccgctgtttcgaggacattacgcatttggatcattgcactgcttctaccatcaagtaaaatcaggctgatagagatcgcaattgcaaagaatagtcttacgcctataggtggtgctttcgcaaaaattggtttcatatttcagttatatttaatggatcttgttaaatgcaaaatggacaatagccgttgatattgtccatttttatgctaataactcaaggttgaattagttgtcgtcactaaagagatctccaccgtgcatatcgatcatctcaagtgctttaccgccaccacgagctacacaagttaatggatcttcggcaacgataacaggcacgcccgttgcttctgaaagtaatacatcaagattttgtaataaagcaccgccacctgttaataccattccacgttcaaaaatatcggcagctaactctggtggacattgctctagaaccccttttactgcatcaacaatgcctgttaaaggttgttcaatcgcttctaacacttcttttgagcttaacacgaatgtacgaggcgcaccttctgcaagattgtgaccgtgaacttccattgtgcgaatttcatcttgattttgaatataagctgttgctatctcttttttgatacgctctgcagttgtttcaccaatcgcagaaccatagtgacggcgaacgtaagcgatgattgcttcatctaatttatcaccaccaatacgcaccgaagcagaatgaacgataccgtttaatgaaagtaccgcaacttctgttgtaccaccgccaatatcaattaccattgaaccagcagcttctgctacaggtaagcctgcaccaatcgcagcagccataggctcttcaattaaataaacttcacgagcaccagcaccaatcgccgactctttaattgccttacgctctacttgagttgcccctgctggtacacacactaacactcgaggacttggacgcataaagttattgctatgcacttgtttgataaaatgctgtaacattttttctgtcacatagaaatcagcaatcaccccgtctttcatcggacgaatagccaaaatgctttttggtgtacgacctagcattgattttgcattactacctactgctgcaatactttttgatgaaccagcacgatcttgacgtaccgcaactaccgacggctcatcaagcacgataccctgcccttttacataaattaacgtgtttgcagtaccaaggtcaattgaaaggtcgtttgaaaataatcctagaaatttcttaaacataaaagggatccattaaatttagttaaaagcgaaataagcccatagacttagggcaaaaaattgggcataaatatagcaaaaaagtcctaataactccaacgaataatttatcttttgcaagttttattacgaaatcctccgcttgtaaaaaatcggttaaatgattttaagatttcttcaaaataaacgtgaaaaaaatcccccaaaaagttaaataaatggtacatttgcaacgttttaattcattattattttaaccaacctacaggagtctttatgcttattggtgtaccaagagagctgttagacggtgaaactcgtgtggcagcaacgccaaaaaccgtagaacagattaagaaacttggttttgaagtcatcattgaagaaaatgctggctttaaagcaagttttgaagacgatgctttcgctcaagcaggtgcgactatcgccaacgcacaagccgtttggaatgcagacattatttttaaagtcaatgcaccaaccgatgccgaaattgcattaatcaaggaaggggcaacgcttgtgagctttatttggcctgctcaaaatcctgaattaatgcaaaaactttctgcgaagaaaatcaatgtgttagcgatggacgcagtgccgcgtatttctcgtgcgcaagccttagatgctttaagttctatggcgaacattgctggttatcgtgccgttgttgaagccgctcacgaatttggtagcttctttacaggtcaaattaccgcagcaggtaaagtgccacctgcgaaagtacttgtgatcggtgcaggcgttgcaggtttagccgcaattggtgcagcaaacagccttggtgccatcgtgcgtgcgttcgactctcgtcctgaagtaaaagagcaagtacaatcaatgggtgcaagtttccttgaaattgatttcaaagaagaaggtggcagcggtgatggctatgcaaaagtgatgtcggaagaatttaaccgccgtgcattagcactctatgctgaacaagcaaaagaagtggatattattattaccaccgcacttatcccaggcaaaccagccccacgcttaattaccaaagagatggttgccacaatgaaaccaggttcggtgattgtggatttagcggctgcaacgggcggtaactgcgaattaacccaagcaggtaaagtggttaccacagaaaaccaagtaaaaattatcggttatactgatttaccaggtcgtttaccaactcaatcatctcaactttacggcaccaacttagtcaatctcttgaaattactctgcaaagagaaagatggcaacatcaatatcgactttgaagatgtagtattgcgtggcgttaccgtaatccgtgatggcgaagtcacttggccagcaccaccaattcaagtatctgcacagccacaacaaaaatcggcagcaaaacctgcggagaaaaaagaagaaaaaccggcagatccacgcattaaatatggcttgttagccttagcggtgatcgcattcttgtggttagcttctgttgcacctgcagcattcttatctcacttcaccgtcttcgttctctcttgcgtagtgggttactatgtagtttggaacatcagccacgcattacatacgccattaatggcagtaaccaatgcgatttcaggtattatcattgtcggtgcgttactacaaatctctcaaggcagcttctttatcagcgtacttgcctttattgcgattttagtggcgagtatcaacatcttcggtggcttcaaagttacccaaagaatgttagcaatgtttagaaaaggttaaggggaaagagtatgtctttaggtttagtacaagcggcatatattgtcgcagccgttctctttattatgagccttgcagggctttctaaacacgaaacggcaaaagcaggttgttggtacggcattgtgggtatgaccattgcccttatcgcaaccatctttggaccacaatcacaaggaaccatttggattttaatcgcaatggcaatcggtggtgctatcggtattcgtcaagcattaaaagtggaaatgaccgaaatgcctgagcttgtggcaattcttcacagcttcgtaggtttagcggcggtattagtcggctttaacagctacggtcttgcacacgaaacagatccagtgctacaaaatatccacaatgttgaggtattccttggtatcttcatcggtgcggtgactttcacaggttctgtggttgctttcggtaaattacgaggcattatcaattcaaaagcattaatgttgccacaccgccacaaattaaaccttgcggcacttgtggtttctgcactattaatggttgccttcttaaataatcctgagaacattttccctgtattagtgatgactgcaatcgctttagctttcggttggcacttagtggcttctatcggcggtgcggatatgccagtggttgtttctatgcttaactcttattcaggttgggcagccgcagcagcaggctttatgttaagcaatgacttgctaatcgtcacaggggcattagtcggttcttcaggtgcgatcctttcttacattatgtgtaaagcaatgaaccgctcgttcatcagcgttatcgcaggcggctttggtaacgatgttcaagtcagctcagatgaagaacaaggtgaacaccgtgaaactaccgcagaagaagtggcagaattacttaaaaatgcaagctctgtgatcatcacgccaggatacggtatggcagtggcacaagcacaatatcctgtggcagaaatcacccaaaaattacgcgaccgtggcatcaatgttcgctttggtatccacccagttgcaggacgtttaccaggacatatgaacgtattacttgctgaagcgaaagtgccttacgatgtagtattagaaatggacgaaatcaacgacgattttgcagatactgacgtagtcttggttatcggtgcaaacgacacagtaaacccagcggcaatggacgatccaaatagcccgattgcaggtatgccagtacttgaagtttggaaagcccaaaacgttatcgtgttcaaacgctcaatggcagtgggctatgcaggcgtacaaaacccactgttcttcaaagaaaacacccaaatgttatttggtgatgcaaaagaacgtgtggacgatattttgaaagccttataagtagcaaaaaataaccgcaacttataacaataaggtgcggttatttctacctatatttatgttcaaaaacaagcaattcttgcttctctctatgtttggcatcccctaaagtacacaagtaacatcgaaagaggcagtataatttcttggactttaggatcaaccgtacctaatcaaatacattctcaattagagaatgttcgaccatttcctgtcttagggtagacatgatttttatatactaaagaataaaataatcgaatatttaacgattcttatcagattttttgttaggatagcactttaatttttctatttgttttttgagtgattacaacgaggtttttatgaacccaagacgcaaatctagactgaaagtggtgatggcagtgttaagtgggcttgccgttgctgttggtttaaccttatatgcgttaagccaaaacattgacttattctatacgccatcagagattatctatggtaaaaataatgatccagaaaccaagcctgaagttgggcaacgtattcgtgtagggggtatggtggttgatgggtcggtaaaacgtgatgacaagacccttaaagtgacctttgatctcaatgatattgggcctgcaattcaggtggaatatgaagggattttgcctgacttattccgtgaagggcaagggattgtggcacaaggtactttagttgagccgacaaaactgaaagcaaccgaagtgttagctaaacacgatgaaaactatatgccacctgaattaggcgatcagatgaaaaagcaacatcagccgatggggatttcagaagcagatctcaaaggaaaatcagaacgtgatgcaacgcagatctctcagccgtttggagaaaataaatgatagctgaattaggtaactatacccttgctcttgctctcgcattggcaattttattggcgatcttaccgcttgttggcgctcataaacaaaatgctagtctaatggcattggctcgtccgatgacgtgggcggtttttttagcattatctatctcgtttggctcgcttttttatctgtttgcggtcaatgattttactgtgcagtatgtggtgaataactcaaacagtacgttaccgttagagtatcgcctttccgctgtttggggttctcacgaaggatctttgttgctttggatttggctactttccctttggagcgttgccgttgcgacattcagccgacaaatgcctgaagaagccatcgctcgtgtattgggggtaatgggcttggttagcattggctttttagtctttattctgtttacttctaacccgtttaaccgaactttccctgattttcctgttgatggtcgagagcttaatccgatgttgcaagatgttggcttaatcttccaccctccgttactgtatatgggctatgtgggcttttctgttgcctttgcttttgctattgcgtcgttgatgacaggtcgtcttgatactgcttgggcgagatggtcacgtccttggactatggcagcgtgggtatttttaacattaggtatcgtactcggctcttggtgggcatactacgagcttggctggggcggttggtggttctgggatcctgtggaaaatgcctcgttaatgccgtggattgcaggtactgcattaattcactctttagcggttacggaaaaacgtagtactttcaaagcgtggacggtcttgctagctattcttgctttttcactctgcttactcggcacattcttagtgcgttcagggattttggtatcggttcacgcttttgcttctgatccaactcgaggcttatatattttggcttatctcgtggtggttattggcggttcgctactgctttacgcttatcaaggcagtaaaatcaagagcttagacaattccgaacgttactcacgagagtcaatgttattactcaataatgtgctattaatggcgttcttatcggtggtctttttaggcacgattttaccgttaattcataaacaaattggtttagggacaatttctatcggggcgcctttcttcgatcaaatgtttatgatcttaatggtgccttttgcatttttattggggattggaccgcttgtaaaatggcgtcgagatcaggtttctgctatccgtaagccagttctcatttcattagccgtaatgatattgcttggctttggattaccttatctttttgccagcaaaattactgtcagcgtggtattagggacaatgatgtccgtcattatcgtggcattgagtttatatgaactacatcaacgagcaacgcatcgtcatagtttcttgcaaggcattttgaaactttctcgttcccattggggaatggtgttggctcatttaggggttgcaatgactgtgtttggtattgcctttagccaaaattacagtatcgaaaaagatgtacgaatgaatgtaggcgacaaagttgaaattttagattacaactttaccttcaagggtattcgtgactcaaatggggcaaactatattggtggcacagcggatattgaaattcatcgaaatggtaaatatgaagccacactacacgcagaaaaacgcttttacaatgtcagtaaaatgggtatgactgaagctgcgattgactggggatttagtcgagatctctatgcagccttaggtgaacgtttagaagatggctcttggggcgtacgtttatactacaaaccgtttatccgttggatttggttcggtggtttgtttatggcgataggtggcatactttgtatgatggatagacgttatcgcttaaaacagaataattaactatgtttatcgctcttcataaggaataatcggcatggtagacaaaatagttgctaatgtttattttctctaaatattagcaactatttttatttgaaaaatcttgtatagacaacatattacaccttttatttacgaagtaatttataaaacagagtaagtaagactgttggcaataatctcggtaccactcgcatagtaaaagtgataaaacctgaaacgatattctgcatacccacttggtgttttaatttaaacaagcgccattctgccttagcctgagcgataccacgacggcgaccaaccataccatttccaacacgagcataaaccaaaacctcaggcaaattcgctacttttttgcctaatgcgaccaatttaatccagagataataatcttcttgtaagtcttgatagccaccacattcaagcacagcatttttttggtaggcgaccgtcatatgattaaatgggcaacgtttctgtgtaaactctacaatggctttggtttctgttggcacacgacgatagctgacaatatcattaatatctgagccaaattcagcaatttgtccgccaaaaataatggtatcgggattttgttcaataaacgcaatctgtttttcaaaacgttctggaatacaaatatcgtccgtatccatacggaatacccattcatttctgcagtgggttaagccgtgattgagtgcttttcctaacccttgattttgctctagtctaacgatattaagcggtaagatgtccgcaaaattttgcacaacttgctctaattcaggggtaatggctccgtcaaatacaacaacaatttcgtccgcttgaaccgtttgattttttaaactttcaaaacattcggttaaatattttgatttttccttaaaatataaggacattaatacggaaaacttcattaaataaaccttttcatattgattgcaagttttggtgaaataaatgtgagggtagcaatcaccaaatgtttaatatttttactttgtaggaacatctgccaataataacaagccgctttacgagataaattcattatatgtgggtaagaaagcatatataatgcattaaaagcaaagtttttttgttgaatatctgtttttacatatttttgtttaatagtttcaatcgctaattcagtattttgtgtatttgtcgatacacttgctcgtttagtatggaaagtacaggttgttaaggcttgagaaacatgttttggtttaaattcgttatgcgaaatgactttcaaaataaaatcatagtcttctagagattttaaatccgttgataatccattgactgcaaagaaaaatgattttttaatcgcaatcatcggcattccacctactttatttgccagtaaaatattctctaaagtgaccgcttgttcattttcataggggcgagtgatataactaaacccttcatttaccatcacacattcagcagggtgataaataaaattaatcgtcgggttttcattaattgtttttgccagtatttcacattttggatgagcaaaacgatcatcatcatctaaaaagagtagccactcgttttcagcaaatcttgctcctacattacgactttctgctgctcctaaattctgttcattcctaatcacattggcaggaaatgggtagagatgtttaatttctactggctcaacagagtgatcatcgacaataatcacttcaaaattatattccgtttgatattccaaacttgttaataatgcaggaatttcattttttcgattataagaaggaataataatactaaacattttctgtcttgttatttaaaaatagaattttatttttaccttcattgccaaataaagataaaaacattaataacactaacataattaatgaaggtaacggaacaatggctaaggaataaaatgcccattttgcgtttgttttaaattaattcgaccttgttttaatccatcaaaaaaatagggagtgagtgctttatttactgcttgtaaaataatcatcaatatcgcagcaatttgagcccccatcgcatataaacctaaatcaacttgattaaattgatgataaataaatacacgatctaactgcccttttaagaaaaaactgacattatgcaaaattaatggcgtaccaaaagcaagcacataaaaaagtgcagatttatattgcttccattgatattttttactcgcactttttttacgataaatcaggtaagctaataaaaataccagtacattgcctaataaaatcccaaataatcttttttcgaccaattctgtttgataaagttcgagaagtaataccgtaaaaacaacagtgcctaagctagaagcaaattgcaaaatggcataggaaatcgcctgtttttgacactgtcgaatgctcagctgaacacctaataaggcttgaaaaatagcagacaaggcaacataggtaagaatttctgattgtaaaatccagcaacccagtaaaattaagctacctatcgcaagggtataagcatagccagaagtcacgactaagttaagggagcgtttaccataaacatagaagtaacgggttactgccccttcttgacttaaaccgacaataataaagaaaagcacaagataagtttggtaatatgcaagttccccaaacccttctacgcctaattttcgagataaatagggcaatagcaaaaatggcattgcccgtgaagtcagttcaccgattaaataaactgcactgtctttgatggctctcattgcatctctttctcaatcaagctatccgccagttgcaaatctaatgtggtatcaatatcgactgagcgataggttggcattaaatagaaacgcacaggtggaataaaaaagtatttttcttgaagtaggctggcgatatcgttgatataaatcgccccattcgcacggtatgcttttggtaattgctgacgtggtgcttcaaaatctttgatttcattcatcgggagaatatcatctccatttaaaacaaatgatttatacgggtggtgttcacattcacaagcggataccacagacttactttttccacctaaaaagatttccatcgcattgcgaatatctaacgcatttcggagtgggctagttggttggaacagtgctacaacgccttcacggatatttaaggtttctaaacagtgtacaacggcatcaatcgtacgagtattactctgtgcaagttctacaggacgatgaacggcagttgcaccatatttttcaccttcctgtaaaatacgatcaccatcagatgtcacaacgattaagtcaaacattccagactcttttgctgcaagaactgcacgccctacgagcgaaactccgccaactaattgtaagtttttatctttaatcccttttgagcctgctctggctggaataattgcaatttttttcataaatctaaccgctagtaatatggctaataagaatcgctattttaattttaaagggcgagtgaaacaatagacaaggaaaagggaataaggaataataaatctcttttacttacttgacaaaattgcctacttattatgtttgctatcacgaaatttattactgcggtcattcttccaccatttaacattctgattttatggttgttttccttaatttgtttccgtttgaaatggaaaaaattaggttatctctcaacctttttaggcatagcaattctctatattttcagtattccctatacttcacaaaaattgcacgattctttggtaactgaagataatctgagcattgaagattataaatcagctcaagctatcgttttacttgggggtggcttacgcgatagtaaagagctatttggtaaattagcgatcagcgaaatagcattagagcgggtacgttatgcagcgtttttacaaaaagaaactggtttgcctttattgattacgggaagtagcccaaacgggacttcagaagctggcgtaatgaaaaaagagctagcacaatttttccatattccaacacaatggttggaagaaaaagccaaaacgacggctgaaaatgcgaagttttctaaacctattttagaaaaagaaggtattaataagatcgtgttagtgacaaatcagtggcatatgcaacgagcaagaatgttatttgaacgagaaggttttgagatattacctgcaagtgttggcgcggggaaaatgcctgaaacctatggattaaatgtattttactttatcccacaatcaggggcattacatagcaatatgcacgccctgaaagaatggattggatattggaaagagaaataacggacattattaggttaatacatttagtagatcagccctagtgtaaaaacaaatatcactaaaaattcaaatagaccgacttgtttaattttccagtttctttttggcacaataaccgctctaattaacccaatgaaataggcaaagctaatgccataatcgcctaaggcgagataaacaaagataaatatacaatgaagtcctatactgaacttacagtaaagaggatttttccgctctcgagcaacgctttttacataaattgttgtcccaataaaaaataacgtagggtggagtaaaatctcaaaattatattggttcgttgctaaatagaaacttgccattccaattatgccgaaggttaaaatacctgcaatatcattgattaagtttcgttcatctttttgttttgcatagtaaatttggacccctgcaagcggcaggattgggattataaattgcaaaatagaaaaatgacttaagagtaccggaaatataaatatgccgctaaatacggcataaataatcatccagcgtttatatttttcattttgttttttgctaacgacggagaaaaaaggatgggaaaagagataagtaaaaagccagctaagcccaagccaaaaatgattcattacaaaatggctagcagaaataccataaataaatggtacaaatgccatcactaatgctccgtgctgattagaaataatcggcttttctttaaatatcatgcttatttatctactattttgtctaggttcccatatccagttttaaattttatactctactatattgatttactttacttgcagcttcttccctacaaagattttattttgttttaaaccatttagctgcctcaatttttcaggtgttgttttatacatgcgagcaatggaataaagtgtttcatctttctggacaacatgatatttcgcattgagattaaccgttttttctgacgctttagacgattgttcttgcttagttttcgtcgttatttttgctttctctttagttttttccttaggcgaagtcaccgctgctttagcttttttatcttctttagagcgattctctacctttttttcagctttcgatttcttggttgatttttcatcattaactgctatttgatttggctgttttggtaatctatttttatatgcaattaatccttgataaatcgcctttgcaatctgacgacgatacgcttttgtggctaaacgttgttcttccgttgcattagataaaaagcccgtttccactagaattgaaggaatatcaggggaacgcaatacgctaaggctggcgtgttgtggcgaactttttgctaattgcgtaacatttcgcagtttgtctaagactgttttacctaactcataacctgaacgttgtgcgtgagaaaactgcagatcaagcactgtctggttcaagtaacgttcattattatttgctaaaaccgaacctgccccacctaataattccgattgcttttcgtgatcttccaaccattttcctaattcatcatttgcacgacgattagataaaacccaaaccgaagccccttttagattatctgaacttggtgaagaatcagcgtgaattgacactagataatgtgccttatttttacgagcaatttcagttcgattaggtagttggataaaatagtcaccattgcgtgtcattactgccttgaaattaggatctgcatctaacaacgcctttaattctctagcaattgctaaagtcacctctttttctttgacccctaaatttttaccgatagcccctggatctttgcctccgtgtccagcatcaatggcaatggttaattttgcttgtgcggaaagagcaagaaataaactcattaccgtaaagcaaacataatgtcgtaatttctgcatagtattaccctaagcggtctgatgttctaaataatctacaatctgttttgctaagtcgttttgaggcataagagctagatttcgccctgtttctgcatagtcaatttgaataataaagtccgcagatgggatcattccttcccctcgacttgcccattctagtaagcaaaccgtttgtggacggaagtagtccctaattcccataaattctaactcttcaggatcactcaaacgatataaatcaaaatgatataaagcataagggggaagctgatactcttcaactaaagtataagttggactttttacattcccattatgcccaaaagccctcacaatgctacgtgtcagtgtcgtttttccagcccctaattctccgtttagataaatcacaacggatttttcattatgattgtctaaatagcgttgaagttgttgggcaaaacgctgaccgaaattgagcatttcttcttcagttgcaaaataaaatgattgcattattgttaatctaaattaataaaatggtgacgataaaacttcagttcttcgatagactctttaatatcatctaaagctaagtggctgtttttcttactaaattgtttaagcatttcaggcttccaacggctcgcaagctcttttaatgtactcacatctaaatggcgatagtggaagtagtccgccaaatctggcatatatttataaaggaaacgcttatcttgtgcaatactgttaccacaaatcggcgaagcccctttcggcacccatttcttcaggaaatctaatgtctgtaattcggcagcacgttcggttaatttactctgcttcacacgctcaaccaacccatttgcagtatgggttttcacacaccattcgctcattttatttaataattcatcgggttgatatacggcaagcacagggccttcagccaaaatattcagatctttatcggtgataatggtagcaatctctataattcgctctttttcaggatcaagccctgtcatttcgagatcgatccaaattaaattttgtttgtcttgttggctcatctttttcaattaattatctaaaattccacaggatattatttattgtagcatttcatgcaccactttcataaacccatcagcagtagcataaacttcttctttgccttgagcttttaaaatcatatcggaaagctcacggaatgcggaatgtccgcctttacgtgttaagactaaatcagcttgatttttgacataatcaaaggcatcgcccacggcaaccgctagtccacagacttcaaatgcaggcaagtccaacgtatcgtcgcctaaaaatgcagtttcttcggctgaaacccccgcttgttgcattaattcaaaacaggcatcacgcttagacattttgccaagttggaaaaggggaatgcctaaatctttgatgcgacggcgtaaaatcggggtgtcaccgcccgatagcactgcaacttgaatgccgcaagcaagaagcattttgatccctaaaccgtctttcacattgaagtattttaatgcttcgccattttcggtgtaataaaggctaccatcagtgagtacaccgtccacatcggtaatcacaagtttaatttttgttagtctttgcataagtatccttgatttcagttaagtggagttttatgatcttgcccattatagccttttggagtagccaatgtcgatttctcaaaatttagcgacaatttctcaacaaattcaacaatattgtcagcaagctaatcgccctgaacagagtgttaaactgcttgcggtgagcaaaactaaacccatttcagccattgccgaagccattgaagcagggcaacgtgcctttggcgaaaattatgtgcaagaaggtattgaaaaaattcagcattttgcggagaacgacacattagaatggcactttatcggtttattacaatcgaataaaacgcgtgtagtggcggagcattttgactgggtacaaacgatagataggctcaaaattgcacaacgtttaagcgagcaacgtcctgaacacctgcctgtactgaatgttttaattcaaattaatatcagtgatgaagcatctaaatcgggtatttctgcgaaagaaatgctagaattagccactcaaattagccaactgccacgtttgaaattgcgtggtttaatggcaattccgaagcctgaaagtgagcctgagcaacagaaaatcgccttagctcaaatgaatgaactgtttcttcaattacaatctcaatttgaagggattgatacgctatcaatgggaatgtctgatgatatgccaagtgcaattgaatgcggttcgacaatggtgcgtattggtacggcgatttttggggcaagatcttaaatttgattgcacttaaagacaaatactcttatcctttccatattcaaaaaaaacctaagggaaaagctatgcaacctaaagcaaaatttagaaaagattaccgtcagcctgattttacgattcatcaaatttatcttgatgttcagcttgatcctgagcagacgattgtcacatcgacgttgtcggtcatgcgtaaaaatgcagaagcgactacgttacgtttagatgggcatagctttgaatttttatcgattaaatttaatggcgagccgtttaaagaatatcaaaaagatgatgaggctttgactttaaatttagccgatttccctgcggatcaattcgagctggaaattcagacaaaactcaatccatcaacaaatacgtcactacaagggttatatcaatcaggcgaagggatctgcacgcaatgtgaagcggaaggtttccgtcagattacttatatgcttgatcgccctgatgtgcttgcaaaatatcgcaccaaaatcaccgcttgtaaaagtaaatatccatacctgctttctaacggcaaccgtattgctcaaggggagctggacgatggtcgtcactgggtggagtgggaagatccgttctttaaaccaagctatttatttgccttagtcgcaggggattttgacctgttacaagataagtttatcacgatgagcggacgtgaagttgcccttgaaatctatgtggataaaggaaatcttgaccgtgccacttgggcgatggagagtttaaaacgttcgatgaaatgggacgaagagcgttttgggctggagtacgatttagacatttatatgatcgtggcggtcgatttctttaatatgggggcaatggaaaataaggggttaaacatttttaactcgaaatttgtgctagctaatccgcaaactgcaacggacgatgattatttgaatgttgaagcggtgattgctcacgaatatttccataactggacgggcaaccgtattacttgccgtgactggttccaactcagtttaaaagaaggtttgaccgttttccgtgatcaagaatttacttcagatttatggtcaagatcggcaaaacggattgaagatgtgcgattgttgcgtgcggtgcaatttgccgaagatgcaagcccgatggctcaccctattcgccctgaaaaagtgattgaaatgaataatttctatacggttaccgtctatgaaaaaggggctgaagttattcgtatgatccacaccttactcggcgaagagcgtttccaaaaaggaatgaaactctatgtggcagaaaatgatggcacggcggcaacctgtgaagattttgtgtctgcaatggaacgtgcttcgggagttgatttagatctgttccgccgttggtatagtcaatcgggtacgcctgaattaacgatttctgatgaatatgatgaaaaacgtcatacttaccgcttgcacgtttctcaaaacacaccaccaaccgctgatcagctagagaaagtgaatttacacattccgttgaaagtagcgttatatggtcaagatggtaagaaaatcaatttacaacacgaattattaactgtcagtgatgtgttagatgtggtccacgaacatcaaacctttgagttccacaatgtgcaacaacgtccagtgcctgccttgttatgtgatttctcagcccctgtgcgtttagattatgactattcaacagaacagcttttgacgctcttgaaatttgctgagaatgattttgtgcgttgggacgtggcacaaatgttgtttaacaatgagctgcgtgaaaatctaagtcgctaccaacagggcgaagcaatggcattctcacaaggtttgttagaagcactcacctttgtgatcgataatgcaaataaagatcctgaacttgccgctttaaccttaaccttgccaaaagaaacggaatttgctgagttgtttaaagtgatcgatcctgcaggtattgcggctgttcgtcaatttatgcaacaagcgattgccgatgaattaaaagatcacttcttagtcgtttacaaccaaaataaattaacggaataccgtgtggttgccgaggatttggcaaaacgggcattacgcaatgtctgcttgtcttaccttgcctttaccgaagtgggtaataccttggtacacaaacattatcatcaagcaaacaatatgacggatactttggcggcactctcagcttcaaccaaagcacaacttgcttgccgagatcagcttcttgccgattttgaacaaaaatggcaacacgatggcttagtgatggataaatggtttgttttacaggcaacacgcccagatgaaaatgtacttgaaattgtgcaaaatttattaacgcacccaagttttaacttcaaaaatccaaaccgtgtacgttcattagttggggcatttgcaagccaaaacccaagtgcgttccacgccattgacggttcaggttatcgtttcttagtcgatatgttgattaagatgaacgaaagtaatccgcaagtggcggcacgtttaattgagccgttaattaaactttctcgctatgacactcaacgtcaaaccttgatgcgtcgcggcttagagcgtttgaaaggcttggataatcttgctcgtgatctgtttgaaaaaattgaaaaggcgttgcagtaatgatctggcataaagcattattttcttttcacggaaggttaaaccgtaaaggcttttggatcggctttgggattaattttgcatttttgtttatttttgcaaattttatcttaaatccgaccgctttcagctggattagcgttctacccttgaccctttcactttacagtttatctgcagtgatcgttaaacgcctacacgaccgtaatcgttcggcgaaagccttgtttatggttgcggtgccgatattgtgttatctcagttcattgggagcgcaaggaacaatggcatttgtgctaggcattatgatgccgatgtttatcggaacgattttagtgatggaatggggtgtttttgcaggaaatcctgaagctaatcaatatggtgagaaaggattgagtgtgagatttaaataattgtagggtgggtcttgacccaccgtttcgttgtaatatcttgaatttattggtgggttaaaacccaccctacaaaactgttttttaaatctcccccagcccctctttttcaaagaggggagctagttacaaattttaataacaaacaaatacaaaatgactgaaataaaacttaactaccacaaaacccattttttaacctctgcacctgatattcgccatttacctgaagacagtggcgtggaaattgcctttgcagggcgttcaaatgcagggaaatcaacggcattaaatgctttaactaaccaaaagaacttggctcgtacttctaaaacaccagggcgtacgcagttaattaacttatttgaagtagaaccaaattgtaaattagttgatttacctggctatggctatgccgctgtgcctgaacaggtgaaacttcagtggcaacgctctttaggtgaatacttgcagaaacgtgaatgtttacggggcgtagtgattttaatggatattcgccacccattgaaagatctcgatcagcagatgatcgagtgggcggtatctgcgaagttgcctgtattattgctacttaccaaagcggataaacttagccaaagtgcgagaagcaaaaccgtcaaaatggtgcgtgaagcaattttaccgtttcaaggcgatgtgcaagttgaagcctattctgcgttaaatcgtattggtattgataaacttgcgactaaattagatagttggttcgccgaaatttttacacaaacccaagagggctaatcttatgtacaacttaaccgaattacgccaagaaaccgatgaaatcatcaactctttattagacgatggcagcgatcctgaagccctttatattatcgaacaccacgttgctcaccacgatttcgataaactcgaaaaattagtggtagatgcttataagttgggctatgagatttctgaagcggaagaagtggaagaagagaatggcgatcttgtgtttgtatgcgatattgtcagcgaaattaaactagatgcggaacttattaccgctcaacaaaaagagctactgccgttaatcgaaaaatcgggtgcggtctacgaaggctggggaacttattttgaagatccgaacagtgatgaagatgaatatggcgatgacggcgaattttttgatgacgaagatgatgattttgatgatgaaagacgttaaccattagcagaattatgaaaataaatgataaccctatgtagaatatttaccatgtaagaatcaagtaataaggaggagcaatgctaacaaattggtcagaaggttatgttaatgatattaattatacgacaggttattacgatggattaaatagccaccaattaatttgtccattcttaatagcaaatttacagccgccaaaagtcattaatgcgtgtgagttaggttttgggtttggtgtatcgcttaatattcatgcagtagcaggaacagtaaaatggtacgggactgattttaatccttctcatgcgttctttgctcaacaattagcaaaccaaggcaatccagataaagtcgttattgcagatcaatcttttgccgaattttgtcatcgagatgacttacctgattttgattttattgctctacatggtatttggtcttggatttcaccacaaaatagagaaactatcgttgattttattcaacgtaaattaaaagtaggtggtgtagtctatattagctataacacattaccaggatgggcaggaaaatcaccaattagatatttattaaatcaatactatagtaaattatctgctactctagaatcaaaagatcaagcgattaaatcagcattagaacatacaaagaatatgctttcagtgagtaatagtctcctttctctctcaccttatttgttggaacaagttgaacagatcaaagaacaaaattctaattacgtcattcatgaatttactaatcagaattggtatccaatgtatttttcagaaattgaatcctgcttgaaacaagctaaattaagttacgcatgctccgtttcttatttagatgattttgatgaggttttatttgatgaagagcaacaaaaattattatctagcattcaagatccttctttatttcaaacagcaaaagactttattttaaataaacaattccgccgtgattattgggttaaaggaaaatctcaacttactaatcaacaaggagagaaagaatggaagaaattaaatatattacttgtttcatctacaacaaaaatttcgaccacgattaaaaactaccgacaaacggaatttaaagaagaattattaaaacctattattgaaaaattatctgattataagattcactcgttagaatctttgtgtgaagccttaaaaggggatatgcctccaaatgcattatttagaataattgccctattagtagctcgaaaagaagttgtcattactcaatcggctgaaacaatagaagcagctacaaattcctgccagaaatttaaccgagctatattggataatccttttgcttttaataacgttaactatctggcaagtcctgtgtcaggtggtgggatttattattctaatattgaattactctttttatctgcatatgtacagaaaattccagagaaacagtgggaaaaatatgtacgtactattttaacagcacataatcaactattacgtaaagatgataatattctatcttctgaagaagagatacttggagaaatatctcgtctgaagaaagaatttttagatgatagatttgaaattacaaaaagtttaaaggtggtctagcccctttttcacccaatattgatacggcttagtatctgtttgactttttaatagctgatgatccataaattgacaaaaactcggaatatcacgagtagttgcaggatcgtcagcaataattagcaacacttcaccatctgccatattgcgaatggttttgcgagtaagcattacaggttcaggacaacgtagccctagggtatctaaagtgtggttaatggttagttcggtcatcgttattattcaaaattaaaaattacaggatatatatgcaacagcttttctctcaacacatcgcacgtattcaacaaatcgtacagcacgccttagagctggctcgtcttgacgggctttggatttatgcagggcaggcaaaataccattttttagacgaccaaacatcgccatttaaaatcaatccgcattttaattatattttccctgatcctaccgcagaacaaagttggctttttttagacggtaaaaataaaccgaaactctatttttatgcaccgcaagattattggcattgtacgccaaatccaccgacatcggcattttttgctgatgagtttgaatggcaaatgctcacggatagccaacaaattcaacaatatatccttaatccgacccattgtgcctttattggtgaacaaacggagcttgccaaatcgctaggttttgagcatatcaatccacagaaaatgctaaatgtactgcattttgagcgttcgatcaaaagcgaatttgaaattgagtgcatatatcaagctcaactcaccgctttaacaggacatcacgcggcaaaagaggctttttttgcaggtaaaagtgagtttgaaattaatctagcctatcttcaagtgaccaagcaatcggataacaatgtgccttatggcaatattgttgccattaatcagcatagtgcgattttacattacacaaaattggatttcacgccaccttgcgaacgccacagttttttacttgacgctggcacaagctatcttggttatgcatctgatattactcgaacttatgcccttgatccacaaagtgaatttgcagcaatgattgctcaaatggagcagtttaaactggatacgattgctgatatgcaagtggggattaattatctaagttaccatacccaaatgcaccgttggatctcgcaaatgcttcatcagtttgagtttgtgaaattacctgctgatcaaatttttgaagagggtattagccgtactttcttcccacacggtttagggcatcagctcggcttgcaagtccacgatgttgcaggtttccaacaaaaccatcgtggcactcgtaaagctccgcctgagatttacccaagtttgcgttgcactcgtgatttagccgaaggtatggttctcaccattgagccagggttctattttattgagatgttgctaaatcaatggaaaaaccacccgcttgcacctttctttaactggcagaaaatcgacgaatttaaaggctacggcggtattcggacagaagataacattgtgatgagagcgacgggtgcagaaaacttaacggcaaaagctgaaagtatcagtagcagataagtaattattacagatcccatttagcttaaaatatctaaatgggaaattggtgtactcataaataatatttctaatctaaagaaaatagatctaataatgtggcaaagctttgcgatttcactatattgtgaaactcttcaatgtaaactttatctagatctgtttccctgattgctgcgtataaattgctatataagccattagaagtgatttttcttgcaacaacatagcctttttctaaatatggttttacagcccaataaggtaaggctgcaatacctcttttactggcaacaagctgaatgattgcgatagttaattcactagtgcgtcttgttgggtttattcctactggttgtaagatttttttcaataaatctaacatattgtcgggaacaggataatgaattagtgtttcgtgacgaaaatcttcagcttcccaaatttctttttgagccaaagggtgatctttggcacaaatagcaaccatttcataagaaaataaaggtttataaataataccaatggactcttctatttctgatacaacagcccagtctgctcggtgagcaagcaatagaccaacagtatcagtatgaaaaccagacacaatatctaattctatccccccccaattttgtctaaaaatatccattgctggcattaaccaatcaaaacaagtgtggcattcaacagcaatccgtaattctccaacttctccttgtttaattcgggttatatctgattcagcttctattattttaggtaaaatttcataagcgagctgtactaaacgttctccagctggagtaaaatggattggctgagttttacgttcaaatagagttagatcatattgatcttctaacaatttaatttgatgagataatgctgattgtgttaaatgaatacatttggcggcagctgaaacactgccgctttcttttaaagcaataatagttcgtaaatgacgaagctctaagaaaattggtttcattagtctgaattttgaatgtaacaactacaattgacctagaatagcatgtatttactatattagaaaatcgttttcctaatcagcattactttattttttattagcatgctgggttaaatacatagtttctattatctatatcattttataaatggcaaatagccttctatttaaatattacttaaaatatgaaaaaaactatttacttccataaattagcaatattactttctctatttttttcaaatgaaccgattgttgctaaacatatagcacagaaaacatgtatagttgtaggtatttatgatggcgatactttaacctgcttgcacaagcggacacaacttaaagtacgcctgcaatatattgatgccccagaatttgcccagccttttggtaataaggcgaagcaatcgttaactcaactggcatttaaaaaagaggttgaacttgagattacggggtatgataaatatcaacggctgttggcagtggtttatgatcagaggggtgaaaatcttaacttaattcaggtgcaacgaggaatggcgtgggcgtatcgccaaacacaacctgtgtatctgcaagctcaacaacttgctcaacagcaaagaataggtttatggcaagataaaaatccgatcaatcctgcggactggcgtgcaagtaagcggtcagatgaacattcattttggcaaggtttttcgcctaaggcaccgcttgccactatagattgtaatgtgaggaaaagttgtaacgatcttcccgattatgacacggcgaaacgctactttaaacaatgccgttggcgagagctagacggcaataatgatggtatcccttgtaataaactttatagaaaggctcagcgacaatgattaatcatacttttcgttcccatttccctttttttcaagataatcccgatgcggtatatttagacactgccgcaacaacactcaaaccgaaagtgttgatagacgcaacgctcaatttttatcgttcatctggttcggttcaccgtagtcaatatgattttcctcaaacgcaacgttatgaattagcaagggatttagtggcaaaacgtttcaatgttgcaacacgagatgcggttatctggacaagtggcacaacccattcacttaatttagtcgcaaatggtttagctgacagtattgaagctggtgatgaaattgtgatttctgtggcagaacatcacgctaattttattccgtggcaacaacttgctgagcgtaaacaagctagattgattgtgctaccgcttaatagcaactaccaaattgcccctgaaacgctacaaacagccttatcagaacgcactaaaatcgttgcgtttaatttggtgtcaaatgtaacaggggttaggcagcctgcagagcaattgataccgcttattcgtcagcaatgttcagccaaaattgtgcttgatgttgcacaagcggtctgttgtgaacaaattgatgtacaagcacttgatgccgatttctatgcgttctctgcacataagatgtacggaccaactggggttggcgtattaacagggaaattgagtagccttgagcaactccgccctcttttatttggcggaaaaatgttacaagagattactgagcaaaagctcacgatggcaacattgccttatcgtttagaagcaggaacaccaaatatcgcaggaattatcgcttttggtgaggtgctggagtggttggaaaaatgggatttttcagccttaaactcaccgctttatcagcttgctaaagaggctcgccaacggttagcagcttatccaaatatacgcattttagcggaagggtgtttaagcccaacgattagctttgtctttcatcatcaacatcacgcagatattgcggcgattttagccgagcaacagatcgcattgcgtagtggtgaacattgtgccaaaccctacttacgttatttagcacaaaatggcaccttgagaatatctcttgctcattacaatgtgcaagcggatcttgaccgcttttttaccgcattagattttgctctcgacattttagaaaattaatctcaacttagatcaaaaaatcgtaaatttcccgattttctgctagaacgaaagggcgttatagggtaatctttgcaagttttttgatttattttttaaaattaaatttataggtattgatatggtaaaaaaaattgcagtattaaccagtggcggcgatgcgcctggtatgaatgcagcgatccgtggtgttgtgcgtgcgggtttaagtgaaggtttagaagtgtatggtattcaagacggttattacggtttatatcacgaccgtgttatcaaacttgaacgccgttcagtgtctgaagtgatcaaccgtggcggtacattcttaggttctgcacgtttccctgaatttaaaaatccagaagtgcgtgcaaaatgtgtagaaaccttgaaaaaatatgaaattgatgcgttagtagttatcggcggtgacggctcttatatgggggcaaaactattgaccgaagaacacggcattgcgtgtatcggtctacctggcactattgataatgacgttgcaggcacggattacactatcggtttccaaacagcacttgaaaccgcattagaagcaattgaccgcttgcgtgatacttcaacttctcaccaacgcatttctatcgttgaaattatggggcgccactgtggtgatttaaccttaagtgcggcattagcaggcggttgtgaatacattatcattccagaaaaaggttttgataaagagtcactaatacgcaacatcgaagatggtttcaataaaggaaaacgtcacgcaattattgcgattacagaattaatgacagatgtacaccaattagcgagagagattgaagaacgctttggccacgaaacccgtgctgctgtgttaggccatacccaacgtggtggtgcgccttgtgcatttgaccgtattttagcttctcgtatgggcgtttatgcagtagaactcttgatgcaaggctacggtggtcgttgtgtgggtattcaaaatgaaaaattagttcaccacgatattattgatgcaatcactaatatgcgtcgtccgtttaaagaagaaatctttaatacctctagaaaattattctaataaaaagtggcgctaagccacttttttattatccgtatctttaaccaaatcactgaatgagtcggtgttctattcggctttatcccaaaatactaattgctttatttactcataggtaatttgtcaattttgtgctttaaggaaaggcaatagcaataatgcgatgccagaggctgcacaagcaatcacgacaaaaaatccggaccagtggtgtgattccatcactaatgctaaaggataaccagctatagcagcacctaaatatgcaaataatcccacaaaccctgttgctgaagctggagtttttttatgggaacattcagcagctgccataccaataagcatttgaggaccaaatacgaaaaaacctactgaaaagaaaattcctgcttgtaatatgaaattttcttttggcataagccacattgcaataatggagaaaaaaataccaatagcaaataacaatgccattggaccacgattgctagcgaataatttatctgatccccaaccagcaactagagatcctataaatcctcctacttcaaagagtgaaagtgcactattagcagaaacaagatcatagtgatatttttcagttaaatagatatttccccaatcgttaatggcagttctaaccacataaacaagagcataacttaatgctaatagccaaatgtatttattaaaaaaaacatattgatgtaagatcttattccatgtgagatatttaccttctttctcttgagcaagctctaagttatcattgcgccattttcctatgctaggtaatcccatggtttctggagtattctgtaatcgaaaaaataggaatatactgattaatattgctaagcctccagcggcgataaatccatatctccaactataatgtaaggtgagataaccaataattaatgggatcatcgctccaccaacattgtgcgcagtattccaaatagaccaccataagcctctttcatttcttgaataccaagttgttagtaacttagaacaagagggccatccccatccttgaaaccaagcattaataacccacaatatagtaaacatgagaacagagctagataggccaaataatatatttgtgattcctgtaagaaataatccataagccataaaatgtttaggattttctttatctaggtaaacacctgaaataaattttgaaataccataggttatgtagaataatgttgagattatccctatattatttttatcaatgcctaaatcagtaattagagtaggaacgacataattaaagcttttccgagtcaaatagaagccggcataaccaatatacattcctatcataatatgtagtcgccagtagtgataaattttatgactttgattttccattatttttatacgtaaggtaaattaactataagtgttgttccatgttgaattggatttttttcaataggaatagagataatttcaaatgtaccacataaaatattcactctctcttgcattccacgaattccaaatcctgttaatatctgatatgtatcaaatccaaccccgttatctgtaataataatatgtatattattttttatttcaatttctatttttaccttatttgctttagcatattttataatgttattcaaactttcttgacataatctatatatagtaatttccagaatatgttctaattttaaattttgatcatttttccatattaattcagtatcaatttgattatcttgaaaatttagttcaataaatagattctcaatagcttggggtaaatctaaatcatcaagtagacgaggtcgaattcgatttagtagtacttttgttgtatcataaatattaagagataattgctctattgtggttgatattttttcataattaggtgcaatcctttttaaaatgtttgcttgagttctaattgctgtaatattttgcccgacctcatcgtgtaattctctagagatttcttgacgaatagtttcttcagtattaatcagctgccgagttagtaatctatttttatttaattctattgataaactctggttcaagttacgctgatcttgaatcgcaagccctagaaatattcctgtgatagtttgggttgaaatagatagtaataaatcagctatagtgagattagaaaaactatgtgtagtaccaataagtgctatactattaagaaggactcctaaaaatgcaccttgccaaccatactgaaaagctaataatataatagggattgcaaggtagaataaagcaaacctatagaaggtatctggcaatttcatttgaatatagatatttaaaacaaatagtaaaatataaataaaaatgtgctttattcttaaagttaccggcttctttattagagaagaagtaagaggaagccattcagtcttaaataaaaactcattgattaaatagcaagcaggaacaatcaataccccaccagtaaaacttacaagaaatgtgaagtaaaattctgatgaggaaatggctacagcattgatcatactaattgaaactatagtgctaagttgaattgataattttttccattgatttccactatagtataaatatgataagtaaataattgggatactacatatacttaaaataaaaatagaatattgatatatttctggaaataaatagtttaataaaatcaatatactaatttcagaacaatatacaataggccagaatttaggttgaatatgcaatataataccactacgtaaggcaaacggcaaaaatagacaggccaaaacaatatctgaaagtaaataatctgagattatccataagcagaaataagaacaagttatcaaaaaccaagagtataatatagtaaatatcattttagttgtgaatttaataaattcgctaattcaacattatttttgacattgagtttatttattgcattagatctatgaacatgtactgtcttaaaactcaaattaagtttttcgcctatttcctttggttcaaaacctaagattaataactcacaaatttccctttctctttttgttaattgccctaccggattagactgtttagatgaaactaattttgtggttagttctggcattgaaatatcaataatacatacatgaggttttaaataaggtaaatgttgacgagcttctttagcagaagaaaattctccaataacagtaacgtcactctctaaagaaagaagttgagaaaaaccagagcgtacaatgacatgatcatcaataagaacaacatgaatcataaaatccttccaattaataatagcgtatttctataaaaaatacggtggaaaagtccaccgtattcttgttactcagcatattctatcttttacgaatttttttctcttctgcgattgcaacgaaggctaacaatccaatacaagtaattgctgatgcatgaagtgctgcaaaagtaccactccatccggttagaccaaaaattggagtaccgtcagcaatcattcctaatcctagttttgcaaaactatctccaattaagtaagcaaaggtaccttttacaccatcagcaacagcaattgcttttttagggacaaacccaacagcagccacgccaatcagtaattgaggaccaaatactaaaaagcctaaagcaaacaatgccgttaaatacataaattcattagttgcaaactgatagaactcaagagtaaaaacaatcagacctagggcaatacaagcggttaaggcacgacgaccatttgctaaatcagataaatatccccataagaatgtacccactaatgccccgacttcaaatagagcaaaaccggaaatagcagcatcttttgaaaatcctaattcttgataggcatatactggggaccactgatcaataccaatacgaacaatatatagaaaaatgttagcaaagcatagtagccaaataactttatttcttaatacatattgaacaaatatctgccatttggtcagttgattttcttcagtattacgatcttcctcactaatttcctccccaaataattcttccgctttacctaaaccatatgcctcaggagaatcagaaccatagcgtaatcctataaatccaataattaatgcaataattgatggaaatacaaacattccaatgacatgtccattaaagaagacattagctccgaataatgcaactccagcagctgccgcaccacctacattgtgtgataaattccagaaacccaaaaatgttcctcgtttctttctaggcgtccatttagtaattgtggagtagctagatgatccccctgtactttggaaaaagccactaagtgcatagaatgaaatcattaagaacagtgcaatgctccctcctcccatactagcactaaagccaagcatacagatagctgaaagaataagcataaatggtacaaattgttttgtatttttaccatcagcataataagagactacggttttcccaataccataagtaattgaaaaacctaagccaataagtcctaaatctgttttagttaaaccgtaagtttcgatcatatcattttgtgcgatgttgaaattcttacgaatcaagtacattgccatataaccgataaatacaactaaataagattgcataaaaggtttgaaccacattttccgtctttcttctagggatagatctaagactgggcgtctaacttcagctaaaaatgaaaacataatttcctctgatatttttaaaaagatgtttaaattttaagaaaattatttcattgctccttgagagaatcccctaaatagaataagaaaatttcctagtttagataccgttaactgtattttgtgactaagatcacattttagggtttattgtgaatttctaggaacaataacggacagatggtttttcccttcaaccttggatatttctgctataaccgcaggagaaaaatgtactctctgctgtgttagttgatagactaagtcaaagacaaggggcaagtgagagataatcagcacatgcttcgctccctcttctcgtagaaatgcaagataatcaatcactgtgtcgggatttccgtcaggggtaatctcttcccatgtttccgcaagatttgcaaaactttgcatagtgttgaccgcttgcataccttgttctacggcttgtgccgtttgctgtgtgcgaaggtaggggctaatgatcactttatctaatttaatttgttgattttcaagcctttttgcaagccattgcccttgttgatatgccatcaatttaccctgttcagttaagtttctctgtgcatcagttggggcattgaaacctgctttgccgtgtcgcatgatccaaatattcatcggtttatcctcttcgtggtttaaacagaacacttttaggcgtataatgcacggcgttttttgttgttgcaagcaacagataaaagatttctatttttcacaatttaaacaatggagtaattgaataatgtctcgtaaactcagaagaaccaaaatcgtttgtacaatgggtccagctacagatcgtggcaatacgttagaaaaaatcattgctgctggtgcaaatatggttcgtatgaacttttctcacggtgtgcctgaagatcatatctctcgtgcagaaaaagtgcgtgaaattgcaaaacgtttaggcaaacacgttgcgattttaggtgacttacaaggccctaaaatccgtgtttcaaccttcaaagaaggcaaaattttcttaaacatcggtgataaatttaccttagatgcagaattaccaaaaggcgaaggtcatcaagaagcggttggtttagactataaaaacctaccaaacgatgtcgttccaggcgatattcttttattagatgatggtaacgttcaattaaaagtgctttctattgacggcgctaaagtatttactgaagttatcgtgggcggtccattatcaaacaacaaaggtatcaacaaattaggtggcggtttatctgctccagcattaacggacaaagataaagaagatattaaacttgcagcgaaaattggcgtggattacctagcggtatctttcccacaatcaagtgcagatttaaactatgctcgtcaattagcaaaagaagcgggattagacactaaaattgtcgctaaagtagaacgtgctgaaaccgttgcaactgaagaagcaatgaacgacatcattttaggtgcagacgttattatggtggctcgtggtgacttaggtgttgaaatcggtgacgcagcattagttggcgttcagaaaaaacttatccgtcgttcacgcaaattgaaccgtgttgtaattaccgcaacgcaaatgatggaatcaatgatcaaaaagcctatgccaacccgtgcggaagtgatggacgtagcaaacgcagtattagatggtactgatgcggtaatgctttcaggtgaaacggcaaacggtgattatccagttgaaacggtaaaatcaatggcagaagtctgcttaggtgcagaaacaatgccaagcatcaatgtttcacgtcaccgtatggaagctaaatttgcaagcattgatgaagcaacggcgatgtcagcaatgtacaccgcaaaccaccttgaaggtgtttctgcaatcattgcattaacccattcaggtgaaaccgcaaaattaatgagccgtattagctctggtttaccgatctatgcactttctcgtaacgaacaagcgttaaatcgttgtgcattataccgtggtgtaacaccagttcattatgaacatgacagccgtactattgaaggtgcgaaaaaagcattatctttattaaaagcacaaggctatttaatgtctggtgatttagtgctattaactcatggtgatgagttaaaagaaggtggtacaaatacttgtcgtattcttcgtgtagaataattctactcattagcaaaaaatccacgcaaatgcgtggatttttttatgtattcaacaaaccaatacctgtgtcttctcgatttagtctaacgaatttcacctaccgaaactttagcatcggtatgtttattgccaataattcgatcttcacatttattgttttcatcacaaatagagacaacaacgctcttctcatcttctagtgtttcaggttgtagagatttaactccgaacttattattttcaactaaattactctgttcgcgagatagataagttggcttaatcccgttaagtttatctaatatcgtatttaattgacgctcattaagtcttttgatatttccttctccggctagctcatcatcaccgtagtttgttcctctcggttgctcataaaatgtaaaatcagtatttttcaacacgataggcatatctttatggctgtaataggctttagcaccatttggagctagtgcaataaccgtggcattctcaattgtagtctttgtagcatcgccaagggctaaagcaaagttagctgcatttgcatcattatccgcagaacctgtaataccaatttcaggtgaaggtttaggaccagtatttaacaaggtaatagttaaatcattttttgatttttcaccgcgtaatgttgcatttttatctgtcatcaacgtataaccttgatggcttttcaggttaattgaacttttatttcgcccttctaaatcaccaacgacatacattgttgccgctttcatttttgaactcggtgaaacattcagtttttcagccccctgaatatttaatgatgtgtgatctaaaatcgttttatctgcacttaacccaattttatggatacgatcgtaatcagattcaaaagacatatttcgatcaaaagtaacattaaattggctgtcggttaaattaatattttttgccataagattaataaaaccatcattcgtttttatattactattacgaatattaattgtcgtttctaaatggcttttaggtgttttaataacttcttgtttaattttgtcataactattatttgtagctgtccaccaatcaaatgcatataggaactcattattaatccattgacgtaaattattattgaacttccatcgtctttgagtatgatttctttctgtacgcaacgctctatctttggtattgaaaatcgcatagtcatagcttggtttttctttattataggaatatcccccataaatatagaaattacctcttcctatatgagtaagacgatcaatatcaacattattaaagccaccaacaatgacaaaatcatcaactttatcaagctgcaaattactaatatttacgctaaaaggcgatctttgagtatcttctaaacaataggcaagattaatacaagttctagaatcttctaaatttcttcttaaaccatttctgcccaatacaatagcgccattattgaaattaaatttactatctataatcttaatatctgaaatgcctttatccgcaaaatgtttatccattagatctgttgcaataaataaacgcccatttttagtatctatatttgctttattaaaacgaatatagctaggattagtataatttaattgtgtatttaataataaaactgaatcagtatctttatatgagtctatatttatatcacctgaaatatcaaaattatgtgcatttagatttacttctcctgaaatacccagtaaagaacctaaaaaattactgctgataaaagaattttcacctacttttttattaccaacatcaagattatctgccagctttagattaacttttgtttttagttttttagagccgtcatcataatagtttttatcttcccgacttaaatcaccactaagattaactttctttatagctgggtctagatagctactgactgcaaaatcaatactatctttaattgtaagttttgcacctttttcagcatttaagttaatttcattctttttcgcttttattgttaaattttcggcttgaatatcactattttttccaaatttaatatcatcagaaaataaagttatttttccagatcgagacattacaacattatccgcctgtaataagccatcgttattcacaaggttattaattaattcattttttcccttagcagttagctcaatataaccatcttcggtaataatagaacctgaatttttcacaatactatttactgtattttcttcaatatctaaatcaatagatgtcgtatctaattctaagctaaattttccgccagcgcccaagacaacttgtccagggctttcaatagtttcatcacgttcaaaatcaatccacttaaatccccaatgattaccctcataacaatcatttgcactccaaccactacaataacgacctttaacttttttctcttgtttaaagtatttagcttcaattgtccccttattttcaacatcatttccaactaaaacaacaaatgcattttcgccatttgcaacaattttaccctcattaataatttttccttcagcagttttatgatttttacgtggagtaaaattgaaattattactattactaattttttcaagatccttagttgtagcaagtaagctacctacattgatttcagcacctttggttataataactccgttagggttagcgagaaacactcgcccatttgcttgcaatttaccttgtatttgacttgcatttccgcccataacacgattataagcaatagcggttgaatcaggctgcttaaattcaacactattttgttttccaatatcaaaactttcccactcaatactcactctaggtgattcttgagtaattgtcattgtcttatttaaggtgttaatttgtgcattgccgtctgtaattttatgattttgaggtaaatctgcagcataaatatttgctgtactaagtgccgttgaaatagctatggaaagtaaagtttgtttacgcatttatgtactccttaattaaaatgttttaattgcagataaccaaaattgatttttatctacattgttatatttcttaccgataggttttgcataagcaaaattaatagaataatgattaggttcaattaaattcaaaccaacaccgatactttttaaacgaactttattttcaacagattcggataatttctcagtatttttatattgttttccaaaaccctcatcataaaagagtgagcttactagcatactttttgaaaaaacaggtaagtagtgttttagttccgcttggataatatgcccttcatcaacagaaacagtacctgcttgatatccttttacccctgataatccacctagtaggaatttatttccactatccagatttttatcagcgaattgcccactaacggcaaacgtaatactgaaggatttaggtaaaaattgctcgtgagataatgaataattaaatgtcgtaaatgtacgtttaggctggtaattctctgataaatagtgttttttctcattggtcgaatgactttctttcccaaaaatagtattgaaagaaaaataggtaacaccttcttttatactattccaagaaccactcactcctatgctagtcgtatttactttccgtttttgttgtaaatcaacagatttttgttcatctgacaatttctgatgattaaatgctaatttactatctaatcttaaacttgcagttctaatagtagggtgagtaatataaccacctaaattataagtactcccttgagcattaagatctttaaaattcgcacctaatttatattttaaatagtttgaattcacgccgactcttgtgccatatccatcaataataaaagaatagtccgctcttaagttatataaatcgaaggtgttagaagcaagcacatcaaaatgtaattcatcaccaagcccaactaagttataaattttatttcccaatgttgttctatattttccagtattatcatttccttgattatcaatggaaatatatccattccaacgtttattatctttaagattaaccgtaagatctgttttacccgtattttgtcctgctttcaaagataacgctgaggtaattcctttaatgtcattaagtaatagagctaacttttctagtttatttttaaccaaatacgaatggcttttcacagtagtattcaccatccgcataaccaagtcttcttttaaacggcttccatttctaacaactacctgatcaagcgatccctttatcacgaaaatttgcaattcaccattattaatttcttgtggtggaataaaggctttagcaacaagataattgttgtcacgatagtagttagtaatttgttgcgataaccgatttaagtcatctaaggtgatttcttgatgaagataaggagaggtaatagatgtcagattatcttgaatttcgtttccgtccaactccagtaatttgattgaatctaaacggaatttaagactttctttgttggcgggaagattctcttcctgtgttggtgttttgaacagttctccagatggttttacttttgctacttgtatctggcgtgtctgttccaactgtttgttcaatgttcctgaatctggtattggatttgcataagtaaagccagatacacatgaaataatgattccagtaattacattttttctatggaaatgtttcattttgataggtctcctttattaataatgtattagaacgctttttctattcatttttaactaaatgataagaattatcaatatcattattgataatttacattatcttttgtaggatatttattagtcagactaaaggagcaactaaaatgagactatcaaaaatttatacagcactctttctctctttgcctaccgtatcccttgcagatagcaatgtttcagctgaactcgctgaaatctctgtgattgcaagtagggatgcatttcactgggcaaatcacacaagtgagaaagcaaccctaaataaaaaccaattattaactcaacaacccataagtacagcggatgcgattaaaaggattacaaacgtggatattgctggcggatcaaggggaattgcacaaaagccgattattcggggcttaagtggtaatcgtgttgttcaagtgattgatggcgttcgccagaattttgacttatctcaccgtggttcatattttttacctatggcactaacccaagaaatagaggtgattaaaggtcctacaagtactttatggggcagcggtgcattagggggaattgttgcgatcagaacaccaaatgcacttgatttattaaaagataatcaacaaattggagcaaaaattcatcaaggatatcaatctgccaattctctctctgaaacagatgtcagtgtctttgctgcaaatgagaagtttgatggactagtgagtggcttttataaccacgctgatgatttgcgtttagcagacagtaaaaaattagtagacagtcgctatactcaaaaaggcggactttttaaatttggttggcaaattaatgatgaaaatcgccttgagctttctcatcgtttaagtcattttgaacaaattgccccaactaacaatgaagttgctgaagaatttaccgaccaagatgtgataaaacttattggaaactggcaccgaaataatctaaatgctgctcctaccgagatgtctgctttctatgaaggactcacatcagtacttggaagtgtaagttatcgagctaaacaaaaaatcacagaccaaagtagcgcactacactactactttaaccctaaagataatgattatatcaatagccaattaacactatatcgtaacagcacaaaagaaaaagaacagcgtattgcaagcggtttgcaagatcaaactagactcagctctgtgggtttaagcatacgcaattcgacggatctaaattggttagccctaaactacggtgttgattttatgtcagatcgtgtagtaacacagcgtgaaaaaaatgccactaccccattccgcccgaataattatgatgctaaatctaaaaacagtgcattttatcttttaacacatattccattatggaatgaacgcattattgtttcgccaagcgttcgttatgatcattttaaaacgcaaagcgacgaagccaaatatagtgcaagtcgttggtctccatcaatcgcagcgacttggaaagcaacggattggctagatctaagtactcgttataatgaagctttccgtacgccatcaatgcaagaacgttttgttagcggctctcactttggtacaaatttaatgggacgctcatttaataatacctttgtaagtaatccaaacttacgcccagaaaccgcgaaaaataaagaaattgctgcgaaagttcattttgacaatctctttgtgcatcaagataaattcatcttcaatgccacttatttccaaaatgatgtcaaagattttattcatcttgatattttccgtgcttcaccaatagagatgattccatctctctcacagtatcgaaatgtagaaaatgctcgcttaacaggatttgagctagaatttgcttaccagcaagaacgtttagcattgggattgaattatgctcaaacaaaaggcaaaaatcgccagacacaggaagccttatccaatattccagcgaataaattaggctttactattgattacgcgatagtgcctcaaacatttatggttggagcgaatatcactcactatgcaagtcagaaacgagtgcctaaaacacacgcaatgacttatccaagttatactctcacagatttaaaagcaagttacaccccttctggcgaatggcgtaatttacgtttggatatgatgatcgagaatgtctttgataaaaaattccaacctgcatttagcttaatggaaggggctgggcgcaatattaaattgaacgcttcttatcagttctgatttttaacaaatattgtcttaaaaaatccacgcaaatgcgtggatttttttatatactgcttccatcaatttctatcaaaattttgcttatgttatccctactttatgccttaaaaacggagaatgtgatttctgaattaaactatcaatttgcaaagatgattgatcagaaacagcaggattataactatacagctcaacagcagaatttagctatctttctgagtgcattagtttcttttaatgtgatacaaggacatagttgtgttcgtttaaattctgatttaacaaccaatccttttggcttgcaaaaaaagaatttcagcagtgattttcatacggagattttgcaaaaaattgagggaatttcaccgcttaagtggcagtcgttgctacataaccatattgcttttagccaagatcctacacaggttgcccctttattatttcaacaggggcggctgtatttttatcgctattggcaggcagagtatcgtatagcacactatttacaacacgcggtaagtttggatttaaaaaaagcagatatcgatcttcatcgtcaaattctacaacgcttttttccaaaacaagctgacacggattggcaaaaagttgctgttgcaacggcattaactaaacgcttctgtctgatttcaggcggtccaggtacaggcaaaacccgaacagttgccattttacttgcagcattacagcttaaacagttaaaacagaaccaaccgctttttaagattgcccttgctgctccgacaggaaaagctgccgctcgtttaaaagaagctatttcaaataatctcgctagccttgatattcctgacagtttgaaagcagaagtaccaaccagagcctcaacaatccattcgttaatcggcattaatccccatagtgatctacctcgtcatcacgctcaaaatccactgcatttagatctgttagtcgtggacgaagcgtcaatgatcgatctcttcatactggaaaaactgttgaatgccttaaaaccagatacccgtttgattatgcttggggataaagatcaacttgcttctgtagaagctggaaatttaatgggggagttgggtagtttgatcagatttggttatagcaatgagcatagtgactatctaactgaggtaacagaacatcaaatttatcctacagtggaaaatgtcccagcaatttgtaattcattatgtcatcttcgtcgaagttttcgttttgacgaaaattcagggattgggcagttagctaaacaagtgaacacccaacaagcggtgaaatcgtggcagattttaacgaatagggcttatgatgatttaacattagcgtgttaccctaaagtcacggattttcctgaaaaatcacaatggatacaacactgtgtaaatagcgtggtagaaaaagcggtggagttatattccgattacttgaacaaagtgaaagctcgagtactttccccagaagccgtgtctatcggtgagatatttaaagcattccaacaagtacgctttttgtcagccttacgcgtcagtgaattgggcgtagaacgattaaatcaaaccattgcagaagccttattacaagcacgtttattacattttaaacatagccgagacagctacattggcaagccaattttgattaccgaaaatgcccctcaacttcatatctttagtggtgatattggcttaattcttccagatgaagcaggaagattgagagtatattttgaaacagaacaaaatggaaaacatttagacatttcccttagtcgtttgccaagttatgaacccgcctatgtaatgaccgtgcataaatcacaaggttctgaatttgatcatactttattggtaatgccactttctcattcgccagtattaacaaaagaactgatttatacggcgattacccgtgctaaaaaacagtttaccttgtttagtgaagaaaaaatttggaaacaagcagtaaaagcagaaattcaacgacaaagtggattaaaagaacaaatattggcagatattttaatgaaatgatttggaataagtggactataatccacagaaatactttagaagatgttaatggcaaattgcagaaaattctgtttcacattagaatagggtacatattcttattgatcaatgaggaaaaacatggaaactatagaaaaaatccaaaaacaaatcagcgagaatcctattcttctttatatgaaaggctctcctaaattcccatcctgtggcttttctgctcgtgcttcagaagctattgtaaattgccaagttccatttgggtatgttgatgttttatcgaatccagatattcgagctgaattaccaaaatacgcaaattggccaacatttcctcaattatgggtagatggagaattaattggtggttgtgatattgttctcgaaatgttccaaaaaggtgaattgcagaccttgttgaaagatactgcaaaaaaatattctctatagcgtctaacaatcacattattttgcagagcttgttgtataaaacagctctgccctcaattaacttcttgattttctttcaattactgatcatagtatcgctctataatacttatttcaaataatacttaattttggcatcatgattaaacgtctcatttaattagagattattcctttctatactttttaattatttgttaaaaaattagagctatatcacaatattcctcccaaaatttaggtagaataccgatgatttcatttattcaattgtataaaggacacaactatggatgacaaatctcaattacgccaagcagcacttgatttccacgaatttcctatccctggtaaaattgaagttaccccgactaaatctctcgcaacgcaacgtgatcttgcattagcttattcaccaggggttgcagagccttgtttagaaattgaaaaagacccagcggctgcctatcgttatacttcaaaaggtaacttagttgccgtgatttcaaacggaactgccgtgttaggtttaggcaatatcggtgcattagcaggtaagcctgtgatggaagggaagggcgttctgtttaagaaatttgcaggaattgatgtatttgacatcgaaattaatgagaaagatcctgaaaaattagttgaaattatcgcttctcttgaacctacctttggtggtatcaatcttgaagatattaaagcaccagaatgtttttatatcgaacaaaaattgcgtgaacgattgaacattcctgtattccacgatgatcagcacggtactgcaattatcagtgctgcagcagtgattaatgcgttgcgtattgtggataaaaaaattgaagaggtgcgtttagttgcatcaggtgcaggggcggcttctattgcttgcttgaacttgcttgtatccttaggtatgaagcgtgaaaatatcgttgtctgcgactcaaaaggggtgatctataaagatcgtgacgatcgtatggacgacaccaagaaacattattcgattgatgataatggctggcggacattaggcgatgcgatgccaaatgcagatattttcttaggctgttctgcggcgggtgctttaacgcaggatatggttagaacaatggcggctcacccgattatcttagcattagctaacccaaatccagaaattacacctccagaagcgaaagctgctcgtccagatgcgattgtctgtacaggacgttcagactatccaaaccaagttaataacgtactttgtttcccattcattttccgtggtgctttagacgtaggggcaacaacgatcaatgaagagatgaaacgtgcggcggtttatgcgattgctgatttagcccttgcagagcaaaatgaggtggtcacttctgcctatggtggagaggggacaacctttggtgcggattatattatcccacgtccatttgaccctcgtttaattgtacgcattgccccagcagttgcaaaagcagctatggaatcaggcgttgccactcgtccgattacggattgggaagcctaccacgagaaattaactcagttcgtctataaaaccaacctctttatgaagccgattttcagccaagcaaaagcagagaaaaaacgtatcgtgcttgcagaaggggaagaggacaaagtattacacgcaacacaagaagtggtttctatgggcttggcatatccagtcttaattggacgtacggaaattattaaagccaaaatcaaaaaattgggactacatatcgttgcagggcaagattttgatgttattgataatgaacataacagccaacacgatgagttatggaaacgttattacagcataatgaaacgcaaagggattaccgaagcgatagctaaacgtgttgtaacctcaaatacaacagtcattgcttcattgctcgttgaaatgggttatgctgatggattagtgtgtggcttgtttggcacatatagtcgccatttagaagctattcgtgacattattggtgtaaaagaaagcgtaaaagtacccgctgcattaaacagtttggttttaccgacaggaaacgtttttattactgatacctatgttaatgcagatccaacggcggaagaactcgctgaaattaccttaatggcagcaagagaaattcgtcgttttggtattgagcctgcggtggcattgctttcacactctaattttggttcatcaaatcaactaggtgcaccaaaaatgcgtaaagtgttagaaattgtgagagagcgagatcctgccttgatgattgatggtgaaatgcacggcgatttagccttatcggaaaaattacgccgtgattatatgccagatagtccattaaaaggttcagcaaatttacttgtaatgccaaatatggaagcagctcgtatcagctataacctattaagagcaacgacaacagcaattactgtagggcctattttattaggtatgaataagtctgcacatattcttaaccctgtatcctctgttcgccgtatcatcaatatggtggcgttcgcggcagtgaaagcctagtaaaaatgaaatgagcgtgatttttcacgctcatttgcttcttattcctcaagtgtttttctaaaattgtttttgatgattacggctgccttgtttttataatcgctttggattctttatccatgataacttcaattttatgatctacaaccacattcatattaatcgtaataccttcaggtggtgtttcaagtcgcactttgggagtgcaagcggtcaaatttaagcaaaaaattgtaaaaagtgagtatatagctttcattcttagaagggatttgatttattaggtttatcttatttaatcatcttttttctttaacaatgaaataatctctttcaaagcaatgatttcttcatttttctgagccaacatctcgtctttatgggcaatagtgagttttagtttttcaatttcggcagtgagattttcaggatttccataatagttagtattattagcgtgttcattcattaaaaagagaacgccttttccctcacaattcatcaactccaacacatcaatattaaaaatttgagcgatttgttcgagtttatgcaaattgagcttagtttcaccacgttcaattttagcgtaaccattagtggacatattcattttttcagccatttcttcctgtgaccactgattcatttcacgcaccatacggattttcccatttacactcacaaatcgtccctctctttctttttccacccacaaattgagtggatttcccacacagtttgttgttagtagaatgtgaagcctacttttaaaatagctcgtattttacacatattttccctaaataacacattaaaatgaggtctttctatgcgtttgtcagttaaaacaacagctatggcgattttagtttcattaggagtaacggcttgtggttcaggcggtggtggcggaggctcatctacatcaacgaataatccagatcaagcaaagcaaattgaagccttaaaaagacaggtggaagctgagcaacaagcggttaaaaatgcacaaactagtgcaaatgaagcagccgaaaaagtaaaaactgtagaagcagctaaagcaaaagcggaggctgaattggcaaaagcactgcaagctttaaaagatgctgaaaatgcaactgcagaagaaaaagcgaaagctcaatcggctgcagataaagcggctaaagatttagctgaagctcaagacaaaattgcgtcattggaagaagaattagctcctataagagccgaagcagaaagaaaacgcttagaagcggaagaagaagctaaaaaatgggcatttttaacccaaagtggagaatggcgacatatagcaagaggtgatggtttaaaaggatatgccgaacatgcttatattgatggaaaagcatggtatctttacccaatcggggcatctgagagcttagttttacaaaatgggattgattttaataaaaatacaatttccaaccatgtacagattttacctgtatatgcaagtcgccaatcaatttctggtgaaaaacaaacattccaagttgctaacgttcattttattaaccaagaatattctacgtatttaaattggtcttatcctgataatataagtgacgatgatttgagaagatcagcaggttatgtcgctttgccgacatctcaaaattcagaatatattaaaacccctgtaatcgcaacttatcaaggtaaagcattaggaatagaaaactataatgtagatacaaaaaatgtatatgaaggagaattttctttaattgcagattttaaaaatgaaagtgtaaaagggaatatagccaatctaaatggtaaaaattatgtcttggaaaagggaaatataaatatttcagatcaaggaaatcttattttctctggaaaagtagataataatctagattataaaggtgttttttctggacctaatgcagaagaagtcgttggaaccgctgggacaaatattagctttggtggcaaacgtcaataattaatcgtaggcgggttctccccgcctaaaatctaagctattgcagaaatgcctttatgttgtactaaagaaagcagtttcagtgcggcaccacttggttttttgacacctcgttcccattcggaaactaggttgctacttacatttaagtagtgagcaaagacagattgagaaaaattttctttctctcggatttctcgaatctcattgggagtgagcgttttaactggcgttaaacaacgtttgtcaaaactctgcattgttgttttatcaaccaaaccaatgtcgtgtaaatcactcatcaattcgtggatcgctgcatttgccggactgttgtattgtctcattagatacctctataaatgctttgccatcaagggcttgttgaatttgttcagggctaaatgccaaaatggttttggctgctgctttaaagttttcttcttcatcagcagtaatattagtccgatcattcttatcaaatccataaacaaataggctaaattctgcaaatttgtacacaatgatagaacgataacctttagatttgcctctgccctgtttgggtaaacgctgtttgataacacctgaacctaaatcggcatcaatcagaccattttcaatgtcgttaatggcatttcttaacgtgtcgtctgaaatacgttctttacgggcaaatttatcaaaatgtttagatttaaaaattcgcattaaatttataccactatcatctttagcgtgatagtaaaaaaatgaacagaaaaagtcaataaatctatcttatgaaaaaatatctcccccttaccctttttatccccctagtagcaaacgcaacccccgaattagaaatcaaatccgccgagcctacattaccaaaacaagcggttattttttcagaaaaatccgcaaatagtgaggaagtcactttaactaaagagcttattagtaagcctgaactgactcgtcaaatgttaaatcgggcgattgatagccgacaatttcatttattgcctgaattggtgcggatttatcaacaaacgcctaatcccgatttggtgctgatcgattatgccaacggcattattttggcaagtcagggggattataaaacggcaattgatctctatcgtggcattattgcgaagcaccctaattttcagcctgtgcgttttcgtttggcacaaatgttgtttgaagatcggcaaaatgaagccgcacttgcacaatttcgtaagctacaagcggacggattaccgccacagattgcaaatggggtggaacaatatattgctgccattcaaaaacgttcggattggtctttcgactttggcattaattatttgcacgaaagcaatgttaataatgcctcaagctcgccttatgttcgagtggggaatgtgccgtttaagaaaacggaagaatcattaccgcaatcagcaaatgggttgagctaccatctgaatttggctaagaattggaatgttagcggatcccattatctacattttgagaaccaatttagtggaaaatcctattgggataatcatcaatttgacgatcagcaaaaccgttcaagtcttggctatcaatatcaaaatgctcaaagtcgtcttgcttttttgccttattatgaaatgcgttggtatggtaatcatcgctataatcacggctatggcgttcggggagaagtagagcattggcttacatcacaatggcagctttctacggctggcgaaatgggcaagctcaaacatcggggcgaaaatcagcttgcagatagcacaacattatttggttctgctacgctactctatgcctttgatgcgaaaagttatctctatggtggtgtagatttgttgcgagatcggacgttagaacgttctttagcctcaaaacgttatacagggcgaattggttgggggcaagaatggtggggcggaatttccagccgtattcagctcagttatggcaaacgtgaatttgaccaagctcaccgcatttttaatcagatacgcaaagatagagagttaggtttgaatgttacactttggcatcgtaacctgcatttttggggaattacaccgaaaatcagctatcaatatcagcgagtgaactcaaatttagtggatctttattcgtataaacgaaatcgagtttatttgagttttgagaaaagtttctagtaaataagtggcttagataattctgagcccttagcatgtactgagtgcggttattgtttatctaattgtttatagattgagtgctcaatattctgctcaaactgagaaccgtagttaatcaatttccacaggtcgaacatattctctttatggttataattcaaattgactttcgcttgtttatgctcagtcaatctagaatggattttagctgataaatccatatcgcctttactgtctaaattcaccgttgcggtgaaatcgtcaatctcacttttattgaccatataagccaaaatctgttccgtatagcccccttgtttaatcgcttcaagcaattcaggggtaaattttaggtaagatctatccgcttgtgtcaatgtgccattgcagatgtagcaaggtttacccgacagccaaaacggaaagataccgttgaatttgccagttaaatccagttggtgatactgtgccaattctaaaatacgttcaaaacgaatatcaaacagctttaaataagcgattttcgtttgtggcagggcaaaatgttcgatatttaaacgcccatcaagcaaatttaaacttaactctcgtaaaaacaggggcttacgcttggtgtagggtaagtgcccttgaatttttactttaacattggttatcggaatacccatattcacttcatcaatattcacatcaagggcttttttcacgccgatatccacttcaccctgtttgtattgataagggagtgagaaatcaatgcccttgatctcaccgtttggtagagaaactgcaccgttgcgaatagcaaaatgcccgccagccatcagcccacgagccgcattcgcactaaatgccgtttcgcctttaatggttccgtttgtgatgacccattgatttctaaagggaaaaaggctttggaatacatttgcaggttgctccgaccaatacaatttgccgattaagtcactggcattattggttaattttcggcgagcaaagagcttaatcgggccgagtttattcgccgtcacatcgcccctaaagttaagattttccacttcgccgtaaaaatttaagtgtgccgttggcttttctaaagtgccaccataggcaaaattaatctgcggagaaaagagttttattcccccagtgagatgaaatttatcgtaatcaaagttaatcggctcattcaaaaccagctctgttttgggaatggataccccatttttaccaatctgttccagactgcctttaaattcagatagttgcactaaatctttatgccacacaccacgcccagacaccgcaagcggtcggtttaaggcttttatttgcgaactgccccaaaaacgccaattccattgatctttcaccgcttttttatcggttggatcttggaaaaagtgtaatgctcccgctttgaaattgttggcataaccgtccaaccgcatttcgatatttttaaagtcggggctttcaccacggaaaatcgcttgcaaacgcccgtgaataccttgtttatcgacccgcacgcccgccaggggaaaacgtaaatcgttgatggtaagaaagcgttcagtcccagttagacgtaacaaagcaccttgcaaaaagcgtaaggtgagatcatcaaattttccccttacatctaaaggaatagtgctatataaaatatgctcaccttgtttgatattacctgtaatttgtagtggcaaaatcaaactgtcttgctgaatttccccttgtggactactgatcacaacattgcctttccctttggcattttgagtaagtaagctgatacgcaccgccgtttttatcggataaagctcatctaaggaaaaacggttaggactaatcgtagttgtcagatatgcattgagcggaaaatcatttgagagttgccaatcaattttccctttttcaatcgtcagactttgcgtatcaaaatgaaacggcaagttgaactgattttcaggtgttatggcggaatttaactgccaatttccgtgaagttgttgatcttgtttataccagttgagcgttgaatgtccttgttgcaaacttggttccgcaatcaaggcttcaggcaaatgccactgataattcaagctaagttgctggggcaatgctagaaaatgttcatctaactgagcagaaagtgttacgtgatgttgctcatcattatttggttgatagctaagttgtgtggtgagttgctgatttgcaaaatttgcgtcaaatgtgaccgcttgttgcttaatataagcggtcagtttttgctgaaaaaatgcaaatttaatttcacttggtgattgcagtaatcccttcaaacgttcgtgcatttcgttgggaagatttttccacgccaaagatttgatttctatgtcaccttctggcagtaacgcaaggatcgttttaatggtttctgtgggatcggtttggcttttttccgatttaggaaaaagagatacgcaggcgtaatcaacagtcgcttgattaagacgaatagattgttcatcaagccattgcaccgaaaggctctctgccgaaataatcggacaatgttgatagtaaatagtaaattgtggcaggattactttttctaaatgtggctcaataccatagggtgtttctattttccagcccgttggcaatacaagattaatcgcagaagctaattgagagcctgaaagcaacgatgcaccgccagccattaaaatggcaagtgccgcaccgataatcaataggcttctgcgtaacatttagagaatatttgttaatggataaagcattgcaaggaaggtagcgaccgtccaagcggttggatttttgatgttttttccctgtttgccgagtagcaaccaagctaacatcatcaaaatcacaaactgaaccccaaagaagataaagtaaggataaatcaccatctcaggcataatcgcaagttgttgatataacacgaaaatcacccaaacatagttgatgattaataccataagtgctaacaataccaacagttttaaaaagccttccaaacggcttttcgctagcattaaataccaaccgcttaataaaataccgagtaaaatctgggcaaaattattggctctaatccagttaaacagcgacggtacttcataccaataaatcagcaaatattgcagcataccaatggcggtgatgcctaagccacaataaattaccgtacgataaatctctttatctttaggtaatttccaatagataaacggcagaataacagaagcaaatccagcgactaatgcaggcgaatgcttcggggtaaagacaagagaatagagaaaattacccaccgcaaagaccaagaaccaaggcagaatagccattaaacgccctttctgccctgggcaaatttgccctttccatagtaccacgaagctaatcaaacaaacgctaaaaaaggtgagcagataaggcgaaacaaagattgcattttgtggtgcaaaatagtgattgagtgacatttcaatcaataacatcgtcaccaacggcaaaatagcgtgcgtggcgatttctaatttagaaggtgtatcgtgatcgtgagccatagtttcaattcaaaaatgattttagggcgagattatgccataatattggcacttttttctatttttaagaggattttacgatgcgaattttacatacaatgttgcgagtaggaaacctagaacgttctatcaaattttacacagaagtgcttggtatgcgtttattacgcaccagcgagaatgagcaatataaatatacccttgcatttttaggctatgcagatgaaagtgaaagtgccgtgcttgagctgacttataactggggagttgagagctatgaattaggcactgcctacggacacatcgctatcggtgtagatgatatttacgcaacggttgaagcggttcgtcaagctggtggaaaagtcactcgtgaggctggtcctgtgttaggtggtagaaccgtgattgcgtttgtggaagatcctgacggttacaaaatcgaattcatcgctaacaaagatgcacaaaaggcgttaggttaatggctgaaacagaagcaaccaattacaatctattgaaaaatcgctttcgtggctatcttcctgttgtggttgatgtcgaaacggggggattaaatgctcaaacggacgcattgttagaaattgcggcgattacactaaaaatggacgacgatggctatttgcatttagatgaaaaatttcatcgccacgttaaaccttttgaaaatgccaatatcaatccagaggcattaaaagtaaatggaattgatgtagataatgcagagcgtggtgctgtgccagaagatgttgccattaccgagatgtttaaaatggtacgcaaagcggtaaaagacaacggctgccaacgtgctgtgattgtggcacacaatgcgacttttgatcaggcatttctacaagcggcggtaaaacgcattaatgccaaacgagatccgttccacccttttgcaatgtttgatactgcaaccttggctggttttatgtatggacaaacggtcttagtcaaagcttgccaaatggcacaaattccttttgacggcaaacaagcccattctgccttgtacgatacggaacgcactgcagagctgttttgtgcaatggtgaataagttgaaggatttgggtgggtttcccgatttaaaggctagaatgtagtaaaaggtgagaaattagaggcgcagcttaatttctcactgctattatacttaaatatactatttgcgatatttcccagccattgcctgataaatggcattctcatttttgagcagggtatatttattttcaagcaacgaaagctctgagctacgttcggtgttcattgcacttagccattcacgcaattcagagataccttgatcgtagcggtttttataatatccgctgatttttctatcgtactcatattttttctgtaaattcgcatagccactttttgacagttggtaagtggaatagtaggtgtcgatttcatttaatgcggttgttactgtctgttcatagttcaatttagccagcttataaccctcttctgaaatcttaatgttattttgtactctgttccaatctaagaacggcaaatcaaaagacactacgccaccagcgacagggttatctgacgtattgttaaacttcgtcgaacttcctgttaggcttccccctaacgtgaccgttgggaaccagctattttcagttgcagtaaggtttttaaatgccccttgtaaacgctgtaagcttgccagtacatctgggcgattagcaatggttgaaacaggaacattcacatcaacatcttgtaatttgaccttaagaatactcggataattgactacaagcggttcgttcggttttaaatttagcaaattacgcaaaacttgctcactggatttttgagccgattgtaagttgattaaggtattttgtgcagaaagcaccgcttgcattgattgatctacgctaagctggtcgattaatccctgtttgaatttattgcttaaaatgcggttgatctgctcatagctttttatgctttgttgagtaatgcggattgcgtcttgataataggcaagattgtaatagctactcacaacggcattaattaaagataatctcgccgcttgtaaatctttttgggtagctttgtgttcccattctgccgcacttgcggtatctcttaaacgcccccataaatcaagggtataacttaggtttaagctaatttgatgtccaatacttgatgtgccagtcgagtttaggttactgctagaaccaacaccttttgaagcagaagatttttccgaagcagtgaaagttgggactaaatttgcacccactaagtttgcgttatataaggctttattcacagaaatagctgtttttgccaaattgatattattgccaagtgccgtttcaactaagcggttaagctgagtatcattatagcctaaccaccattgctcattgatttgatattgtttggtaatatcttgatattgtttataatcttgctgtgctttttgtagagagccatcgttgctcatattggtacaagctgaaagtaccagtgcagaaagtaatgtaaaagtaagttttgacactttcattagaaattccttgattaaaaaatgatggggcgtattttaaagaaaacgccccatttcgactagctctaaactgaacgatcattcattttttgcaaaaatttacataatgtattgacttgttgatcaatttctatcgttatataattttaaatataatgattttgtcttaatcacagaagctagattatgaaaaaatttctttctgcattcgctttattggcgtttgtgacaagtggtgtgtctgccaatgagcagccgatcagtacccattttggcaatttacccaaagctgagcatgtacaaaaaattaaatggaacagcttttgcaatggaaccctgacatcatttttacgcaatttactgatattgagtttgctcttattactggctattttgttttcgcttaatctcggaaagtatccgatttcgccaacagcagtgtggcaagcggtcgtttgtgctttctctgttgaatgcgaaaccaaccaaattcaaacggtgttatggcatattcgagtaccacggattattgttgcttgcttagtcggggctgcactagcttgtgcaggggcaatctatcaggggatgtttaaaaacccgttggtttctcccgatattttaggtgtatcggtaggggctggtttgggggcttcgttggcgattttttgcaatttgccgatgtggtatgtgcaactttttgcatttgtcggcggtattagtgcggtattgttggtaactgtgatactggaaacgaaaaacctaacgattggctatgccagtcagcctttgatctcagggatcgattttcgtctgggaacaaatgacatctgctgtgtgttaggggcaaatggggcagggaaagtacctttttacgtacgttattgggtactcaagcaaaattgcacggggaaattttctttgcaaaccaaccgcttgttacctattcaccacaacagttagcccaacaaattgcctatgtgccgcaagcgcatcaaagtttatttccctttacagcacgccgattaccttgcagatagcgttgtgattttagataagcaacatcagccagcctttcaacaagggaaaaaagccgatatgcttactcttcatcaattagccaaaacctatcgtattgatatggcaagtttggctcaacatttaccttttaaggaataacatgaattcattctacgacattgattttgctcaactttataaacaacatctgattgcatgtcgttatcatgatgttaccgctgagaaatgggataagaaagcggttagatttgccgaaacttttgttgaaaaagagaacagttatacccgtcaatttctagataaaatgaagattgaaccgacagatagtgtattggatattggctcagagccgggaacgcttgccattcccctagcccgtttatgcaaacaagtttacgccttttatatctatctgttaaaccgtctttatcagcgtggtattcaggcagaactgacttttttacagggagaaacagggggctttcaaggggaaacataccaagatctgcaaaatgccgtagagttttcgctagggacattaaccgaactagaacgacaaaaattacaggctttctatcagcaaaaacagcaatctcaacaaaaaatcagccacgatcaagcccgttgggcgtttatttcgtggcaggtgtagaatatcgacaaatataagcggtgtgattttgcagaattttctatataacctaattgcgatggtataaagaaaaagtcttcaccctagctcaaatcctgagacattcctttaagagaatatatcaggatttccaaaacaatattgccctaattacatgttcaatactttcattttgcatattaaaaaacagtggcaatctcactaaccgctcgctctctttagtcgtccatttgtcttctccacaaaatcggccaaactgctgccctgcagggcttgaatataatggcacataatggaagaccgtcaaaattccttttgatttcattgcattaataaaatccgttcgcaccttgagattttgccattttatataaaacagatgggcatttgcttggcactcttggggaatgtagggcaattccacaatccctttctctgccaaaggctgtaatgcgtcaaaataacattgccaaatcatctgccgtttttgttggatttgttctaacccttgtaactgagcataaaggtaagccgcttgtatttctgacattaaaaaacttgagccgagatctcgccaactatacttatctacttcgccacgaaaaaattgctgacgatctgtgcctttttctcgaataatttcagcacgagcggtcagttcaggctgattaatgacaatcgccccgccttctccccctgcggtgatatttttcgtttcgtggaaactgtaacagccaatatgcccaatcgtgccaagtgctttccctttataaaacgcattaatcccttgagccgcatcttctaccacccataagcgatatttctgtgccaatgccataatgctatccatttcacacgccacacccgcataatgtacagggacaattaccttcgttttgggggtaatcgcttgttctatcaaggcttcatcgatattcatcgtatccggtcgaacatctacaaacacgattttcgccccacgcagtgcaaaggcatttgccgtagaaacaaaggtatagcttggcataatcacttcatcacccgattgaatatcaagtaaaatcgctgccatttctagcgccgccgtacaagaaggtgtcagtaacactttatgtgcgtgaaaccgttgttcaagccattgctcacatagacgggtaaagtgaccatctccagatagcttatctgaacagatcgcttgctggatataatttagctctgtacctaatacaggcggttggttaaaaggaatgttttgcatcatcgataaaaccaataataagtgccgctgatttttccgtttaagcgttgataaagccgaattgcagctaaattgctcagctgggtggtaatcaccattttcgtcgcttgctgacgtttcgcccaagcgatcgcattcattaataagcgatagctaaccccctgcttccgccatttttctgcgaccgccaacaagccaatatgtgccgtagtctcttttactcgaagggtaatcatcccttgtatttcaccgcttgtggcttcactgagtaaacaaatatcgtcaaattctcccttaactgcatttttaatccattgccaataaaatcgacgattttctaacaatgaaaaccaaggcgaacgaaaacgcgtttgtgaaaacaaatgcgaaaagggttcaagttgaaccaaatcctgttccgttgccacacgacaagcggtcagttcaggtgaaaaatgtgcaagatcatattcaaaaacaatctcaccttctacaaactgaaaatcttgctgctgcacccaagctatttccgttattgcccagcttggcaattttgtttgaatgagagagaaatcagcgagaactaaatccgagttgctccctttactaataagatccagatcagcgatatttcgaccaaaaaaattagaaagccaaaggtgcttatacatttttcctctcttattcattaattatctttcacatatttaaactaggctgattttagtcatgttttttcattatattgaataggagcaaacatatatccgatattttttattgtacgttatatattgataagtgacgataaaataatttacacattcaatctagccaaaagttttgtaaataggtacaatcaaacgcttgcattttattaacatttgcgaagaaaaatttaactttggagaacgttatgtcgtggaacgaatcaggcaatcagcaagatccttggggtaaaccggggcaaaagaagcctgaacaagaacaaccttcgggtcaagaaaaagagcctaataagcaatcaaatgaaccgcaaccacctgatttagaagaagtttttaatagtttattgaaaaaaatgggtggtggtagaggcaatggctcaaaccaaaataaccgtccgcctgtttctgcagggaaattcttgcctgtcttactcggcttaggcttagtggtatggggagcttcggggttctatactgttcaagaagcagaacgtggtgtagttactcgtttcggtaaattacacgaaattgttttacctggtctaaactggaaaccaacttttattgataatgtaacgccagtgaatattgagcgtgtgttagaactgagaactaacggctctatgctgacccaagatgaaaatatggtgttggtagaaatgactgttcaataccgtattgaagatcctgcgaaatatctctttagcgtaactaagcctgatgatagcttgaaacaagcgaccgacagtgcgttgcgttatgtgatcggacatatgacaatggacgacattctaaccacagggcgtgcgattgtgcgtgaaaaaacgtggaatgctttgcgtgatattatcaaaaattatgatatgggattattgatcactgacgtgaacttccaatacgcacgtccaccagaagaagtaaaagcggcatttgatgatgcaatcaaagctcaagaagatgaacagcgtttaattcgtgaagccgaagcctacgcaagagggcaagagccaattgctcgtggtcaagcacaacgtattttagagcaagcaaatgcctacaaagagcaagttgtgttaaatgctcgaggtgaagtacaacgctttattcaattattgcctgaatataaagccgcaccagaagtcactcgtgaccgcttgtatattcaaacaatggaaaaagtgatgaaaaatacaccgaagttaatggtagatagctcaaacggcaataatctaacggtgttacctattgatagattgatggctaaatcaacgacaaatgaagcggtaaaaacactatcatcacaacctgttattcaacaacagccacaacttgctcaacctgtcagcccggcacaattgccagcggtggaacagagtgagcctgtgcgtaaagggagattttaagaatgcgtaaattacttttacctgtgctatccgttgttgcatttatccttttccaatcggttgtcgtagtacaagaaggtcagcgaggcattatgttgcgtttcaacaaagtgcatcgtgatgccgataataaagtgattgtgtatgaaccaggtttacactttaaagtgcctgttatcgatcagctaaaaaccttagatgctcgtattcaaacccttgatggacaagaagaccgctttgtcaccgtcgagaaaaaagacttgctggtggactcttatgtgaaatggaaaatcagcgattttggtcaattctatacttcaactggtggcgatacacaaaaagcttcaaccttattacaacgtaaagtcaatgaccgtttacgttcagaaatcggttctcgtacaatcaaggacatcgtttcaggctctcgtggcgagctgatggctggtgctcaaaaagccttaaatgacggcgaagatggtgcagaacgtttagggattgaagtggttgatgtgcgtgtaaaacagatcaacttaccaaatgaagtatctgcgtcaatttatcaacgtatgcaagctgaacgtgctgccgttgctcgtgaacaccgttcacaaggtgaagaaaaagcagaatttattcgtgctgatgttgataaaaaagtggtgctgattttagccaatgcaaataaaatcgccgaagagctgaaaggtcaaggtgatgcagaagcggctaaaatctatgctgaagcatttaaacaagaacctgagttttacagttttgtgcgtagtttgaaggcttacgaagaaagttttgccgcaggctcaaacaatatgatgttgcttaaaccagacagcgaatttttccgctttatgaaagcacctacaaaatagttgtatccaaagacccgataaagcgggtcttttttatctttaaaatagaaagctacaacgaggttgtaaaattttaggttgttatataacagtttatattaaccaaaatgtagggacacactgagtgtgtccgctcataaaagatcaattgaggacacactcagtgtgtccctacagtatgcctgaaagattgaggtttagcgtaactgtaacaaccaaaaaaatctaatcgcttgtatgcttttgacattcactaaacctaactaaaagaggcaatttattatgggtaaaagtgttgcaatccttggggctcaatggggcgatgaaggtaaaggcaaaatcgtagatttattaacggatcgtgtgaaatatgtggttcgttaccaaggtggacacaatgcaggtcacaccttaattatcaacggcgaaaaaaccgtacttcgccttattccatcaggtattttgcgtgaaaacgtgacctgcttaatcggcaacggcgtagttctttccccttcagcattaatgcaagaaatgggcgaattagagtcccgtggtattaacgtgcgtgaccgcttaaaaatctctgaggcttgcccactaattttgccatatcacgttgcaatggatcacgctcgtgaagcggcgttaggtaaaaacaaaatcggcacaacaggtcgtggtatcggccctgcttacgaagacaaagtcgctcgtcgtggtctgcgtgtcagcgatctattcaaccgtgaagcctttgcggaaaaattaaaaactattttggaatactacaacttccaactggttcactactacaaagttgagccagtcgattaccaaaaaaccttagatgatgtttttgcggtagcagacatcatcacaggtatggttgcagatattacaaccctattacacaaagctcgtgccaacggcgacaatatcctatttgaaggtgcgcaaggcacaatgttagacattgaccacggtacttatccatttgtaaccagttcaaataccaccgctggtggtattgcaacaggttctggtttcgggcctcgtaatttagattatgtattaggtatcattaaagcttactgtacccgtgtgggatctggtccatttacgaccgaactgttcgatgaagtcggtgcagaaattgctcgtaaaggtaacgaatttggtgcggtcacaggtcgcccacgtcgttgcggttggtttgatgccgttgctgttcgccgtgcaattcaaattaactcaatctcaggtttctgtatgactaaattagatgtacttgatggctttgaggaattaaaaatctgtgtcgcatacaaattacaaaatggcgaaatcgtagaatactcaccgcttgcggcggcaaactgggaaggggttgaaccgatttatgaaaccttaccaggttggaaagagaatactttccgtgtaactaaattagaagatttaccgcaaaatgcgatcaactacatcaaacgcattgaagaagtgttaggtgtaccagtcgatattctttcaacaggcccagaccgtgttgaaacaatgattttgcgtgatccgtttgtagagtaattagattttaacgataacagtcccctggtttgtagaaattaggcgattttttgtataaaacagatcggatctgaccgctcgtttacatttatattgcgaacttagtggcaaagtagtgtaaaatagccaagttttcgtgatttatattcatagaggaaaaagaatgaaaagagtagtcatcacaggtatcggcattatttcgagtatcggtaataacaaagaagaagtattagcttcattaaaagaaggtaaatcaggcattgaatttgtacctaaatttgctgaagtgggtatgcgtagccaaattgcagggacgattaaattaaacccagcagaattaattgaccgtaaagtataccgttttatgggcgatgctgcagcttatgcttacctttcaatgaaagaagcgattgaagattcaggtttaaccgaagagcaagtgtctaacgaccgtaccggtttagttatcggtgcaggcacaggctctgcacatagtcaattagtggcttgtgatgcagtgcgtggtcctcgtggcgtaaaagcagttggtccttatgccgtaactaagacaatggcttcaagtgtatctgcttgcttagcaaccccttataaaattcgtggtgtaaactactctatcagctctgcttgtgcaacctctgcacactgtatcggtcacgcaatggagttaatccaattaggcaaacaagatgtggttttcgcgggtggtgctgaagagctatcttgggaatgtgcaacggaatttgatgcaatgggtgcagtttcaactaaatacaacgaaaccccaactaaagcttctcgtgcttacgatgccaaccgtgacggcttcgtcatcgcaggtggtggtgctgttgttgtggttgaagagcttgaacacgcccttgctcgtggtgcaaaaatttatgcggaaatcgtaggctatggtgtaacatcagacggttacgatatggttgccccaagtggtgaaggtgcggaacgttgtatgaaacaagcgatggcaacagttaaaggcgaaatcgaatacatcaacgtacacggtacatcaacaccagtgggtgatgtgaaagaattaggcgcaatcaaaaatgtctttggcgataaaaccccagcgatttcatcaactaaatcaatgactggtcactcattaggtgcagcaggtgctcacgaagcgatctactcgctattaatgttagataacgatttcattgcaccaagtatcaacattgaagaacttgatgaacaagcacaaggtgtgaatgtcgtgacagaacgccaagacaaagcattaacaaccgtaatgtctaacagcttcggctttggcggtacaaacgcttgcttagttttccaaaaatatcgaggctaatcttgcttaatttttgaaatctgatataagggagtgggaattttcccacgtcttttttatttatttggagtgaataatgttaaagtttaaacatttattatctattttagtattggcagtttcagcaaatgtcgtggcaagcggtgtatcaatggaaatgtttcaaatgaaacgccaaattaacctattaacgaatgcccaaacagctgaagaatttacgcaaaatgccgataaatttattgaagtgtctaaaaaagcccaagcaactatgccaaatagcttagatggcgatcaagagaaattcaaaggctatcaacaaggtatgcaagaagtcatcgatgtggttgctcaagcaaaaaacttagcaagtcaaggtaatttaacggaagcaaaaacagttattgcacgtttagatagtttaagaaaactgtatcattcggtatataaataaacatctagcctaaagttaaatggacgaaaatggtgtaatagacaaatttgttgcaaaaaagcagcttaaaaaagtctctcccacaatttgtgtaaatacctgtttctgagataatacattcagacacaggtattttattatgaacgaaaaacaacttcacgccttggcagcggaatttgccaaaaatctaaaaacaccggaagacctcaatcaattttcacggatgctcaagaaaatcaccgtcgaggctgcgttaaatggtgaactgaccgaccatcttggttatgaaaaacatcagcctagaaaaggtaaaaatgcacgtaacggttacacatctaagaccgtcatttgtgatgaaggtgagatagaaattgagacgcctcgtgaccgtgacggcacctttgaaccgcaacttatcaagaaaaatcaaacccgcatcacaggaatggatgagcagattattgccttatattccaaagggttaagtaatcaggaaatcgttgaaatgttcaaagaactctatgatgcggatgtgtcaagcagcctgatttctcgcgttaccgacgccgtgaaagagcgcgtaatggcatggcaaaatcgcccacttgatgcggtttatccaattgtttacctagattgtatcgtagtttcagctttgcattgtgcatttagtgcgtaacagcttgaaattcgtttcgtggaaagattacaaagccgccatcgcagatttaaagcaggtttatcaagccccgacggaagtacaagctcgcgaaaatctgaccgcactttcgcaaaaatggcaggcaaaatacccgcttgtggcgaaaggctgggaagataactgggcaaatattgccacattttttgattatccggctgatattcgtaaagcgattttataccacgaatgccgtggaatcgcttaatagcgtgattcgtcgcgtgattaaaaaacgaaatgtattcccgacggatgattcagttttcaaagtgatttggcttgcgattaaagatgcatcaaaaaaatggacaatgccgattcagaactggaaactggcgatgaatcaatcataaatgagccgctcgtagcaattttgtcgttctcaaaacagattgtacagaatatgaaacagagcctattcggtgcatttatttacaatattgttgccattccgatcgcctgcggtgtgctttatccttttactggttggctattaaatccgatgattgcagcagtagctatgacattgtcgtctgtgactgttgtgttaaatagccagaggttgttaagataaaagtaaaaaatagagagcaaaaaagaattctatttaccttcgtgtcattaccagccccaaccattcaaggagtgatagaggatcactatttaggtgtctgcgttactgttagattcatctatttcagtatttttgagtaatgttattatgctgaagcataacaatcttattttattgcttacagctccgtgccgtaaaactccgctatttttgttcacatccaacgaaaaaagagaaatataaaagccttgaagtttttacatttcaaggctttatattatgtttgtctagatctgctgaaatcaatttggtggagataatcgggatcgaaccgacgacctcttgaatgccattcaagcgctctcccaactgagctatatccccaaaattgcgagagatgatatgctctcgctttttttctgtcaatctgaaaacaatggaaatagattaattgattaaaaactaactagttctgcgcttcaataaacgcaatcgctttttgaatacgcgcaagcgttctctctttaccaactaacttcgcagtaatatccatagatggcgactgccctgagcctgttactgcaaggcggaatggcatacccactttacccataccgatgtcaagctctgcggcagtttggctcattgcatcgtggatattttcaacactccaatcatcacaagcggtcagtttttccaataattttgcaagtggtgcaactgcttccgctttgaagtttttcgctaccgctttttcatcatagctatcaaattcttgatagaaataacggctttggcttgctaattcttttaaggtttttgcacgttcgcttaagactggaatgatctctgctaatgcaggtccttgagagaaatcaatcccctgatcattcatatgccattcaaggtattttgccacatagactgcaggcaaactacgcatatagtgttggtttagccactgtaatttttccgtgttaaaggcacttgccgatttgctgacagaatgaatgtcgaataactcaatcatttcttcacgagtgaagatctcttgatcgccgtgtccccagcctaaacgtacgagatagttaattaaggcttcgggtaaatagccatcatcacgatattgcattacgctaactgcaccgtgacgtttggaaagtttttgaccatcatcgccgttaatcatcgaaacgtgagcgtaagttggaatttctgcccctaacgcttttaagatgttgatttggcgtggtgtgttgttgatatgatcttcacctcgaacaacgtgggtaatgcccatatcccagtcatcgacaaccacacagaagttgtaggtcggtgcgccatcggtacggcggataattaagtcgtctaattcgctgttgctgatttcaatgcgtccacgcaccgcatcatcaaaaatcactgatccttccgttgggtttttaaaacgaacaacgtgtggttcgctcggatcgtgtgaatgatcgcctaagcagtggcggtcataacgaggtttctctttattcgcttcttggtttgcacgcaattcatctaaacgctcttttgagcagtagcaacggtatgccgtgccttcttcaatcatttgatcgatcacttggttataacggtcaaagcgttttgtttggaaatacggaccgtgttcccacgctaagttaagccattccatgccttcgataatcgctgcggttgcttctggggtagaacgctcaaggtcggtatcttcaatgcgtaatacaaattcaccgttgttatgtttagcatataaccaagaataaagtgctgttctagctccaccaacatgtaaatagcctgtaggacttggtgcgaaacgagtacgcaccttcacatttggatctaaagggaaaagggtttcgattttcatattatcgcctatattttttcagaattttctaaacaaaaaggtttcggtattttacccctcttgagcggaaatcatagtgaaaagttgacagtttgggtgaatttttcaacgaacagccaaaaaatagtaaaaatggattgactgaaaatttttgaactctataatgccaccccacaacgacgggcgattagctcagttgggagagcacctcccttacaaggagggggtcactggttcgagaccggtatcgcccaccacttcaacttttgaagtccgttgttacaatctaatttagtttgaaaagggcgattagctcagttgggagagcacctcccttacaaggagggggtcactggttcgagaccggtatcgcccaccacttttttaaagtaccagcctttcaaacttcccattggtttaaatgcttatcttaagtgggcgattagctcagttgggagagcacctcccttacaaggagggggtcactggttcgagaccggtatcgcccaccacttaatccaagtgtttaaactagtcgaaaccgcaaggtattcgggcgattagctcagttgggagagcacctcccttacaaggagggggtcactggttcgagaccggtatcgcccaccatttcacttttcatcaatctccttcttattttgcaaattttttgtttgatctgaccgcttatctttgactttttactattttttcgatctctgtcgaaaaatttatctcttgtcctttctcttttttatatttcaattaggctttttctgtttttccctaaaactatacgttttaaacgtatatttaacttaaaaataggagtagaataatgaatgtcgcttttgtggagttgccgccttttgaggaatatagaaaaaagtatcttgacgatgactcatttagattattacaaaatgagttactaaaatttcccgataagggagagcttattcaaggtactgggggactaagaaaattgcgtattgtggatattattagacaaaaaggaaaaagaggcggagctagggtaatctattactattacgtgcgagggaaacaagtttggttgttccacgcctacaataaaaaccaacaagacgatttatctaatgaagaacgtgtggttttggcgaatacattaagctatttaaaatctttagtgaggtaatatatgggaaaattatttaatgaactaatggaagggatgcaagcattagagttacacttacaaggcaaaattacactaaaaaccactgttgtggaagttcctgatccgatagtgattacccccgaagaagtgaaagctattcgtcagaaattaaatctttcacaagccgtttttgctcgtaaattacacacttcggtgagaacttatcaaggctgggagcaaggaagaacaaagcccaatccgcaagcggtcttactattaaaaatggttgaaaaatcgccaaaaacatttgagcaaattgcgagcatttaagtgaatatcggcttgtttaccgcaagccgaactatttttgtgatccccatcgaaaaattcattatttcaacttttcaaatcttgtaaaaatcactagcctaaatgagcagacaacagtagaattgccgcctttaatttaactaaattccagcaaaactaaccttttgccacaaaccgtgtaacaacgaggctttcaaacaatgtctgaacaaattcaagcaaccgatgcaagttgtaattcaaccaaaactgaaaaaattaacttattaaacttaaatcgtcagcagatgcgtgaactatttgcggaaatgggcgagaagccatttcgtgctgatcagctgatgaaatggatttatcattttggtgaagataattttgataatatgaccaacatcaataaggtgttgcgtgaaaaattaaaacggatcgctgagattaaagcacctgaagttgccgtagaacaacgttctgccgacggcacaatcaaatgggcgatgtgggttggcgatcagcaaattgaaacggtatatatcccagaagatgatcgtgccaccttgtgtgtttcttcgcaggtgggttgtgccttggcttgtactttctgttcaacggcacagcaaggctttaaccgtaatttaagcgtatctgaaattatcgggcaggtgtggcgtgcatcaaaaattatcggtaactttggtgtaacgggcattcgtccgattaccaatgtggtgatgatgggaatgggtgaaccattgttgaatatgaataacgttattccagcaatggaaattatgttagacgattttgcttatggtctatctaaacgccgtgtgactctttcaacatcaggggttgtaccagcgttagataaaatgcgtgagcagattgatgttgcattagcgatttcattgcacgcaccaaacgatgaactgcgtaatgaattaattccactgaataaaaaatacaacattaaaatgttaattgattctgtgaataaatacttagaagtatcaaacgctaatcacggtaaagtgacgattgaatatgtgatgctaagccacgtcaatgatgatgtggaacacgctcatcagttggcagatgtattgaaaaataccccaagtaaaatcaacttgatcccgtggaacccgttcccagaagcaccctatgcgaagagttcaaatacgcgtattgatcgcttccaaaaaaccttgatggaatatggctttacggtgacagtgcgtaaaactcgtggtgatgatattgatgctgcctgtgggcaacttgcgggtgatgtgattgaccgcactaaacgcacctttgaaaaacgtaaattcggcgaagggattgcggttcaaaatcagtagtatatttcaaggtagagacacactgcgtgtgtccgttccaacaatcgtaattcgtatcggcggacacacgcggtgtgtccctacatagagggaagtcaaatgacctttgcaaaatttttccgtaatttgaccgcttgtagcgtggcattatggcttgttgcttgtgcgaaccaaactactcaggtggattttaaccgctcggaagccgtcaaagctcgcattaatttggcccttgcttaccttgaacaatctgattttccaaaagcgaaagagaacattgacaaagcgcttgaacacgatgtaaaagactacctaccgcactctgtgcttgcctattattaccaacaaactggcgataaccaaaaagcagaagaagcctaccagcaagccttgaagttaagtaaaacacagagcaaaaacaatcaagttcgccctgatgtattgaataactacggtacctttctgtgcaaacaaaaacagttcgacaaagcctatcagcaatttgaaacggcattaaccagtcaagaagcctattacaatcaagcagatacactagaaaatatcgccttatgtgccaatatgaagaaggatattgagaagcaaaaaacagcactatctcaacttgagaaaatagataaatcaagagcagaacgactatataatttcatggagattagataggcttattttcttaaactagcgtataattcgctcaatattttattttaagcagggattcgttatgaaccatcttccaattgcaaatgaggctctacacctttatacacaagctatttctcgcctcaatcaacacttatctgaagcctttaatcaagccgttgatatgatattaaactgcgaaggacgagttgtagttgcaggtattggtaagtcaggattagttggtaagaagatggttgcaacctttgcttcaacaggcacaccaagtttctttttacacccaacggaagcctttcacggcgatttaggtatgttgaaaccgattgatgtagtgattttaatctcttacagcggtgaaactgatgatgtaaataaactgatcccaagtttgaaaaattttgggaataaaattattgcaatgacgggaaatctgcaatcaacattggctcgtcacgcagatataacccttgatattagtattgagcgtgaggcctgtccaaataatcttgccccgacgacctcaagtttagtgactatggcattgggcgatgtcttagcgattgctctgattaaagctcgagattttaaagcggaagactttgctcgtttccaccctggtggcagccttggtagaaagttgctttgtcgtgtgcgtgatgttatgcagaaaaaattgcctattatctgtccgctttgtagttttagcgattgcttgaatgtaatgaatgaaggacgaatgggggtagctattgttatggaaaatgagcaattgctgggtattattaccgatggtgatattcgtcgtacacttgctaaatttggtgcagaaagcctgaataaaacggctcaagagattatgagctgtaatccaaaaacgattttagatagcactttccttgctcacgcagaagagtatatgaaagagaaacatattcactcattaatagcggtcaatgaagcaggaaaagttacgggcattgtggagttcgcaagctaatggcaaagtcaaattatattactcgttctggttggcaagcattagaccaagagctgaaatatctttggaaagaggaaagacccaaggtaacacaggcagtatctgaggctgcagcattaggtgatcgcagtgaaaatgcggaatatatttatggtaaacgccgtttgcgtgagatcgatcgccgtgtacgttttttatccaaacgtttggaagtactacaaattgtcgattaccacccttctcaagagggtaaagtcttttttggtgcttgggttgaactagaaaatgaggaaggtgaaataaagcagtatcggattgtgggctgtgatgaatttgatccagcaaaacaatggatttcgattgattcccccgttgcaagagcattaattggcaaacaaattgatgatgaaattcaagttgaaactcctgctggaaaagtgatgctctatatcaataaaatttggtatgaaaaaaaactaaccctatgaaaagtttagcctttattcaagaaatgctataaattcatcgttttgattagtaactaggcaagcggtctgtaattttaatttttttgcaaaaataatttgacatatttccagaacctagtaatatgcacgcccacagacacagtgagtggtgagatggccgagcaggctgaaggcgctcccctgctaagggagtatggggttaaaaagctccatcgagggttcgaatccctctctcaccgccatttactttatcacgcacccgtagctcagctggatagagtactcggctacgaaccgagcggtcagaggttcgaatcctctcgggtgcgccattttatttttttatttatcaggataaaatggttgctgataaaataaataacaccgtttcttttcaaatacgcacccgtagctcagctggatagagtactcggctacgaaccgagcggtcagaggttcgaatcctctcgggtgcgccatttcaaactaacttcctaatttcatttagtatcattaaaacggtttttatgctgacttttgcacatcaagaacatattcgtacatactattccgatactcgtaatattcactttcaattgcctcatctttcaagcaatcaatctgtggacgtttgcgtaattggtgcaggctttttagggctttctaccgcactggagctggcagaaaagggtaagaatgtgattgttgttgaaggtgctagggttgggtatggtgcatcgggacgtaatggtggacaagcaatcaacggttttgaagaagggattgatgagtatattgaacaagttggcgaagaaaatgctcgtaaactttggaatatgtcccttgaagcgctcgatattattgacgagcgtgtcaaaacctacaatattcaatgtgattggaagaaaggctatgcaacacttgcattaaatcatcgtcgaatggacgatttgattgcgattgaaaaagagagccgtgaacgctttggctatcaacatatgcaactatgggatagggcaaagttagaacagcatttaggcagtaaaatttattgtggggcgttatacgatagtcaatctggacatttacacccattaaattattgtctagggttagcggcagcctgtttagagcaaggggtcaccatttacgaacacactccagcccttgatctgcaattttcaggtaaacaagttaaagttattaccccacaaggtactattaccgcagataacgtcatattggcaacaaatgcttatatcgatgctaaatctaataagaaaattggttttaaacttgcacgcaaaattctccctgtggaaagttttatcattgcgactgagccattaactcaagcaatggcggatagtgttatcaataatggtatgtctgtctgcgataacaatattttgctcgattattaccgcttgagtgcggataatcgcttactctttggtagtgactccagttctaatgttgatatgatggcaaaaatgcgtcgcaatatgcttgatgtgttccctcagcttgaagatgtcaaaattgattatggttggggtgggccgattgatatgactctaaatgcctcacctcacttcggtcgagtgaagtctaatgtttattttgctcacggcttttcaggtcacggcgttgcactaacagggcttgcaggtcgtattatcgccgaagccattgagggcaatgacgagcgtttgcgtatttttgaagccctgaaagtgccaagtttatttggcggaaaacttgtcaaacaaatggcacttaaaattggggtgaattattatcgttttttagatcggtatagataggatagagcatagtagacaaacttcaggaatactgtcaatactatgcctagccaagttatatcaagtatacttaaaaacatctaactaatgtttcgcgtgtgcgacactatttaataatttatccgtataagccacgccaatcgccgataaaataaagccgatatggattaataattgccacatcattgtttcagggcttaactttgcagcgttgataaatgtttgcagtaagtgaatagatgaaatactgataatcgccattgagagcttcacttttagcacagaagcattcacgtgatcgagccattccggctggtctgggtggttatcaacatttaagcgtgatacaaaggtttcatatcccccgacaatcaccataattaataggtttgcaatcattaccacgtcaataagatttaacactgctagcataatagtgttttcgtccatcacaccgagattaaccactaaattccataaggattttaagaatttataggcataaatcccttgtaccacaattaaacctaaataaataggaagttgtaaccaacggcttgcaaagataattttgctaaaaatactttgttttaactgaatgttttttaatgtattcatagttgtttctcaataaaataaaagcggtgagattttaacaattttttgtaaaagaattaacaaatctgactgcttgaatcagggtaaattatttacggaattgttttccatcattccacgaaaccgtatattctgtcggtaaacggacgcttggtaaggctggcacagccgctttgccaatcgctaataacatcactggggcataacgttcgctgtcaatttctaggacttctaacactgccttacgatcaaaaataccaatagcgtggctatcgtaacctttctctttgacaactaacattagctgcattgccgctaaactcgtatcaatcaacacttgatctcgaatatcctgtgggctgagtgtattgtgtacgcccattaagaaattaaaggaattttcgcgaaaattttggtgtaaacagccgcttgcaatggagtgatctaacacatcgccaagtaacttttcataatgaagatccgccaaaatgacgactaccgctgaagcactttcgcaaggcggtgcgttaaaggcgactttatccaacagtttctgtttttgttctgcctgatccaatatcacaaaccgccacggttgaagattggcttttgatggagcaagctgggcaagtttgatcatttcggtgagttcttcacggctaatctgaacttgattattgaacatttttattgttttgcgttgtttgatgacatcaataagttgcataacatctcctttttaatttgcccaagcctctggggtgaggcgtttgccaaaatggctttcgattaaacgtattgtgattgggtgttgagggttcaatagcacttctttggtactgccatattcgaccacttcaccttgatccattaccatcaatttatctgcgatatgcttaatcataccgagattctgtccaacatagatataggataatcctaaacgttcctgtaaatttaacattaggttagttaattgtgttttcaccgaaaagtctaaggcactgagtgtgtcgtcaataatgataatttcaggattgagaatcaacgctcttgctaatgcaatccgctgtttttggctacttgatgcctcttttatatgaatcaaggcgtgttcaggatacaaaccaactaattttaaggttttaaatatccgttcgttacgtttttcttcagaaagatgggtagcaagtttcagtggcgaatccaaaatctgcccgatattataattgggatcaaaggcatcatttggatcttggaaaatcattctgatcttcttcgctcgaaaagcgtagtcaccgtaggtcaattcgtgatctttgaaaaacattttgcccgacgttggttcagtaatacctacgagcattttggctaaggtggatttccccgctccgttcgccccgataatcgcaagggtttcttggtgatataagctaaaggaaacattttttaccgcataaaaatcttgcttacggaaaatgccaatgcgatcagtaaagcgtttactgacggactgaatatcgagaagtggaagtgccatagttattttgaaaggctaagaaataatcccttccgccgtttacggggtaaggttagggtggggggaattacaacgatgttacaaaattttcgtttaaattaattgcccccttccgccttcggtaccttcccccgtaaacgggggaagggaaacgaaaagctatatttaaaaattacaatacatctacacaatttaagtcaatgaaagattgctctaagcgtttagacatagactcttccattttgcgtaaccaaacgcgtggatcgtagtattttttgtttggtgaatcagggccttctgggttacctaattgaccttgcaagtaatctttgtttgcattgtagtaatctaaaatacccgcccaagatgcccattgtgtatctgtgtcgatattcattttgattgcaccgtagccaattgcttcacggatctcttcttgtgaagaacctgaaccgccgtggaatacgaagtcgattgatttcgcaggtaagccacgctctttagatacgaactcttgtgatgcacctaagatagatggttttaattttacgttacctggtttgtaaacaccgtgtacgttaccgaacgctgctgcaacagtgaaacgtggacttactgggtttaatgaatcgtaaacgaataacacatcttctggttgtgtatataaacgtgactcatcaacatcgctgttatctacgccatcttcttcaccaccagtgataccgatttcgatttcaagggtcataccgattttgctcatacgctctaagtattttttgcaaatttccatattttcttcgattggctcttctgaaagatcaatcatatgtgaagagaataatggacgacctgtttcagcgaagtgtttttcacctgcgtctaacataccgtcaatccacggaagtaattttttcgcagcatggtctgtgtgaagaatcactggtacaccgtactctttcgctaattcgtgaacgtgttttgcacctgcgattgcacctaatacatctgcacgagcaccacttgctggtttgatacctttaccagcgtagaattgagcaccgccatttgagaattgcacgataactggtgctttaacgcgtgctgcagtctctaatactgcgtttactgagtctgaacctacgcagtttaccgcaggaagtgcgaagttgtgttcttttgcataagcaaagattttttgtacgtcatcacctgttacaacacctggttttacgatgtctaataattttgccattttttgtttccttctagtttgggatttttatcttcccccctttgaaaaagggggctaggggggatttttactcgattacacgaacatttagatctttaaatcccccttaatccccctttttcaaagggggaaagtgaataaaattagctattcgcacgtttctctaaaatttcaaccgctggtaagattttgccttctacgaactctaagaacgcaccgccacctgttgagatgtaagagattttatctgcgataccaaacatatcaattgctgctaatgtgtcaccgccacctgcgattgagaatgcaccgtttgctgtcgcatcaacgatagcttgagcaaccacttcagtacctttacggaagttagggaactcaaatacaccaactggaccattccaaaggattgttttcgcattacggataatttctgctaactcttccgctgatttatcgccaatgtcgaagattgattcttctgcagctacttcgtttactgctttgtgcgttgccgcagcagcgtcagagaactctaaaccaacacgcacatcaactggcacaggaatgtttgttgctttagataagagttgtgcttcaggaattaaatccgcttcgtataatgatttacctacattgtgaccttctgccgcaatgaatgtatttgcgataccgccacctacgattaattggtcagcgatttttgaaagactgtctaatacagttaatttagtagatacttttgaaccacctacaattgcaagcattgggcgttgtggctcttttaatgctttacctaaagcatctaattctgctgcaagtaatggacctgcacaagcaactggtgcgtattctgccacgccgtaagttgaaccttctgcacgatgcgcggtaccgaatgcgtccattacaaatacatcacaaagtgccgcatattttttcgctaactcaggatcgtttttcttctcacctttgttaatacgcacgttttcaagcaccacgatttcgttttcttttacatcaacgccatctaagtaatcacgcactaaacgaacaggaacacctaaatctgaagcatttaaataatcaaccacaggttgtaaagagtttgcttcttcaaataccccttcagtcggacgacctaagtgcgacgtcaccattactttagcccctttttgtaaggctaattttaatgttgggattgttgcacggatacgagcgtctgatgtaactttgccatctttaataggcacgttaaggtctgcacgaatgaaaaggcgtttgcctgctaggtcaagatctgccattttttttacggacatagttagttcctcttttgattttcaaaaataaaaaacggggcgattataacagtttcaattatattttgggtaatgtagatcaaattattcgttgatcttatgaatttcttcataaaataaagtaattatgttctttgacacaatcttctcaaaaacattcaaatcgagccaatatcctatcttccttaagatgcaaaaagcggccacgaagtgaccgctttttgcataaagatacggattacaaccagaacaaataccctgccgttgcaatgacaaaaatacagataatgttaagccagaaaccagctttcaccatctcactctgtttaatttgccctgtaccaaatacaatcgcatttggcggtgttgcaactggtaacataaaggcacaagacgcacctaagccgataattaatgcaagccctactggcggcatatttaaggcttgagcaatagaaataaagattggtactaataatgcagcacttgctgtattagaggtaaattctgttaagaaaataataaatgctgcaaccagtaatccgataaggtagaagtatccgtcttcaattaagaatacgataccatctgccattactttactagcccctgtttgacctagcactgagcttaaggttaaaccgccaccgaaaagcattaatacgccccattcggtatttttctgaatatcgtcccacgaagcaactctagtgatacaaattaagactgcagcaaaaagcgcaacaatactgtcgaaactaccaattttaccttgtagccctaataagccagaaattagtgggttaattttatcgccaaatacccaacaaattgcgataacgccaaagatagaaagggtaataatacgctcgcgatttaactcaattttttcaaaactatgctcaaaagtaacatcaaatttcggtttaaatactacatatagcgttgcgatcattaatggcatcaagataaacataatcggcaagccatattttaaccaatctgcaaaagttaaattcagctgtgatgccacaatcgcatttggtggactaccaaccagcgtccccattccaccaatacttgcactataagcaatccctaataatacaaagacataggtgttgtggtgagtttctttatctaatttacttaaaatccccattgcaagcggtaacatcattgctgcggttgctgtattactcatccacattgaaagaaatgcagtaacagagaataggtaaatcaccgcaacggataatttcccttttgccattgccataattttatttgcaatcaggcgatcaagctgttgaatgtgtaatgctgtagctaaagcaaaaccaccaaagaaaaggaagatagttggatcagcaaaagcacttaaggcttctttagattttactaaccctagaccaatcgccagaataggcacaagtagagccgttactgtaacgtgtagagcttccgtaagccataaaaccgcaacaaatactaataaggctaaacctttacttacagcgggttcaaaaggtaatgtatttaataagacaaagaataaaacaatatcaaataacagaataagtccattccttattattgggtttgatgattgatgtgataccgacataaagcccccacaaaataaaatgatgtagatcaataaaccaaattagtttagcaaaacagtaatttattaaaataagcaaatgttggatttgtgagttatatcacaattttttaacaaaaagaaaggtaggctcttgcctaccttagaaaagattatttggtatattaccgcttgttactgagttgatcttctctcgcttgctcttttttcaccaactgcaacgtctgacgaatttcacgtttactttgccaaactaacagaccgacagaaagaaaagtaattccataagagagccatacatagaagccgtaaccgcccattgagaaaaaatcactaagtgatgcaaattgaaaggtcatattctctcctagttacttaattttgcaagttcacgcacccaagggcgtttgcgttcatcttgaagtaatgcactgcgataacgcactatgcttaaccaaatcataaagatcattgagccaaaaatcgctaataataatgggattaacatttcggttgccattgaaggcttatcaaatttagtgatggttgccccttggtgtagcgtgttccaccattccacagagaagtggataatcggtaagttgattacgccaaccattgaaagtaccccagccgcttttgcccctgtatttttatcttggaaagcagaataaagagccattacgccaagatagaggaaaaataatactaaggctgaagttaaacgtgcgtcccatacccaccaagttccccacatcggcttgccccaaattgctcctgtcacaagagaaaggaaggcaaagaccattccaatcggtgccattgagatcattgctagatgtgcttgacgaatttgccataccgctgcaatgagtgcaacaactgccattgagccataaacacccatcgaccaaattgccgctggaacgtgaatgaaaataatgcgatagctatcgccttgttgataatcttttggggcgaatgccaagccaataataaatgctgctgaaagcaataaaaaacttaagactgcaagccaaggctgcaccttccctagcaaatggtactgtgtttcagactttgcgtaagggtgtaaccatttccacataaaaactccaagttattacaaaaaatagggttcaaattaccgcttgttactgtaaactaacccttaacgcccctgcgattgcaaaaggcgaaaaggttaatgcgagggctaacattgcccctaaaatagcaagttgccctgtatatcccatatttaaggttgaggcttctaacacggcagcggcgaagatcaatacaggtagaaagagcggtaagatcaataaactgagtagcgtaccaccttttctcaacccgacagttaatccaaccccgattgccccaaggcaacttaaaatcggtgtacctaacaatagggttaaaaccaatgcccaccacacttctgtttcaagagaaagcaaaatcgccgtaatcggcgaaagcagaattaaaggcaagccagttaatagccaatgtgcaatcacttttgctaacgccacttgcggcaaaccgacgggtagcaacatcaactgctctaatgagccatctaaataatcatcacgaaatagtcgctcaaaagagagcaaggctgaaagcaccgccgcaacccacgcagttccagaggctattttagcgagtaattcaggattagggcccattaaaagcggaaacattgtgataataatcaagaaaaaccataaagggtttaaaatttccgcaggtttacgaaaggcgatggttaattctcgttggataatagtcagtaaaatcatagggttattttatactctaaatggatctaacgataacacttgaactttgtcactttctgcggtttgatggctggtaaaaatcaccatacccccttgctcacaatgttgttcgatatgggcgatcagttccgcaaccccttttttatcaatcgcagtaaaaggctcatctaaaatccataacgtcgctttggtcagccataattttgccagagccactcgacgttgctgcccagccgacaaatgcgagcaaggcaaatcttctcgcccaatcaacgacacttttcctaaggcattccaaagggcttcatcatctaaaggcaacccttgaattttttggaaaaaacgcagattttcccaagcggtcagttcaggcttaacccctgcgtgatgccctaaataaaagagattagtgtagtattgatctcgttgttgctgaattttaacaccattccactgcacctcgccttctgccgccactgcaaacccagctaaaatccgcaatagactggtttttccaatgccattatgcccttcgatttgccaccattgaccactcgaaatagtcaatgaacagccttcaaacaagcgagtttcaccacgttcacaagcaatattaatgagcgaaagttgatccatttatagtcctaaaatttctttgacaaaaggaagtgtgagcttacgttgagcctgtaacgaggcgtgatctaacaacattaatttatgcattagggcttgtaaatcacgatctaaccgcttgagtaaaaagttcgccacttcatctgaaagctctagccccttattgcgtgcattacgttgcaaaataatgcgtttctgttcatcatcaagatccgccaaacgatatacctcgccccaagttaagcgagaacgcaggtcaggcaagtgaatagctaattgatgtggcggacaatcggcactgatcaacaataatgttttcttacattgattaaacaacccttgctgttcacgaatctgattaaacagatcgaaaatagccaattcccactcttcatcacctgccaccgcttgtatatcatcaagacaaaccacatcaagttgatccccattatccaataccgtaggggcgaagtaatgggatttatccaatggaatataggttgctgattgttgattaagcaaataatgattactcaccgccttgagtaaatggctcttgccactgctcttaccgccccagatataaaaaaaaggttgctgaacatccacaaaattttggcgtagcgaccccaacagcaataaactgttttcggcgtaaaagttgtcaaaagtatcatcatcaatttgatggatcggtaatgtcagttgcaatgtgttatctaagaaaaaaatttttgccaaggatagcggaaaaacgaaaggttgagaagtctcaacctttgatttataagagattttatttattaggctttttgtagttttgtccagttataatacccataaagggaatttaataaatatgcagaatacattatgtacattgatggattttcagcccaaagaacgatagagagaatatttaaggcaatccataatagccactgttcacgataacgtagtaacattaatgcttgagccgcaaccacaataattgtagttaaaccatctaaacctgtcgaactgccaccagcggccttcaaggcttgaaccaataataatgttccaataaccataaaagttaataatccagtccatcccttaatagttaatgcttttgtgatcaccgcctcacttccttcggctttttgcatattttgtttccaaaggaaatagcctataaattgcgcagggatataaacatagagcgttgtattcatttcaccaaggaaatttgccccccatgcaacgtagaaatagctgtatgcaaaaattaaaccaaagaaataattactgatttttcctttaccaacaaaaacattacagataatacctgaaatacctgccaccattccaatgatagaatcggggtagtaaatatatacgccaatttgagctgcaataaataagaaaagccaagctacctcaaagggtttccagccactaaaaaattcttcttttaattggtttataagtattggataattcataataactcctagaatatagtctgatttcttgtattctacctaaattttgtaagaaatgtataacataaattatatttctgagaactagctcacaaaatttactattcaacctaatctctctaaattattagaatgtatattattcactaaattgcatttgatatagctgtttataagcaccacctttttccagcaagactttgtgtgatccgcgttcaataatctctccctgatccaccactaaaatctcatcggcgttttcaatggtagacaagcggtgagcaatcactaaaacagtgcgatctttttgtagttcatcaagggctgcttgaattgcacgttctgattcggtatctaacgctgaagtagcttcatctaagactaaaacaggcgaatttcttaataaggcacgggcaatcgccaaacgctgacgctgtccaccagatagacttaccccgttttcaccaattactgtatccaagccttgtgacattttttcgataaattccatcgcataagcggctttagctgcagcttcgatctgctcacgactgtatttgtctttagctgcataggcaatgttattcgcaatggtgtcgttaaatagatgaacctgttgagaaacaattgcacactgttcacgcaaattgtttaaggtgtactcttgaattttatgatcatcaagataaatattgcccgaatcaatttcataaaaacgggtaatcaaattcgcaatggtcgatttccctgagcctgaacgcccaactaacgctaaggttttccctgcaggtaaattaaacgagatattttttaaagcgggttgttctttaccaaaataagtaaaggtaacgttttcaaaacgaatgtcgcctttggctcgttcaatttgataagtgccttcatttttttctgttggtaaatcaaataaggtaaagagcgtttggcttgccgccattcctcgttggaactgggcattaacgttggttaaagtttttaatggacgtaaaattcccattaacgccccaatcactgcggcaaattccccagctgttaaatcatcgccgataatttcaggcgaacctgcgacaaaaagcaccaccgctaaggctagagaagcgatcacttgaataatcggatcggcaatcgtacttgctgccatcattttcattcctttgcgacgcatatcgttactggtatggttgaagcgttcttcttcgactttctgtccgccaaacgataacaccactttatgtccacgcaacatctgttcggcactttcggtcatgcttcccatagattcttgcatattacggctgagtttacgaaagcgttttgacacaactcggattaataccgcaatcacaggaccaatgatgaaaagaacaagggataaacgccagctataataaaacattgttgtgacgagaaagacaatgtagatcccttctcggaccacgctttgcaacgcatttgccgaagaacttgctacttgctcagaatcataggtaatacgggaaagtaatcttcctgaagagttttggtcaaaaaatgttacaggcataaacattaaatgcttaaatactttttgacgcattgtcatcacaactttaccagacacccacgccaaacagtaggcagaaataaagctggtgataccacgagcaaaaattaagcctacgacaataaatgccatcacttttaaaaagttacgatcagagtcaacgccaaagccatcatcaatcaaaggtttaagcattgtgatcaagtatgcatcggcagcagcgttaaatatcattgccaccattgccacaataatccctattttaaaaagggaaatcataggccataggcgtttaaatgtctgccaagtagagtggtcttgagttatatcatcaagagaaaaaggatttttatttgccattttttatactttctgatcaatcatagtttcccattctaaaactaaatgttcattctgccaaatattcatttcaaagaaaaaatcagatagaattattaaagagacatatttctatctattcttacaaaagcacaatcaaatctagtttttgaaaggattatatttccttactattttatgatggcttaatagccctcttcacttctaaggattttttatgctacatctactcaaaggggcttatcgtctatttcgttgtattcgagaatttgtgataagtctggtatttattttatttgtgatgttagggtttgcttttatggcgttatggtcaagtgatgctgctaacagcaaaacacctgtcgaatttagtaaaggggctttattactcaatttagatggttatttagcggataatcacgatgaatttagtgattttaatcgctttttacgttctgaattaggtggtacaaatgagccgattaaaatatcaacttttgatgtagtgcgtgcaataaagaaagcacagtatgatgaaaaaattacaggattagtgcttgatttaagttattttgaagggggcgatattccttctttaacctttgtaggcaaagagattgagcgttttaaacaatcaaataaacctgtgattgcaattggtgaaggatatagccaacaacaatattaccttgcgagttatgcggataaaatttatctaaacaaagcaggatttgttgatttacacggtttaaattattccactctctatttcaagtcgttgctagacaagattgaagtcgttccgcatattttccgtgttggaacctataagtctgccgttgaaccgtttttgcgtgatgatatgtcggcagaagctcgtcaaaatgctcaattatggctatctcagttatgggcaaatttcagcaatgcgattgctaaaaatcgccagattgatgcaaacacaatagtgccagaagcaaaccgtttaatcgctcaatataaagcggtgaaaggtgatgatgctcaatacgccttaatgcaaaaatgggtgacggacgtggcaacacatcgtcaaattcgtctcgacttgattgagcaatttggtgaagatcaagacggaaactataaccatatcgacttttttgactattctttgtcgttatctgaccgctttaatgtggtaggcaaggataaaatagctattgtgaatgttgaaggggcgattgtgttaggggaaagcgatgatgaagttgctggcagtgatacgattgtaaaattgctgagaaaagctcgtgaagatgatgacgtgctaggcgtagtattgcggattaatagcccaggtgggagtgcaatggcatcggaattaattcgccaagaggttgaggatttgcaacaagcgggcaaacctgttgtggcatcgatgggcggaatggctgcctcaggtggttactggattgcggcaacaagtgataaaatcattgcaagcccaactactttgacaggctctatcggtatttttggtttagctgtcagttttgagaaaacggcgaaaaaactaggtgtgaatgaagatggtgttagtacatcgccttttgcacaacaaacagcattaaaatcgctatcaaaagagcaaagtgagttaattcaaattagcattgaaaatggctacgaccgtttccttgaattagtcagcaaggggcgaaaaatgtcgaaaggtgatgtagataaagtggctcaagggcaagtttggcttggggaaagtgcatttgaaaaagggttggttgatgagttgggcgattttgatgatgcctatcacgctttaacaatcttaatcaatgaaaaacgtaaagcgaaaggggaaacagaaatcgaacgctttagcacacagtggctaattgatgaaagtgatgatttgataagccaagtaatgcgtggtttcaaattgcaattacaattaaaagctgttgaatggttgaatttgcctttgcctcaacaaactcagcaacagcttggtatgttggcaaaatttaatgatcctaagcagagttatctctactgtttaaattgtggtagtgtgaagtaagttgagcgagcgtcacaaatggcgttcgtatactctagctaatttagggaaattcgctttgattaatgaattgaggattgcaaaacaagctatacctctttaaacttctcacctaatttttatatagaaaaagcaatgacaatgacggaaacaatgacactttctttaggacaacagctaaaaaatgctcgtgaagcattaaatttgacgattgaggacgtggctcgaaaaacaaatctgaaaaaaggccacctcgaagcgatagaaaatgatatttttattttgccaagcgtgccaccagctttcgtgcgtggttatgtgcgtaattatgtgcgttttctgcgtttgcctgaaacccttgtaaattcagtgaattacggtgaagtgacaattccaaaagaagtccgaaaagctgcaccgattgcggttaaaaaccataagtcgcaaatgcgttgggtaaaagggctgacgtggattgtgttgttaagtaccgttggtatgacgttggcttggtggtggcaagagcatcagaaagatcaggctaaccgtgagcagttgattgtgaataccacagaagcaacggctaaagttgtcgaagagcctcaagtgacaccggttgaaccgcaaccaaccccagcagaagttccgcaagcggtaacattgcctgctaaaaatgcagaacctgcaacaccagcagtggaaagtaatcatcaagagcctgtagctcaagtagcttcagagaaccaaacgactgccactactacagcagtggcagagagcagcacgcctgttgccgtagagcaagctgagctagttcaatctgtgcaaactgagcctgtgcttacacaaacagaagcaaataatcaagcggaagaacctacacaaacggcagtagaggaagaactgcggattgagattacgggggctgaaagttggattactgtgcgtactgcacaaaacaaacgcttagcagaaagactttataaggcaggtgaagtattaagttttaacgataacgaacaatatcgtttaactgtgggggcgcctgctaacgtcaaaatttattacaaagggcaagttgttccactgaaagtagatggacgagttgcacgtttcaaattacctttagcggaataatatgttaaaagaaccacctattaagcgtcgtcaatcgaccaaaatttatgtcggtaatgtgcctgtggggggcgatgcaccgattgctgttcaatcaatgacgaatacacgaaccacagatgtggaagcgactgtagcacaaatcaaagctcttgagcgtgtcggggcggatattgtgcgagtgtctgtgccaacaatggacgcagcagaagcctttaaattgataaaacagcaggtaaaagtaccgcttgtcgcagatattcactttgactaccgtattgcgttgaaagtggcggaatatggtgtggattgcttgcgtatcaatccaggtaatatcggcaaggaagagcgtattcgtgcggtggtggactgtgcgagagataaaaatattcctattcgtatcggggtaaatgcaggctctcttgaaaaagatattcaagagaaattcggtgagccaacgccagaagccctgttagagtcagcacttcgccacgttgagatcttagatcgtcttaacttcgatcaatttaaagtgagtgtgaaagcgtccgatgtctttttagccgtcgaatcttaccgcttgttagctaaagcgatcaaacaaccgatccatttaggcattacggaagcaggcggtgcaagagcaggggctgtgaaatcagcaatcggtttaggtttattactttcagaggggatcggtgatacgcttcgtgtttcattagccgcagatcctgttgaagagatcaaagtgggctttgatattctaaaatcattgcgtatccgttctcgtgggatcaactttatcgcttgcccaacttgctctcgtcaagaatttgatgtgatcggcacggtcaatgcccttgaacaacgtttggaagatattattacaccgatggacgtatccattatcggctgtgtggtgaatggtccgggtgaagcgttagtgtctgatcttggcgtgaccggctcaaataaaatgagcggtttttatcttgatggcgttcgtcaaaaagagcgttttgacaatgataaattgatcgaccaactcgaagcgaaaattcgagcaagagtggcagaacagcataatcgtattgatattgttcaagtgtaagggatatatgagtaagaaattccgagttatttcgttattctctggagctggagggttggatttaggatttaaaggtgggtttgactttttaaataaaagatacgatgaaaatcccttcgaagtggtttgggcgaacgatattaatgaaaaagcttgtaagactttaaaacataatttccctgaaactcccgtagtatgtggagatattacactagttgataaaagtacattgcctgaagctgatgttgttctaggtgggtttccttgtcaagattttagcttagctggaaagcgacaaggattagcggttgaacgtggaaatctttatctcagtatggttgatgttgtagataaggtaaagcctaaactatttttagctgaaaatgtgaaaggattgcttacatggcaaaatggtttagctataaatactattgtcgaagattttggaaagattggctataaaattaaataccaactattgaatacagctaattatggtgttcctcaaactcgagaaagggtaataattgtcggtgttcgcaatgatttgacatcagaatttttctttccccgagaaactcattcagatagcgaggatttatttcaatctacagaaaaatgggttgatttaaaaagggcaatcggtgatttagaaaatgatgaaaaacatttttctctaccaaatagtggctattctaaagctaagttatttcaaggaactcaaggaaacaccaaaacaaaagcggatcgcccaggtccaacaatgagggctgagcatcatggaaatattgaatttcactatagcttgccgaggaggctctctgctagagaggcagctcgtattcagtcgttcccagataactttgagtttttaaattcgacgactgatgcttataggcaggtaggcaatgcagtagcccctgtatttgcatggcatcttgctcaatctgtaaaggaaaccctgaaatgatttatactacagcggatataaatgaaaaacagaaatttgaagagttattagataaaactcgtgatctggtactaaaaaatttagatccatcaataaattcagggaacaaatttgaaagtttggtttttaactgtatgcaagtttgtgctgatggtactttatttaaagggaatttatatcgtacagcagacagagatttccctgatattgttataaataattactggggagttgaggttaaatttactaaggatgataaatggaagtccataggcaatagtgtacttgaatcgtctagaattgagtgtgtaaagaaaatttatatgttctttggtaagtgtggaggaatacccgatattaagtacagaacttatgaggattgtttatttggaatttctgttactcattatcctagatatgaaatagatatgaatttaccgaaaggtgaatctatttttgacttaatgaatatatcatatgatgaattaagaaatcaggaacaaccagttaaatctattaagaaatattataaatctaagttaggaaaagataattcactatggtggattgatgaggaaagtacttttagtagaaattttgaaattattgattttacaaacttagaaaaagagcaaaaacgagatcttattgctgagggatttatcctttaccctgaagtttttaattcaaattattcgagactatgtgcattttgggtttcttactattctattatttgtccaaatatgagagatcaatattctgcaggaggaaaaaagagaatagaggatattgatgaagatctaaaatttatttttaaagttttaggtactcatgaattatctaaactacactataattttttgtttaagtatgtggctcgtattaaacatatattgaattgtattgatttatctttagtttctgaatgttgggacactagcttaacaaatagatatgagatgattagaatatggaaagaaaaaatagataaatatactcctcaagaattctcaataaaactatctaatgcatttgaattagtgaatgataaacttatttaggaaagcacaatgaaagtcgccgtttttagtaccaaaaattatgatcgaaaatacctcgaaatagctaatcaacaataccattttgagtttgaattttttgattttatgctcaatgagcgtaccgctaaaatggcagaaggttgcgatgttgtttgtatttttgtaaatgacgatggtagccgagcagtgcttgagaaactggcaaaagtgggcgtgaaaatgatcgctttgcgttgtgccagttttaacaatgtggatattcaagcagcaaaagagcttggaattcaggtagtacgtgtacaagcttattcacctgaagcagttgcggaacacactgttggcttgatgcttactttaaatcgccgtattcatcgagcttatcagcgtacccgtgaagcaaacttctctcttgaagggctaatcggatttaatatgtacaaacgtaccgttggagtgattggcacagggaaaattggtattgcaacaacgcgaattttaaaaggctttggaatgaatattcttgcctttgacccatttaaaaatcctattgtggaagaaattggggcaaaatatgtcacacttgatgaactttatgctaagtccgatgtgataaccctacattgcccagctacgccagagaactatcatctgttgaataaagaggcttttgacaaaatgaaagacggcgtgatgatcatcaataccagccgtggttcattaattgatactcctgaagcgattaaagcattaaaacgtcgtaaaatcggtgcgttaggtatggacgtttatgaaaacgaacgtgatcttttctttgaagataaatcaaatgaagtgattttagatgatgttttccgccgtttgtcttcttgccataacgtgcttttaacagggcatcaagcatttttaacagaagaagcattgatgaatatctcagatgtgacactgtataatatctgctgtttacaaaaagggggacactgcgaaaatcaaattgaatagaaatagaatacaaaataattgagaataaatatttctaacaactgtttgtctattactcctaatcttaatggctgcttaaaaaggataaatttctctagtatcccaatgctttaaaattgggtaaaaaattgttgttatctaaacgctttaccacagtatcaatcgagccatcaatatttaaacaaagctcacgccacccttgaggaatcgcatctaatgtgaaatcattacaatgtggtttgaattgtatacacgttgaaggcgttgataatatacgatacccattccattgagcatcaacctcttgatgaatatgcccatgtacaatagccttcactttcggaaaagcttttaatgtagcaagtagatcatttacattagaaaggctatgctgatcaagccatgctgaatttgttggcagaatattatggtgtaaaacaattaaagaatatcgttcaggatggacttccaactttctttttaaaaaagcaagctcagaagactctaatctacctttagggctatcttgaatatggctatcaagaagaattatctgccaatgatcaccaactaaaatatgcttttcaggtttaatttgagaataaatagacaaagcattacgcatctgtggttgtaaatcatgatttccagctacccagaagagtggtttaaccaacggtttaaccatttttgcaaaacgatgatatgcctctcgattatggtcttgaacaagatcgcctgttgcaagaatcaagtcatactcaaatgattctttcatgatcatattaagcacagcttgaaaactttgagtggtattaacccctaatagttcacaagtatctgatgcaaataaatgtgaatcggtaatttgtaaaatccgaattattggagagcttaagggaaatatataactatcgtccataatactaaaggttcaaagaaaagccataagatggataagcaactactctactgatttcccaaacgttgtcatcaagaaaaatagaaaaatgtgacatctcctacacttttcacaaaaatttacattgcttaataattttttgcaactctaatatattacatatatgtcaataatgattaatcagaactagtgttagttaaaattagttcaaaaaactatcaaaaattaactcataattatccccatccctattataagaaatataacgaggaaattttttcacctgaaaatttcttcactataatctgtttagcacccgttttgaatctgtaagttatttcctcaacatctatttcttctattctaagaatagctctagattcatttacaatcgtatccttatgtggataaagttttttaccatttgtcgtttgaaaattatacggtaatactccataatagctgagttgaaatgcaatagaaaataaatcaaacgttggtaaagttaagatctcctgtttaagtggttctactactttcccgtattgaattactgttcccttaacctctgccttagcataagttttcccatttcttatatcttggtaattcaacatattaaattgtttaccttgtattttaccacctgtattaaatactatattatataaaggaatgttaattttagatattattgaataatattcatcactctttttaaaatggatatatgttggcattatataattagacttatacttgatatgaaactcttctccccttatagattgaacaatacaaataaaagaaataattaatacttctaattttttaatgcattcattaaatttcctctaaactaacgtactcaaaaagcctagcaatcgcattattatcacgaagttgctcagcttcttcaacttttattttagttaaatgagcagaaaaataattgataaaatcatacatataattacgtaaaaaaacacctcgcttaaaagctatttgtgtcatactagattgaaaaagatggcttgcatcaatagcaactaaatctttgtcttccttcgtatatgccatagttgccataattccaatacctaagccagaacgaacataggtcttaataacatcagcatcagtagctgtaaatactattctaggtagaataccatgtttattaaaagccttatccagatctgagcgccccgtaaaaccaaatgtataagtgattaaatcatattgtcccaactcttcaatagttaatttattatttcccttatttagcttggccaaaggatgatctggttttacaatcactgaacgattccacatgtaacaaggtaacagaataacattttcaaaaagatattgagcctctgtaataatagctaaatcaacctctcctgccattaatgcatcatatatttgtgttggagatccttgatgaagatgtaaacttacggaggggtatttattcttaaatttttcaattatctttggtaatacgtaacgagcttgggtatttgtagttgcaattctgagtattcccttatgcggacttgtttgctcttctgcaatagatttaatcccttgagcttgtgccaacatctcccgagcaattgtaataatacgttcccccgccggagtaagcgctttaatatgttttccacatcgttcaaaaatatgtatacctaattcatcttctaacaaacgaacttgcttactaattccaggctgagatgtataaagtacctcagcagcttctgtaatattcatattttgattaacgatttcaacaatatagcgtaactgctgtaatttcacgtatatatcctttatttctaacttagtacaatattaagtaattgctttaaatccgtaatttcataagttggcttaatttctgtatgattaacttccttgcaaggattaaaccagcaagaatcaatacctatttgatttgcacctaaaatatcagaagaaagagtatctcctaccatcaatattctagacttatttatatctcccatttgttgaaaagcaaacttaaaaattctttcatctggctttggcacccctgcaacctccgaactaatcacaatatcaaaatacttttctgtattagtattttccagacgcttcttttgcaatatttctaaaccatttgtaataattcccattctaattattccaaacaatttttctaatacctctatagttccagataatggtttacttattacagccatttttaacattaattcattatttaaagctaattcgtcttttccaattttttttgcaatgttagagaatcgacatatttgaagctgttcaattgtgatttcttgattttgatatgcaagccacaagggcttattcacagcttgaaaagcttcataatcatcttgggaaaactctataccataacaagctaaaactgcttgtaaacctaaatatgaattaaatgaaaataacgtttcatccgcatcaaataaaatccactgatacttcatatttcctcttgagttattatactactcagatatattaatttctttcgtaatccaatcaacaaaatgctgtactttaggattgtctgatatttgagatggataaacaacataaaatgatttttcatcatttaatcctgtagaaaaaggctcaattaaatttccttgttctaattcatgctgagcaatagtcttgttggcaatagcaataccttgctgatacaaagctgcttgtaatgccataaatgtatgactaaaaattggaccaatttcctcaacatcaatttgttcacttaaaccaaaatattcaatcgttcgcttccatttattacggctaaatacatgcaataatgtttttccaatcagatcttttggtgattttaacggattttcctctaagaacttaggagaagctaaaattactaatggagcttctgttaagcgaatagattccacattctcccatttacctgaaccataataaatagcaacatcaatttcttttccaagctgagcctcatcttgatctacacctttaatcctgacctcaatatgggggaaccgctcatgaaacttactcaaccgaggaacaagccaatgcataccaaaagtttgaggcacactaattgtaagaatttgtctattatttttagaacgaattttatccgttgctttagcaatttgctctaatagcggacgaatttcatcaaaatattgcaaaccaagttccgttaattctaacaccctatttttccgatgaaaaagttgaatatttaaaaaatcttcaagtaatttaatctgatggctaactgcggcctgggtaacaaatagttcatctgctgctttcgtaaaattaagatgacgagcagcagattcaaatgccttgagagcattgagtggcggtaactttttattgttcataatttttactagaaaaagtgagttttttagattactttttttgataaataaaattaaaaaatctcgtttgtataactggtcaaacatctctaaaattcagcaccatacttagatggatagtgatagctgtcttttagctatttttgaattttaagtatgatgttgtgtttgcatattggtctaggaaactagactagagtaacaaaaaagttactcgtttcacttcctgtatattttgaaccttttggtttagctaccgcccatgttgggcggtttttttatagcagaatttcctactattctaccagaatatacaaaaattgccacccaaagccgcactttcgataaaaaatcctatttttttcattgaaaacattcatttttctttagaaacgttgtaaatttctcatatctcatataaaaaaataaaggacacaacaatgactaaaaatattgactgggcaaacctcggattttcttatatcaaaacagattatcgttttattgcacattggaaagagggcaaatggaatgagggggaattaactaccgacagcactttacatattcacgaaggttctactgcattgcactatggtcagcaatgttttgagggcttgaaagcctatcgttgcaaagacggttcgattaatcttttccgtccagatcaaaacgccaaacgtatgcaaacaacctgtgatcgccttttaatgccacaggtgccagtggaaatgtttatccatgcttgtaaagaggttgtcaaagcaaaccaagaatggttagcaccttatggaacaggagcaacgctttacttacgtccatttgtgattggtgtgggtgaaaatattggcattcgtgctgcaccagaatatattttctctgtcttttgtgtgcctgttggtgcttacttcaaaggtggcttagctccagcgaatttccttgtgtctgattatgaccgtgctgcaccaaacggtaccggcggtgtaaaagtgggcggaaactatgcagcaagcctgttgcctcacgaattagccgttgagcgtaaattcgcagatgcaatttaccttgatccaaaaacacatactaaaattgaagaagtcggcgcggcaaatttctttggtattacaaaagataacaaatttattacccctgcttcatcgtctattttaccaagtatcacaaaatactcgttacttcatctcgctaaagagcgtttaggtatggaaacgattgaaggcgatgtttatatcgatcaactagatcagtttgcagaggctggtgcttgtggtaccgcagccgtaattacccctatcggtggtattcaaaatggggataacttccacgtattctattctgaaacagaagttggccctatcactaaacgtttatacgctgaattaaccagaattcaatttggcgatgtagaggcacctgaaggctggattgtcaaagtcgagtaattcattttcaagcagtgagagaatagcaaaaatttgctatctactcaccgctttcattaggagaaacaatgatccaacgatttcaagtcggtaaacgcctatctgaaatggcaatttataacggtgtagcctatcttgcaggacaagtccctaaagatgattcgcaagatatgtacggtcaaacaaagcaagtgttagccgaaattgataaatggttagcccaagcaggcacaaataaaagtcgaattttgatggctcaagtttttgtaagcaatatgattgaatttgatgaaatgaaccgagcttgggacgaatgggttgctgaaggtaatgcaccgccaagagctgctgttgaagcaaaattggctaaccccaattggaaagtggaaattgtggtaactgctaccatttaattagtcgtggaagtacaacataataaaaccagtattaaacgaccctatcccaaattctgtgtaaacacccatttcaactatacggtgatcgtctaagcgatcaccgttaagttgaaatgggtgtttacacagaatttgggatagggtcaaaacaaaaaaccgcaagctatctctaacctgcggtttttctctttaataaaaccccgacgatgctctactctcacatggggaatccccacactaccatcgacgttacagcttttcacttctgagttcggtatggagtcaggtgggacaactgcactattgtcgtcgggaaaatcttttgatgattctctctatcttcttttttctgttctttaagggcaaatgtaatttgcccctacatctttctgttctttaagggcaaatgtaatttgcccctacatctttctgttctttaagggcaaatgtaatttgcccctacactattctaatttcgaaacaagctgttctgagtctctttgttttattttgtttagttagtttgttgcttttattcagctctctaactctctcacgtctacttcaaaaacgcttgaggttgtatagttaagcctctcgggcaattagtatctgttagctcaacggctcacaccgcttacacaccagacctatctacgtcgtagtcttcaacaacccttactagcttatagctagggagaactcatcttaaggcgagtttcgtgcttagatgctttcagcacttatctcttccgcatttagctacccagcaatgcctctggcgagacaactggtacaccagtgatgcgtccactccggtcctctcgtactaggagcagcccctctcaattctccaacgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgacttgtctgtctcgcagttaagcttgcttataccattgcactaacctcacgatgtccgaccgtgattagcaaaccttcgtgctcctccgttacgctttgggaggagaccgccccagtcaaactacccaccagacactgtccgagaccacgtttcgtaatcttcgttagaacatcaaacgttaaagggtggtatttcaaggtcgactccacaagcactggcgtgcctgcttcttagtctcccacctatcctacacatcaaaattcaatgttcagtgtcaagctatagtaaaggttcacggggtctttccgtctagccgcgggtacaccgcatcttcacggcgatttcaatttcactgagtctcgggtggagacagcctggccatcattatgccattcgtgcaggtcggaacttacccgacaaggaatttcgctaccttaggaccgttatagttacggccgccgtttactggggcttcgatcaggagcttctctttcgataacaccatcaattaaccttccagcaccgggcaggcatcacaccctatacgtccactttcgtgtttgcagagtgctgtgtttttaataaacagttgcagccagctggtatcttcgactggttcagccttcggaggtatactcctacaacctacgccagcgcaccttctcccgaagttacggtgctattttgcctagttccttcacccgagttctctcaagcgcctgagtattctctacctgaccacctgtgtcggttttcagtacggtttagtaaagcctttcgcttagtggcttttcctggaagcgtggtatcagttacttcatttccgtagaaactcgtcatcatctctcagtgttatggaagtccggatttgcctaaactccccacctaccaacttaaacagacatccaacagtctgctaacctaaccttctccgtccccacatcgcagctttaccaagtacgggaatattaacccgtttcccatcgactacgcttttcagcctcgccttaggggccgactcaccctgccccgattaacgttggacaggaacccttggtcttctggcgaacgagtttttcactcgttttatcgttacttatgtcagcattcgcacttgtgatatctccagcatacttctcaatacaccttcatcgacttacacaacgctcccctacccaacaggcgtatcacaaatattcctctgatttctatccgcactttatgccaactcaacgtgttgggtgcttgaccaacatctcattccgtttcacttcattcgatgttgttaatcgaaggcgtatttgtgatacgcctgatgccgcagcttcggtgctatattttagccccgttacatcttccgtgcaggccgactcgactagtgagctattacgctttctttaaatggtggctgcttctaagccaacatcctagctgtctaagccttcccacttcgtttcccacttaatatagactttgggaccttagctggcggtctgggttgtttccctctccacgatggacgttagcacccaccgtgtgtctcctatgcattactcttcggtattcgcagtttgcatcgggttggtaatccgggatggacccctagccgaaacagtgctctacccccgaaggtattcacataaggctctacctaaatagatttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccttgcaactatccgcccagttaagactcggtttcccttcggctcccttattcagttaacctcgctacaaaatataagtcgctgacccattatacaaaaggtacgcagtcaccctttcgggctcccactgcttgtacgtacacggtttcaggttctatttcactcccctcactggggttcttttcgcctttccttcacagtactggttcactatcggtcaatcaggagtatttagccttggaggatggtccccccatcttcaaacaggatttctcgtgtcccgccctacttgttgcaagtttagtaccacaacataaacttaaaatacggggctatcaccctgtgtcgcttggcttcccagccaattcttctgtctttgctgctatcacttgctggctctttcgctttcgctcgccgctactgacaaaatctcggttgatttcttttcctcggggtacttagatgtttcagttctcccggtttgcctcaacagactatgtattcatctattgatagtagattcttcatctactgggtttccccattcggatatcttggattaaacgcttcttatcaactcatccaagcttttcgcagattagcacgtccttcttcgcctctgattgcctaggcatccaccgtgtacgcttagtcacttaactatacaacctcaaacatttttatctaaaagaaaaaacatttaagactgatattaactactaaacacttaactgcttttgttcagttaagattttttactactcagactttcttgtttcagggcaaatatgatttgcccctacagaaaatctctcagttttcagcttgtttccaattttttaaagaacaatcgataatcacctttcggctaatcatcatatttaaataaacaactcactgttcgcttaaatatgatgattggtggagataagcgggatcgaaccgctgacctcctgcgtgcaaggcaggcgctctcccagctgagctatatccccaatgtcatcacatcgctttcttcgtttcactcactattcagtatagatttctcttcaccgtttagagtggtgggtctgagtggacttgaaccaccgacctcacccttatcaggggtgcgctctaaccacctgagctacagacccaaaaggatgtcttcgttctctttcttgtctacaattaccaaacaatctgtgtgaacacttgcaaatctcttcattcaggtaaggaggtgatccaaccgcaggttcccctacggttaccttgttacgacttcaccccagtcatgaatcataccgtggtaaacgcccccctttcagttaagctatctacttctggtacaacccactcccatggtgtgacgggcggtgtgtacaaggcccgggaacgtattcaccgcgacattctgattcgcgattactagcgattccgacttcatggagtcgagttgcagactccaatccggacttagatgcactttctgagattcactccacctcgcggcttcgtcaccctctgtatgcaccattgtagcacgtgtgtagccctactcgtaagggccatgatgacttgacgtcatccccaccttcctccagtttatcactggcagtctcctttgagttcccgaccaaatcgctggcaacaaaggataagggttgcgctcgttgcgggacttaacccaacatttcacaacacgagctgacgacagccatgcagcacctgtctctaagttcccgaaggcacaaactcatctctgagttcttcttaggatgtcaagagtaggtaaggttcttcgcgttgcatcgaattaaaccacatgctccaccgcttgtgcgggcccccgtcaattcatttgagttttaaccttgcggccgtactccccaggcggtcgatttatcacgttagctacgggcaccaaacataaagcccaatccccaaatcgacagcgtttacagcgtggactaccagggtatctaatcctgtttgctccccacgctttcgcacatgagcgtcagtattttcccaaggggctgccttcgccttcggtattcctccacatctctacgcatttcaccgctacacgtggaattctacccctccctaaaatactctagccacccagtatgaaatgcaattcccaagttaagctcggggctttcacatctcacttaagtcaccgcctgcgtgccctttacgcccagtcattccgattaacgctcgcaccctccgtattaccgcggctgctggcacggagttagccggtgcttcttctgtgactaacgtcaatgtaatgctctattaaaacatcacccttcctcatcaccgaaagaactttacaacccgaaggccttcttcattcacgcggcatggctgcatcagggttccccccattgtgcaatattccccactgctgcctcccgtaggagtctggaccgtgtctcagttccagtgtggctggtcatcctctcagaccagctagagatcgtcggcttggtaggcctttaccccaccaactacctaatcccacttgggctcatcttatggcaggtggcccgaaagtcccaccctctagtccttagacattacgcggtattagcgacagtttcccgtcgttatccccctccataagccagatccccaagcattactcacccgtccgccactcgtcagcaaagaaagcaagcttccttcctgctaccgttcgacttgcatgtgttaagcctgccgccagcgttcaatctgagccatgatcaaactcttcaatttaaaaagtttaatcgctcaatatgtactgactataaaaaaatcacgactgaatttattcaatcattatgaatttcaagttaagcacctatcaagacttcaaaattaaaaaatatttttaaacaaagtcaatcaacaagtgcccacacagattgtctgataagttgttaaagagcaaaaaagaacgacgcactgtcaaatttaactactcacaacagcgcgtcgttgtgtggtgcgaattatagagaaatcctaaaccaacgcaagtactttttgcaaaaaatttgaaaaaatgatcgcttgtttaaaataagctcataatgtttatttaaaaaacagaggttgtttatattttcatagacatatttacaaaatatcatacaaatatgctattagataacaaaaaggattagacccactcaaatagatctaatccttatggtatcaatttcatatcaccaattcacaggtaacttacttgtacaacttaaatatttagaaacgataggacagattggttccaatagcatttccctttaattttgtaccatttcgtttcaaattattttttgagtattctaaacctacttcaatatcattagagattgcatattttacaccaatcgcatatccaatccctttgaaactaccaaaatccgatattttactaatactataatgtaatttaacgtatggtaatatatctggtaggagacggtatccttgagcatatccaatactatattgggatttttgtttgatatcatgaaaaatattgctacttcctaattttgctttaccatcaattattccaattaaattcctaccataatctattgcatagtctaaagtaaagtttatgcctattgcctgcttaccttgcaaatcaccatttttatattttgtagttgtaacatccataccaattcccccacctgtaaaagtttcacctacaggcgcagctaaagcagaacttgataacaaagctactacgataaatcttttcataataaatctcctattaagttagcgtagaaaatatcattttattctaatgagatagatatatatcaaaccgatgttttttagtttccttacaaaaatcaggtttcttatttgctaaaaataatgcatagttaggtctttttacaaccactctctttctagcaagttgctgagcagggaaaagtaaatcatctgaatctaaatcacagccaaccaattgttgaaatagttgcatctccttttttactaatgcacttttagtcttagacggatacataggatcaagataaacaacatccaccgagtcaagatctggatttaaaccagtaatagaactatgaggaagtaataccattctttctctcataaaatgaccaatttctaaatctttataagctctttgtaaaccatcttccaataatgcgccaacaattggattacgttcaataagtttcacatagcaacctattgatgccaaaacaaaagcatcttgccctaaacctgctgtcgcatcaataattgtaggagtgtacgaacccttaacaccaacagctttcacaatagcctcattacgaccaccgccaaactttcgacgatacgacatttttccatcaacaaaatttacagctacagcacctaatttaggctgattaagtttccttaattcaaggcgttcattagtctgtactaatgctaaattagagctaggattatgcttcaatttccatttttcacaaatatcataaaagcgctcagtaaaatcactttcattaattaattgaatattcatatcatgaggtttaaatacaacataggaacaattctttgttcccatgttataaaattactttttaacacgagtgtgtaaacctttcttctctaagttacgataaatcaaccactgttgtgcaatcgtaattaagttagacgttagccagtaaagtactaagcctgatgggaaccataagaagaatacagtaaacatcacaggcataaagttcatcactttttgttgtactggatcagcaattggggtcggcgacattttttgtaacaagtacattgaaccacccattaatagagggaaaatgtagtatggatcttgtgccgataaatcttgaatccaaccgaagaatggtgcgtggcgtaattccaccgcttccataaatgtccagtataatgcgatgaaaattggcatttgaagaagaattggtaaacaaccgcccattgggtttactttttcttctttatacagtttcatcatctcttggctcatacgctgacggtcgtcaccgaaacgttcacgcatctcttgaatgcgaggttgtaacatacgcattttcgccattgaggtatattgagctttggttaatgggtatagaatggttttcaccacaatggttacaccgataatagctaagccccagttagacacaatactttgaatgaatgttaataaccagaataacggttttgcaatgaaccacgcccagccataatcgacggttaaatcaaagttatttgccacttgtgccattgctgcttgatctttcggtccagtccataaatggcttgtaatagttgcttcaccgttaggtgcaacttgtgttacgggtccacgataaccgatagtgcctacgccatttcctgtgcgagtataaagattattttccgcatcttgatttgggatccacgctgatacgaaataatgctgtaaaaccgctgcccagcctgctttagtatctacagataagttagcttttgccatttcatcaaaactatattttttatagttcacttcagaagatgaataagccccccccgtataggtcggcattgcaaaattgccggcactttcaactaaagtatgtttaagctgaccgtaaggctgaacttcgagagtttctgcagcaccatttttgatgtgataatttaccgccacattatagctaccacgttttagggtaaatgttttggtataaactacaccatctttttcaaatgttaatggcacggcaatttcgtcttgaccttctgctaacgcaaatttctctgctgtagcttgatactgagcgcgacctgctgtggtatcaatcccgtttttaccaactaacccactttgtgccacatacagcactttgccattatcttgtagcaattcaaatggtgtattagagtctaattctgcgttatattttaagagatcagaatcaaccacatcaccacctaaagtatcaacggttaaacgtaacacgtccgtttcaatagtaatggtttttcctttagttgattgctcattgatagatgccgcattagatgaagcgggtacatcactcgattgatttgcaacttgttgtgtttgagcttgagccatcgcttgtttttgtgcttggatctcagggttataatcctgttgccattgcgtaaaaatcaagaacgaaacaagcaacaaacccataatcagtaaactacggtttgagttcattttaagttctctgtggttaaagtgaagtggaatagcccactatggaaaattagacattttaatataggataacaaactatccaacgccttttacaagatagcggttggatttttttagagatttactaaaaagtacggcttcttgcaaacaaatgctcacaaatcaaacaaacttaggattttcttactaatattaaagcaaaataatgtgatgaacgccacattttgaagaattacttcttttttattcttacgaaatccgacaaaataagtgtcatttagcaagaaaactcgtataattacgacgtttttatttttttattcttacaagaggtacacacaatgggtggtattagcatttggaatctagtcattatcgttttattagttgtcttattatttggcactaaaaaattacgtggattaggctcagacttaggcgaatctatcaaaggctttaaaaaagcgatgaatgacgacaaagctaaagacgctgaatttgagaaagtagaacaaaaaaccgcagaatctactgaacaaaaagctaaagaaaaagagcaggcataatccgtgtttgatataggtttttctgaattagttttggtatttatcgtaggcttagtggtattaggcccgaaacgcctgcctattgctattcgtacagtgatgggctgggttcgcactattcgaggattggcagctaacgttcaaaatgagctttctcaagagctaaaactgcaagagttgcaagagagcattaagaaagcagaagagttgaatttaagtaatttatctcctgaattgagcaaaaccgtagaagaactcaaacaatctgcacagaaaatgcaagctaacttagactcagcgagagggcaaattgaaagtctgacgcaagagcaagttaatgaaattcaaaataaaattgagcaagagagccagcaactttctcaacaagctgaacagcaaaaagaaaccgaaaacccaccgcttgaaaccgaaacgctttcggcggatcgcattgcagaacttgctgaagcagacgaagaaaaattgacggcgtattatcccccagatgacgatcttgcaagtgttgagcctaaaacgaaacaggataaataatgtcagtcgaagaatctcaaccccttattagccatttaattgagcttcgtaaccgcttgttaagagcggttatttgtattttagttgtcttttgtgtccttgtttattgggcaaatgacatctatacattactttctagcccacttactgaacgtttacccgaaggggcaacgatgattgccacgaatgtggttacaccgtttttcactccgataaaattaacggcgattgttgcagtatttatttccgtgccttatattttgtatcaagtctgggcatttatcgcacctgcattatataaacacgaaaaaaagctagtttatccactgttaatctcaagttctctgcttttctatattggtgtggcatttgcgtattatgtagtctttccgctcatttttggcttcctgacccaaacagcccctgaaggtgttgtaatggcaacagatattaatagctatcttgatttcattttgactatctttttagcctttggtgtctgttttgaagtgccagttgcgatcattttactttgttggtctggcgtaaccacagcagaagatctcaaagagaagcgtccttacattattgtggcagctttcgtgatcggaatgttatttaccccaccagatatgttctctcaaacattactagctgtgccgatgtgtctgttatttgaactaggactactggttgctcgtttttatcagccgaaagatgatgaaaccgagtcaacagcacaatctgaataaataactatagaggcacaaaatgtgtctctatgtattttagataatgtatattctgctcaatagccatctgacgtagtattcccgcatagaatacctttaatcaacttttgagagccaatacattctgaaattgaatattgattcaaatattgatagaaatgttcaagggcgtgatctaagacagatttcaggtgacaatgcggttttaaaatacacacaggagaattgcaatctatcaatctgggattgccttgcaaggttctaatcacttcgcccacaggcatggagagaatgagagaggaaattctaataccgccaccttttccccttgcggtgattagccacccttgttttgccataaaatgcaccactttcaccaaatggttctgcgacacttgaagcgattctgctaactgcggaatggtgcgaagctcatcttgatgatgagcaagatacatcaatacacgaaaagcataatcagtaaatttacttaggtgcatagttccctccatacttgataaagttgggcattaatgcccaacttatctttcccattactcgtgagaggagagtaataaattccccaaggttttcaccccaatccccgttgcacctgctgcccataaatcacttgcagttttgcggaaggttgcagaacagtcaatgtgtaaccaattttgctgataattttccacaaaataggataagaaggctgttgcggtacttgcgcctgcaccaacaggaacagaaccgatattggcaatatctgcaaaggaagatgaaatttgagcacggtggaactcttcaaacggtaaacgccagaaaggttcgttttcggctttggctgcctcaaataaacgggcaactaattgatcgtccattgatagcactgaatggtagtcattgcccactgccactttggctgcgcctgttaaggtcgcacaatcgacaataaactgcggtttctgtttgcttgcttcaattaaaccgtcggctaacactaaacgcccttctgcatcggtatttaacacttctgcagttacgccattgcgataagtaataatatcccctaatttgaatgctcggctactcaccatattttctgcacagcaaagatagagtttcacacgttgttttaagccacgcgcaatagcaaaacctaatgcccctgtgactaaggcggctccacccatatcggtacgcattgtggacatactgtcacttggttttaagctataaccgcccgtgtcaaaggtaatgcctttaccgaccaaacaggctaatactggtgcatctgggttgcccgttgggttatagtcaagttgtaacatcgcaggtaaatgagcagagcctttaccgactgtccaaatgccgtgatagccacgttcatttaatgcttcacgagcaacgatttcaaaagaaaccttacctttgcctacatatttatcggcttggtgtaaaataaattcagctgctttgtgagccaacacttcgggggttaagcggtcagatggttcgttaataatgtcacgagtaaagctgctacacgcaaggcgagcatcaaattcggtttgttgttcatttaatgcaggataggtgactgagcctgcatttttcacgctaacaaatccttgatggaacgcccaacactgctctaatccccagccttcgcctgttaaggcaacatttaaaatgttctgatttttgattttgcgagctgcttgttgaatggtggttaattcatcttttaccagatgaattgtcataccttgatcgtttgccgataaaattgcattttttccccaaacttcaggggcggcagttaatgataatgtgatttgcattgaactcataaagactccttgatatatagctatataaatacttttacacttcatccaatataactttgaatattgtcaataaagtattattgccaatcctactaaaccccctactaaaagtctatcgttcagttcactctaagatacattgtgaaaaaataaacacatatcacagatattattcattttttttaacatgatgtaataatcaaaaattgggaatgtatcttcaaagctaataacaagtaatgaatcaattaattttggtgatctcttaagcgatcaccaagagctaaggatgaaaacgaaagtaaagaagagcagctcttaagccttgattataagagtttaatctatcttttacctctcaatccgcccaaacttcccactttgtacatcacgcatagcttggataatttcttctcggctattcatcacaaaaggcccataacctacaacaggttcatttaatggttctcccgtaagaattaacagtttagcatcgttattcgtctcgatctgaacatcagcaccgccacgttcaaaggtcactaactcaccacgacgagcaatgtcctcgccattaatttgtactgtgccatctaacaccaaaataatcagattatggctttctggtacagcaaaagtatgaactttacctgcatttagtaccacatcccacatattaatcggactaaaagtactagcaactcccgaagtacttgatagctctcccgcaataatacgagccattccagcattatcaccaagttgcacgacaggaatatctgccgatttaatagcctgatattttggtgttgtcattttgtgagctttcggcaaattcacccaaagttgcaccatctcaaacattccaccttctcttgaaaaacgctctgagtgaaactcttcgtgcattacacctgaacctgccgtcatccattgcacatcacctgtcccaatagtaccgccaccaccataagagtccgcgtgagcaacttcgccttgatacgcaattgtaacggtttcaaaaccacgatgcggatgctcgccaacaccacgaaaatccgatttgcgtccaccatcaaaatggtgaggtgggttgtaatccatcaataagaatggatctaaatttttatcggtatcgttataactaaacattgattgaacgtggaacccattacctacccagtgttttgctggtgccgtatgaacatttgcaacttttttcattttgttatcctttgtttatagttaaatgttgcgagtgatttatcacatcgctcttgatggggtgcattataatcttacctgaaatttgataaatatagattttattgattaactatttaatataagtaaataataaaaagaaaaatcgcaaaaaaagataaaaccattataatgtcgcctttcacagcggtgcgataatgcaaaaatattgcaacatcgtaccgcttatttattcaaccgtggttcgcaaacctcccacgcaaaaaaaactaaggaacacaatgaaacctacacctaaagccgtcgtaattttttcaggcggacaagattctacgacttgtttatttcttgctatcgaagaatttggcaaagaaaatgttgaagtcgtcacctttcaatatggacaacgccacgccatcgaattagataaagcccgttggattgcacaagatcttggcgttaaacagaccttaattgatacatcagtgatcaaagccattacgactaatgccttaatggacgatcaagctgaaattaagcagacaggcaacacgcctaacacctttgtggatgggcgtaatgcactttttctactttacacagccatttatgccaaaagtcaggggatccaaaccatttatacaggtgtatgtgaaacagattttagtggttatcctgattgtcgagatgtattcattaaatcaatgaacgtaacgctgaatttagcgatggattacaacttcaatatccgtacaccgttgatgtatctcacgaaaaaagaaacttgggcgttagctgatcaacttggggcatttgactatatccgaacccatactcacacttgctatcttggcgtagaaggcggttgccatacttgcccaagctgtttgttgagagaaaaagggttaaacgaatatttagaggaaaaaagcaatgtttaaaatcgccaaagaatttagttttgatatggctcatatgttggatggtcacgatggcaaatgcaaaaatctgcacgggcacacctataccttacaagtagagattgctggcgaattacatacggacggtgctaaatcgggtatggtgatggattacagtgatctcaaagtggcggtaaaacagcatattcttgacaaaatggatcacgcctttatctacgattcgacaagcgagaaagagtgtaaagttgccacattacttcaatctctcgattccaaaacctttggtattcctgctcgcaccacagcggagcagatggcgaaatacatttttgacacactcacaacggaaggactacctgttagtcttattcgtctatgggaaaccccaacgtcttattgtgagtactgccgataatgaaaaatccagaataccgaattgtcgaaatctttgaaacccttcaaggcgaaggattcaacacaggtatgccgagtatttttatccgctttggtaaatgcaatcttgcttgtccctggtgcgataccaattacaaccaatacgaaaccaaaacccttgcagatattatgcaagtggtcaaaggtttttccgcaaagaacatcattattacagggggcgaaccgacaattcagcccgatttagcgtatctgctcgataccttgaaagcagaaggttattttattgcaatagaaaccaatggcttaaaacccgttccgccacaaattgactacatcgccactagccccaagcggttatatcagaagaattatttgaaacatcacattccctttgcgaatgaagtgagaattgtggtggacggtgatgtgctagcgttttgtgagcagatagaaagcaccatcaaagcagagcgttactacctttccccttgtgaagaaaatggggtgatgaatatgttagaaaccatcacccaactaggaaaacttaaccagcgtccgaacaaaccccgttggcagttaagtattcagacgcataagatggctgggattgagtaatactgaaaacgcttaattgttgcaattaaactattctgctacttttacttcttttgtcccacaaccaaaattaataatctcttgctcagacataagaggataacggcattgcatttttagatagagaattccctcatctgatagagtgtcttgataacctactctagcctcttctggggatagccccgaagtgtcttgataacctactctagcctcttctggggatagccccgaagattcttgatgtctatttatactatattgtaacgatttaggtttactagatttctgagattctggctcattgatatcttgcgccaataatgaattttcattattgctatccacaacagaagcctgttcattttgaactgaaatagattgtctagctccagccttttcatctgatgaggaggcctctgttatatccttcttagaatcaggaatttttacttgggaagctcccgcttctgagacctcagattttagagattcaacttttggtgactcaacttttggtgactcaacttttggtgactcaacttttgatgcctcaacttttgatgcctcaacttttgatgcctcaacttttgatgactcaacttttggtgactcaacttttgatgcctcaacttttggtgactcaacttttgatgcctcaacttttgatgcctcaacttttgatgcctcaacttttgatgcctcaacttttggcgactcaacttttggcgactcaacttttgaatcttccgcttttagtccttctacatcagctttatcttctcccttttcttgaataatatccttcttaggttgttcaaagcaggcagttacagaaaatatagcaataaaaattaataatagtttattcataaaaaatatccttaaataaaaatcaacgcattgtcacaaactcttccgagcctgttgggtgaatggcgactgtgttatcaaaatcagctttggttgcccccattttgattgcaacggcaaaaccttgcatcatttcatcaacaccgaagccaatgccgtgtaagccaacaattttttcttccttgccgacacaaactaatttcattcggcaaggttggcggtgttgtgttacggcactgtacattggggtgaatgaagatttataaactttcacattttccgcaccgtattgctcaaccgcttttggctctgttaaaccaatagtaccaatcggcggatggctgaaaactaccgttggaacaaggttgtaatccaaatgttcatttggcctattgttgaataaacgctctgataaacggcgacctgcggcaacggcaacaggggttaattcaattccgccttcaataatatcgcctacggcatagatgccttcgacgttggtattctggaatttatccaccttcacaaagccacgttcattggttgccacacctgcagcctcaaggttaatcacgtctgttgctggttcacggccaatcgcccataccaagcaatctacgctttgttcttcagcattttccaattttaacgttaaagagccatcagcatttttaacgacttcttgtggaatagcgtgagtatgaagttgaataccatcttggtgcatcacttctaataaagtttccacaataagtggatcgaaagtacgcaaaggagcgtgttggcgaacgaataaatgggtttctgcccctaagctgtttaatactcctgcaagttccaccgcaatgtaaccagcccccacaaccgcaacacgttttggtacatcatttaaggcaaaaacaccatcagaatcaatgccatattccgcccctttaatcgcaggacgacttggacgaccgcccgttgcaattaaaatatgatcagccgtgatttgctctacgccaccgtctgccaaggcaacttcaacggtattcttattcacgaattttgcaaacccacgaataacatcaacattgtttctggctaaaacgttattgtaagaagtatggatacgtccgatataggcttgacggctttcgactaatttacggtaatcaaaacgattgaccgtcacatcaaagccgtaatctggtgcatagcgattgatcgcttcagcaatttgagccccatagaacatcacctttttcgggacacagcctacgtttacgcaagttccgcctaagtgttttgcttcgataatggcacattttttaccataacttgccgctcggttaatggaagcaataccgccgctaccaccgccgatagcgatgtagtcgtaatgtttggtcataaaaggttccttaaaattatctttatttcatatcaatgacacacattaaaaaaacatagccacatccagccataaaagatatggctgatttgactattacttcgcaatacgcttatatttaatacgatgtggttgggttgcttctgcaccaaaggttttctttttccactcttcgtagtctgagaagttaccttcgtagaaggttactttaccttcatcaccgtaatctaaaatgtgggttgcgatacggtctaagaaccagcggtcgtgcgagataaccattgcacagcctgggaactctaagatcgcattttctaacgcccgcaaagtttccacatcaagatcgttggttggttcgtctaataataagacgtttccgcccgcttgtaataatttcgcaaggtgtaaacgaccacgctcaccgcctgacaattcgccaacacgtttttgttgatctacgcctttgaagttaaagcgtccaacataggcacggcttgggatttcaaagttaccgatagttaaaatatcttgtccgtttgacacttcttcccacacggttttcttgtcgtccattgcatcacggaactgatccacagaggcaagtaccacggtttcacccattacgattgaaccgctatccggttgttcttgacctgaaagcatacggaataaggttgatttacctgcaccgttcgcccctataattccaacgattgccccttttggtatgctgaaagataaatcgtctattaaagtacggtcgccgtaagatttagttaggttactcacctcaatcactttatcccctaagcgtggaccaggtggaataaagagttcgttggtttcgttacgtttttgatattcgcctgagttaagctcttcaaagcgtgccatacgcgccttgcttttcgcctgacgacctttcggattttgacgtacccattccaactctttagcaatggatttttgacgagcattttccgccgcttgttcttgctctaaacgtttctctttttgctctaaccaagaagagtagttaccttcccaaggaataccttcaccacggtcaagctctaagatccaacctgccacgttatctaagaagtaacggtcgtgggtaattgccaccacagtgccttcatagtcgtgtaagaaacgctctaaccacgccacagactcggcatctaagtggttggttggttcgtctaataacaacatatccggtttttcgagcaataaacggcaaagagccacacggcggcgttcgccccctgaaagatgttcgattttagcgtcccaatccggtaaacgtaacgcatctgccgcacgttctaactggttatccaaattgtgaccatcgtgagcttgaataatcgcttctaattgagcttgttcagctgcaagtttgtcgaagtccgcattttcatcggcataagccgcatagacttcatctaaacgagtgagtgcgtttttcacttctgaaaccgcttcttcaatggcttcacgcacggtttgctgtggctctaattttggttcttgcggaagataaccgattttgatccctggttgcggacgagcttccccttcgatctctttatcgatcccagccataatgcgtaacagggtggatttacctgcaccatttaaacctaacaccccaatttttgcccctgggaagaagctcagtgagatgtcttttaaaatatgacgcttcggcggaacgacttttccgacacggtgcatcgtgtaaacaaattgcgtggacatatacattccttttctgacaaaaattagggggtattctacttgaaatcagggacaaaatatagctttgcccccgaattgttactgatctttccaatctgcttgaattttcttatgttcataggggaaaaacagctgatcgataatttgtcctttacgttcattagaaatctgattaaaccaaaactctgcctgtgataaatttttctctacgcctgcataaccgattatagagtttcattgtttgggctgatgtaacagaagtaaaaaaagaaaaagggcaacaagaatggatttcaacataatgctctcctaaaagagttgctgtaaaagtagatatatcgaaaggcggattgattttataagaaattttacgtttttcctacaaaacaaaagatcaaacccaagctcacatacgccaattatttggggcgtagctagattaagttttatcttcttaaattaccctatattgatgttagaacgagtatcttacattagaattaacagataaatccgtattatattttccaaacacagagccttctaaactcaagcctatacttaacttatcattagctctgatattaagtcccaagtccatcaacattctggcatcttttttgctattgctagcacttataccatctaccaaaatttcattgcgttttgcaatatcccattgatagccaatgccagcccaagcggtcgctttgctctgtccaatttcaaaagttttacctgcattcacacccaaacgaccaaccagcccatttgaggcttttatggttaatttatgtccgttatcggctaaattagcttggctatttttgacataaatcacttccgcttgtggttcaacatagcctgaacctaagttaaatctatagccaacttcaccacccaaatagaatgaatgggtgtgatattgttgagatttaaaatctaacttcatttctttaaatgcgtagtcaaatttatggttatttttgacatatttagcgatggtatcaagataaaagccgttatcaaataacgctgttgcataaacgcctgcaccgatagattttacatcgccgtttgttgagccgatttttccttcaatgtctgttgaagtatgcgtcactgttaccccagtaaataactctgcatttgaaaggtggctttgtttatcaaaacctgtctgaatatgggtaaatttatgcttatagctatcgctactgcctttaccgcctaatactctagcccatacgcctgcattggcgtcaatgccacgcaactctcccattctcttattgagattgttcatttcaacgtggttaagatcagtatgcaatgaagtaacttcattagcttctttgatcgcagcttgatttggggatttcgtgatatggatatttccattctggccttgtttgaaatcatagattactaatcccttattactaactaacgactgttcagtttttggattaatcaaagttatgtcaacaccatctttttgcacaatataaaatgttacatctcccatattcttagtgataaaacttagttctgggtacgaattaatttcctttgttaaagattctgtcgctttgcttatgataggatcttttgcgttgctttctgaactatcaacaataatctttttagttccttgatcgttaggtagacttgatgtatttggtgtattaattacactaacctcattactactattttcaacatttgccgaagatactgtcgaattattacctatatctaccccattactgttttcgatattttccggtgtatttaccgaatcattattttcggatgctgaacttacagtatcatctgatgccgatgcagcattaatggcttgatttgaatggccactattttcaacttttgttggaagatttgttgagttattgctagtagtagatacattctctacctttgtagtattagttgctgtactattaattgaacaaaaactttctgacacaccaggagccaaacttaacctacaatcctcacgattagatgtatctttataagtaccattatttcttgcctcatctatactgaggtaggtaatactataaatatcataaagatccgttacatacatgcgaccaccgtcaacggcatagctgtaaagaaaacggaatatatcatttcctttattgtcttttgcgtaatttcctaccacctcaaccattttaagatttccagctttatccttaacagaatcactaatccatcctttttttatcttaccatccccatcaacttcaattccccataaggttacggtatggtgctgagaagtgagtgctgcaacaacgtttcctgtcttaaaattatcaattaaagatttagtgactaatttggcatccgagtcataacgttccgtccagaatggaccaccactaatttttgttggacctctctcactttcataatacgtttttttattatgttcttcgtataattttactcctgatgcaaaacgagagaaaaaatactccatacctcgatatggttgtaatccaccctgtatatgcggataagttttatatatccatcctgaaatggctttgctatctttaggagtatcctcgttaaattctacttgcgcttttactctacttttccaccatccgagagtatttcctgcaacagcgccccaacactgatttggatattgtaaatcagcagtccatccactattttgattgactccacttgcccaataagtctgagcttcaactacctgtacagatgaagaaaaaagtgtcgctattacgatcttcgaaagataaggtttcattatgttctcctttaaatcattggatgtgtttttaaattgtattgacgaatcattgtaaatttttttagcgcttaacactttgtaccagcgcaagatatatctaagattccctatattatgtagtatagcttaaaaatattgaatctctttatatttcatatacgttttttatatctttgagacactattttctcgtcaaataatccccttcacacacccatttataggtcgtgagtgcttctagccccataggtccacgggcgtgtagtttttgtgtgctgaccgccacttctgctcctaagccaaattgtgctccatcggtaaaacgagtacttgcgttgatatataccgccgccgcatcgacttgttgaacgaactggcgagccaaagcatagttactggttaaaatcccttcggaatgttggctgccataggtacgaatatgctcaatcgcttgctgaataccatctacaactaccacgctcaaatccaacgacaaccactcttgacgtaattttgcttgttcaagcggttggatttgcggatttttctgcagatcttcagaaaaatcatcgctatgcaatgtcactttcaatttgcaaagatgttcggcgagtttcggtaaaaactgatctgcaatcgccttatcgaccaacaaggtttctagggtgttacaagtacttgggcgttgggttttcgcattggcaatcacatttaacgaacgctctaaatccgcactggcttccacatatagatgacacaccccgataccgccgacaatcactgggatagtcgagttttctttgcagaactgatgtaaacctgctccaccacgcggaataaccatatcaatgaactgatccaacttgagcaattcgagcaataatgcacgatcaggatcagtgacggcttgcacggctaatttcggtaagccagcctgctctaaggcagattgcacgacttcaaccaaaattgcattggtaaatttcgtttctttaccgccacgtaaaatcaccgcattgcctgttttcaaacagagcgaagcaacatcaatggtcacattcggacgagcttcgtaaatagtcaaaattacccctaacggcactcgttggcgttcgattttcaacccactatccaacacaccgccgtcaatcacctgcccgacaggatcggcaaggctcgccacattccgcacatcatttgcaatcccacgaatacgctcaggtgttagcaacaagcggtcgattatcgcctctgaaatcccttgcgacttggcataatcaatatccttcgcattgaccactaaaatctcctcggtacgctgttccaacgcatcggcaattgcgaacagggcttggttcttttgaacattgccaaactgtactaactcaaagctcgcttgtttggcttgttgtgcaattttaatcattgtcatagttgattctctgtaaaaaataataggagagattttagcatagaatgttggatatatgattatagatagatattaatgctaattctcaataaataatgcttcctgttcatcactaaatccgatacactacgcaaacgtttgctttttgcaagcggtcagatctttagcgattttttacaggggaatttcaatgaatattttgattattggcaacggtggtcgtgaacacgcattggcgtggaaagttcgtcaatcacctttagcggaaaaggtttttgtagcgcctggaaatgcaggaacagcgcttgaagctggaattgaaaatgtggcaatttctgcaacggatctgaccgctttagtcaattttgccaaagaaaatgaggtggggctaaccattgtcgggcctgaagcacctttagttatcggcgttgttgatgcattccgtgccgctggattaaaaatttttggtccaactcaagctgcagcccagttagaagggtcaaaagcctttgccaaagactttttagctcgccacaacattccaacagcagaatatcaaacctttactgaaattgaacctgccttagcctatttataccagagaaatgctccgattgtgatcaaagccgacggtttagccgcaggtaaaggggtaattgttgcaatgacgctggcggaagctgaagaagcagtgaaagatatgctttcaggcaatgcgtttggtgacgcaggtagccgtgttgttatcgaagaatttttagcaggtgaagaagcaagttttatcgtgatggtcgatggtaaaaatgtcgagccaatggcaaccagtcaagatcataaacgagtgggtgaaggcgatacaggcttaaatacaggcggaatgggagcttattcccctgcccctgtcgtcactccagatgttcatcaacgtgtgatgcaagaaattatttatccgacagtgcgtggtatggcaagtgaaaataatgaatatacaggttttctctatgcaggcttgatgattatgccaaatggacaacctaaggtaattgaatttaactgccgtttcggtgatcctgaaacacaaccgattatgatgcgattggagtcggatcttgtcgaactctgtctaaaagcctgtgacggcaaactaaacgagatacaatcaaaatggtgtgaacaagcagcgttaggaattgtgcttgctgccgaaggttatcctgcagattatcgtcaaaatgatgaaatcacgggggttccgacagattattgtgctgatgaaaaggtctttctcgcaggtgttagccagcagaatgggaaattagtcacaaaaggaggacgtgtactctgtgccaccgcattaggttccaccgtatctgacgcacagcaaaaagccttaaaactggctgaacagatccagtggcaagggcgtttttaccgtcgagatattgggtatcgtgcgatacagagagagcaatgtaaagtagcgtgatgaaataggcggtagataatatcgacattttcataaccatatattgagcttgctcaaagttttatctgattaaaaagtttacaatcacccatcggtgaaatttaactgatggttttttgtatttctcatcgttaatcaatgagctattataaaagcattcaaatttttcctaccagtataatttcagtattctttccataaatttaaaggagatcataatgaagccttatttttcgaaggccttgataactgctctactttcatcctctgttaatgttttggcagacgatgtctactgggcaagtggagttgataagcaaaaaggttggactgctgattttcaatatcctaaccaatgctggggagctgttgcaggaaatatgcttggttggtggaaaagagaattaaaaacccctgttttatttaatcccaatacaccaaacgataataaggagatttcaaaatggttaaataagaaatatccaaacatacagggaggattatacccatttcgtggaatggaatatttctttgaggattttgctcccactgttaagttatatgaaactcataatacgaaaacttcttatgaggcacagcgtgggccaacaaaaatcagtggtggtccattttggactgagcgttacgactctaatgcagctttagttacaaaatcattggttgaaaacttcaaaactggaaacgttgttgccgcgctaacatcatggacacatactgtgactttatggggcattgaggtagatgaaaaaactggcaaaattaaaaaaggttatatcagtgactctgtagcagatcaggcaggaaaccttaaaatggttgaggtgacaggggattatgtacttgataataaaggtaatgaaatttttcgttttctttatagttactatgttccaaatggaaataaatatgtcaccgatgtgtacgatatttacagcattacttatgtgagtattgatgaaacgcgaaataatggtacttataaagacaccactaaccgagaggattgtaaattaagtttagctccgggagctgatgctagttattgtggtattagtaacagtacaacaacgactactgcaactgaaaataatagttcaaccaatacagagacagtagctgagaatactaacgaagcgagtacagtcacgacagaaccagctccagaagaaacagatgtagatgctcaatcatcaaatacagagacatcggaaacagagactgtaagtgaagtccctccaacagaagaagctgttgcagaaacaagcgagcaaccgaccgctgtgccaactcctgaagttgcagagccagcacctgagcctactccaagcgtagcttcaactgaaacagcgactgtaagcgaggttaaaccaacagaaccagaaaccgcagaacatcgagcggtgaaatcgttaaaagcagctattgctaattatcaagagctaagttttgtaacctcccgtgtcggtgatgtaactcgttatcttattcaaagagaaggtattaatattgctttaattgatccaaatagcaaacagattttggtgaacaatacgggcttagtgaactatgatttaacacaagaccagaatggaaatatccatatcacgaaatccccaaatcaagctgcgatcaaagaagctaatgaagttacttcattgcatactgatcttaaccatgttgaaatgaacaatcttaataagagaatgggagagttgcgtggcattgacgccaatgcaggcgtatgggctagagtattaggcggtaaaggcagtagcgatagctataagcataaatttacccatattcagacaggttttgataaacaaagccacctttcaaatgcagagttatttactggggtaacagtaacgcatacttcaacagacattgaaggaaaaatcggctcaacaaacggcgatgtaaaatctatcggtgcaggcgtttatgcaacagcgttatttgataacggcttttatcttgataccatcgctaaatatgtcaaaaataaccataaatttgactacgcatttaaagaaatgaagttagattttaaatctcaacaatatcacacccattcattctatttgggtggtgaagttggctatagatttaacttaggttcaggctatgttgaaccacaagcggaagtgatttatgtcaaaaatagccaagctaatttagccgataacggacataaattaaccataaaagcctcaaatgggctggttggtcgtttgggtgtgaatgcaggtaaaacttttgaaattggacagagcaaagcgaccgcttgggctggcattggctatcaatgggatattgcaaaacgcaatgaaattttggtagatggcataagtgctagcaatagcaaaaaagatgccagaatgttgatggacttggggcttaatatcagagctaataataagttaagtataggcttgagtttagaaggctctgtgtttggaaaatataatacggatttatctgttaattctaatgtaagatactcgttctaacatcaatatagggtaatttaagaagatcaaacttaatctagctacgccccaaataattggcgtatgtgagcttgggtttgatcttttgtttttactaaagaggcatttcgaattgaccacagattaagagagaacttaatacaagcaaacaaaaccccaacagaatatgccacaagccattaagctatgctaaacttccccaccttaaggggaaataatatgaaaaatcttatcttcttttttaaactctttatccaccgctttcagcaaaacaaaattgcggtctattcagggtatttgacttataccaccttgctctctctcgtaccattgattatggtggtgttttcggtgtttacgctattaccgatttttgaacaagcgaccgcacagttaaaagagctggtgtacgataactttgccccaagtgcaggggatatggttcagcaatatcttgagatgtttgtcgataactcaaagaaaatggggatcatcagtatcatcggcttagtcgtggtggcggtgatgttgatttcgagcattgataatgcccttaacgaaatttggcataatacgaaaaaacgttcagtgatactctctttcgttgtctatttagctgtgctgatttttgccccgatttttgctggagcgagcattgccatcagctcttatattttctcgttggaaatgtttagccaagacggactgttttcttttagccaccacctgcttaaatttattccttttgtcttaacttggttgctgtttgccttggtttatcttattgtacctaacacccaagtgaagtttagacacgctgcggtgggggctttatttgctggagttttctttacgctgggtaaacaaattttcatctggtatatcaccactttcccatcatatcaggcaatttatggtgcgttagccaccattccgattatgattgtttggatccacctgagctggcaagtggtgttattagggggacaatttgcttccgtattaaaagatatggaaatgatcaaagcaggcgaattagcaaatccattaacggaggacagagaatgatcggattaattcaacgagtaaaatgggcgaaagtggaagtagataaccagactgtcggcgaaatttcaacgggactattagtattattaggtgttgagcaaggtgacgatcaggctaaggcagatcgcttactggaaaaagtcttgaactatcgtgtctttgccgatgagcaaggcaaaatgaacctaaacgttcagcaagcagggggaagtttattagtcgtttcccaatttacccttgccgccgatacccaaaaaggcctacgccctagcttctctcgtggggcaaccccagcacttgctcaagcactttacgactattttcatcagcaagcggcactcaaaatccatacccaaacaggacggttcgccgccgatatgcaggtcagcttacagaatgatgggcctgtcaccttttggctacaagtataggcacggcaatgtaccaacagttccagcaacaacttgcaaagcattgccctaatcagaccgctttcttcatcggtttaagcggtggggtggactcggtagtcttactgcatctgttcgcacaggctcgacaagcccttaaccttaaactcagggcaattcatatccatcacggcttaaacccaaatgcagatagctgggcaacattctgtgaacagctttgtgaacagtgggcaattcctttcactgtctgcaaggttcaagtacaaggcaagcaagggctggaagccaatgctcgaacagcacgctatcaagccattcaacagcatattcaacggaatgaaatattggcaaccgcacatcatcttgacgatcaagttgaaacctttttccttgcattaaaaagaggaagtggtattcaaggactaggggcaatgcaagcggtcagttttttgcaaaatattgcgattttccgaccacttctcagcttcagtaaaaccgacattctcgcttatgctgaacaacatcaactggaatggattgaagatgaaagcaacttcaacactgattttgaccgcaatttcctacgtcaaacggcgttacctttgctcaatcaacgttggcaacagtttaatcaaatggtggcacgctcaagccagcattgtgccgagcaacaacaactgattgaagaattgctacaccccgaactggctagtcggctacaaaatggcggtttagacatcacaggctttgagcatttttctttgttaaagcaacaacagcttgtccgtttgtggctggcacagactcatcttgcaatgccaagcgtggctcaactagaacagattatccaacatctcattttggcaaaagccgataaaaatccgcaggtcaaacttgaacaacatcttattcgccgttatcaacagcagatcttcattacccctattcaagcagagacagatgattttgagttggaactgccaccacaaagtgaagaaattcaactgcccacctctattggcattgttcaacgcaacggcacagagattatttacaaaatatcaggcaaatctcaccgcttgttattgccagaaacgttacaacaaaccccacttcgcctgaccaaccgctctccaagcaaagtgcagtgttacggcaaaaaccatcgagaagagatgaaaaagatttggcaggaaaatcgtatccccgtgtggttacggggacgtgtgccaattatcttttataaacaagtattaatagcaattttaaaaatctagtgcattctccacaaaatagttacaaaaataggattgctcgaagaatcatatccaacggccacaacaatccttgaatcttttcccagatcgacaaatacacaattttttcatagcaggcataggaactgttggatcaaaaaaataccaacgatcatctacatttacaaaaagagaacattcatgatgaatttgcacaccatcttctgtattaaagtaagccctaaattcaacaatactatgaattttagtcacattttcttggttggaaataatatcaagacctatccactgagtcttttggctccaatcttttattgcttttaggtcaagcaatgattgctgagcagggagtgtcgttctaactatatagtcaatcttaactttggtgtaagcagaataacgagaacgcatcaattcttcggctgtaataggcagtttttgagcaaaatgaaatggtttacagcattcatcatatgctagttttgattggcaaggacaaacataaaacataacaaaatctttaaaaagctctctatctaacttaatatctttatttataggaaaacattatgagtaactgttattactaaaactcatacaccatattaatatacggaattcaataactaacaacggcacactcacccacaacggcaacgtttcaaacttccaaaacgtacccgcaatcgctatgcctaaaatcattaaacgggaaaagcccgcgttattacgttgtgctttcaggctttgattgatttcatttaaacgaaaattaatctgtttttgttgttgcaaggcttgaaacatcgcttcagggaactcggcaaaatgttccctaaattgcggagctcgctgttttagatctcgccacatagccttaaagcccacttgttcattcaaccaatcctgcaaaaacggcttagcggtttgccataaatctaactgcggataaacctgtctgcctaatccttcaatataaagcaatgttttttgcaataacaccaactgtggctgtacttccatattgaatttacgggcaacggtaaacaaattcaacaaaacgtgtccaaacgaaatttccgaaaggggtttagcaaaaatcggttcgcagacttctcgaaaggcttcttcaaaagcatcaatatcggtatctgccggtgtccagcctgactcaacgtgcattaacgcaactcggcgataatcacgattgaaaaaggcaacaaaactttcggcaaggtagcgtttatcgttctgatttaaggtgccgacaataccgcaatcaatcccgatatattgtggattttcggggtgatttgggttcacaaaaatgttacccgggtgcatatcggcgtggaaaaagctatcacggaaaacctgcgtaaaaaacacctgcacaccacgttcggcaagcagtttcatatcagtgccgttggcttttagttcatcaatatttgctacaggaataccataaatccgttccatcacaatcacatttttatggcaaaaatcttgatacatttcaggtacatagagcatttcactgttttcaaaattattacgcaagcggatagcattcgccatttctttgcgaagatcgagttcgtccaacaacgttttttcatactcacgcaccacttccacagggcgtaaacgtctgccttctttatttaaacgtggaatccaactcgccaagcggtacatcaaggctaaatcgtccttaatcacacaatccatctctgggcgaaggacttttaataccacctctttacctgcaagcggttggttttgattaaattttgccgtatgcacttgagcaatagacgcagaagccaaagcggtttcatcgaaatcatcaaaccacttttccaacttatcgcctagagcctcttcaattaaacgacgagccagttttccgtcaaaagcttcaacagaatcttgtagcaacgcaagctgatctgccaactcaggttcaaacagatctcgacgagtcgaaagcatctgccccagcttaatccatacaggcccaagctcttgcaacgcaaggcgtaaacgcacgccgaaaggctcattcggatattgattttttacccaaaataacgacttccgcccacaacgaatccctcgtgttaacggaatatctggaatcacctcatcaataccatagcgaagaaaggtgtgaataatgtgataaagacgacgcaggtttttgatgttcatttatttcctttttttccaacttattcccttcccccgtaaacgggggaagggaaaataaattctaatttaatgctagttttgcaaacttctgctctaatctctccgcttgctgttccaactcttttacctgatcgcaaaaatcaaccacttgcaaacgatgaacaagcactgggcgttcgatagtcaggttatcaacaaggtgctgactgtcttgcacaaactgatttttcaccttggtaaaaatacctttggcgaagtccgttgaagcctgagccagtacatcaccgataaaacgtgagagcaattccgcaggatctttttccaactcgtcaagtaactgtgaaaaatgctgtaatacttgaatatcgcctgtcaaaatcagtgttttattattaatcaactcactcagtttacttttatccgccagttttgggagagctgtcgcatcaaggctcaccgcacaatcaacttcaccctcataattcgccagccaatccgcacggttttcactgaaaatcacaaaaagtataatattcggttgatttaactgaattttaagaattttccctgcaagtttgcgtaacatcggcgatgtttggggtgaacgttcaatcaaatgattaaacgctgtttccaatgcccctaacgcaaattgcggtaacatcaactgttgtaataacgttttcatttttaaaatttgtacccacgatgtaatgccacaatcccagcacttaaattgtaataaccgacattttcaaaccctgcattttccatcattccctttaactcgtcttgtttcgggtgcatacgaatagactcggcaaggtagcgatagctgtcggcatcattaacgaccacttcgcccactttcggcagaatattaaatgaatagaagttataaacttggctaatcggatcgataatcggcttagaaaattccaacaccagcaaacgtccgcccggtttcaacacacggaacatcgaacgtaacgccttatctttatcagtgacattacgcaaaccgaagctaatcacaatgcaatcaaaggtgttatccgcaaacggcaggcactctgcattcgcttgcacataattcacattgccgacaacgcccaaattccgcaatttttcacgcccgacttccaacattgagctgttaatatcggcaagtacaacttcgccagtttcgccaacaatacgagaaaatttagcggtgaaatcccctgttccccctgctaaatccaacactttctgcccttttcgcaccccactgcaatcaatggtaaaacgcttccacacacggtgaataccaaaagagagcagatcattcattaaatcatatttgcctgcaacgctatggaacacattggcgactaactgctgtttttcttctttggcaacggttttaaatccaaaataggtggtttctgattgtggttgttgagattgttgagcgtcgttcattgtttcgttctcatgagaaaaaattaaggcgtaccatatcaaaaaagcggtgagatttccttaattttttgctaaaaaattacgaacttaccatttcgcagtatattaatgttaatccttttctgccttagtagtaataacattattctatatatttcactttattaatgaaatcaagcaaaaatagcgcaaagaaggatatcgacttaatctcacactctataaataaaaaatctgcactttattatgttagagactaaacctaacgattaaagtgcagattcaatgatatgatttagtttacaaaaaaattaacccataccgtattttttaattttttacgcaatgtaccacggttaataccaagcattgtggctgcacgagtttggttaccgcgagtatgttgcataaccatatctaacattgggtgttcaatttcagataaaactaactcatataattcagttggatcttgaccatctaaatttcttaagtagttacgaaccgcttgttttacattttcacgaagtggtctatctacttgttgagcttgtgcatttaacattgatactgttaatgggttttgtgtcggttgttgttctaacattgtccttttatccaacttattaagattcttcacgaatcgattttacaaaatcttccaacgcctttaactgttctttcgtcgaatcaagggcattaaaagtacgtctaaaatttgcatttggtttaagctgttcgacataccagccaacgtgtttacgcgcaattcgataacctttttcttcaccataaaactgatgtaggttttcaatatgctgtaacattaattggcacttatcattaagtgataatgtcgaaacgagatctcctttctcgaaaaacttgccgatttccgaaaataaccaagggcgacctaaactgcctcgaccgatcatcacagcatcagcttgtgtatagtcaagaacccgttttgctttttccgcagaggtaatatcaccattggcaataataggaatcgaaaccgcttgtttaactgcctttatgctgtcgtattctgcttcaccttcaaatagacaacttctagtgcgtccgtgaatagttaaagctgagatacccgcttgttcagctatattggcaatttctaggcaatttcggttctcaggatcccaacctgttctaatttttagcgttacaggcacatcaacagcattaacgaccgcatctaaaatacgggcgactaaatcaggttcgcgtaaaagggcagagcctgccatttttttgttcacctttttcgctgggcatcccatattgatgtcaataatttcagctccgtaagcgacattgatttttgctgcttctgccatttcagtgggatcagatcccgcaatctgtacagcattaataccgatttcgtgatgatgcgataaacgcaatttcgatttttcggtatgccatacatcagggtttgtggacatcatttctgagaaagttaaacctgcacctaattggctacacagtcttctaaaaggttgatctgtaatccctgccatcggcgcgaggaaaatacggttttttatttcatattgaccaattcgcatcgacttatccattgattatttttagtacaaatttaacctaaacgatatccaaataaaaagtacggtgtaaaaccgtacttcacaacctttattcagtgttcagcatcattatcgcctactaactcagggatgcgtataatacgcattttttcgccatttgggaagtctatttattcgacaatttaatgaaaatttaaaattaatcaaacaattgttatctataaaagtggtgaacgagatttattcacccatttcatcacaacattctcaacgctcgactcaatttgctctcccacacgttgcgataattttttcttttgttgatatttcacttcaatcacgtcttgcgattttaccgcatctaaaatgagatcatcactagtagagagttcatcaacaaggttaaattcaactgcttgttgcccaaaccaatgttcacctgtcgcaattttttctatgtctaactgaggacgatgttgagcaacaaattgtttaaacaagcggtgagtttcctccaattcttgctggaatttctgtttgcctttttcggtattttcacccacaaatgtcactgttcgcttgtattcacctgctgtcatcacatcaacatcaatatcgtgttttttcaatagacggtgaatattaggtacttgagctaccacgccgacagaaccaattacagcaaaaggggcagatacaatcttgttagcgacacacgccatcatatacccaccacttgcagctactttatctaccgccacagtcaaaggaatggatttgtctttcaaacgttgtaattgagaagccgctaaaccataaccgtgaaccacgccacctggactttctagctttaacaaaacctgatctttctctggttttgccaaagcaagtacggcatcaatttctttgcgtaaagcagatacaccgctcgcttgaatatccccttgaaagttcaagacaaacaaacgggatttctctgcctcagggttttcttccccctcttttaagcgtttcttttctgctttcgctttctctttttctgcttttttctcttgtttttctttatgttttaactcagcttcacttaaaaaggcacttgcaagtgctttttcttgttcttggtatttctcagttaaattagtcagcgtaattgagcctgattctggctgtttacgactttctaaaatcagcattatcacaacggcgacaatgccaaagaccgtcaataattccagcaaaaagataccgtaattaagtaagatttctttccacataatttgttctctcttatgaaatatgtttaattcttcccatctaatccaagcacttgttagcctagtagcctaattcaatcggtaattcagatctaacccagccctcaaaaccgcctttgacactatatacacgctcaaaaccttgctcgacaaggtattgagctgtattacgactactcaccccgtgataacaactcacaatcacaggttcatcataatcatattcatctaaaaacttgccgtagctatggtttgttaagtgaaatgcaccttgaggacggctatgactaaaccttaccatatcacgaatatccactaaaacagcgtcttcattttgcatcatttcccacgcttgttgtggggtaatttctgtaaatgtttcttccatattatttcctctattgaaatcgaggaaatatagcattaaacacaaaattgtaaataaacaataagctattacagcagttgaaatttcaactcacttttatataataggaactattataaatgcgtaattctatacgcatttttttctttatatgataggacttttcaatggatcaactatttcaatttttacaaagctacatcgactatattattcttggtttattaggactaatgagtgtgattttatttgccaaaatcattgaacgagttctattttataagaaagtagaagtcaaagattacgaaacattgcaagagttagaaatcgatctcactgctaacctcaccactatctcaactatcggctcaaacgccccttatatcgggctacttggtactgttatcggtatcttattaacattctatgaacttgggcattccggtggggatattgacgctgcttctattatggtgcatctctctttagccctcaaagcaactgctgtcggtatcttagtcgccattcctgcaatgatgttttataacggctttggacgtaaagtcgaagaaaacaaattaaaatggcaagcccttgaagctcgcaaagctaaagcctaagcggtcactttctgccaaaatttgacaagcgacgaggatataatgaaaaaatttgacgaaataaacattatcccattcatcgacattatgttggtgttattggcgattgtattggttactgcctcttttatctcgcaaggtaaaattcaagtaaatgtgccgaaagcctctactacacaagcaatgaaggctgatgaattggcaaaactgctcactattactgaaaataatgaatttttctacaatgataaaccgatcactaaagaagaactgaacgcagaaatagcaacttgggataaaagccaaaaggtgaccttgaaagtagatgcgaccgttgcttttgaaaaatttgttgaactaaccgaccttctggctgcaaatgaaatcaaaaatgtagcaattgtgacgaaaaaagagaatagtaagtaatgaaaaaacgtcactcccgtatcggattaatcggctctctcaccttacacggtacgctatttgcaacggtgtttgggattatccatactcaaaaaccattacctgcaacagaggaagtttccagtatttcaatggaaatgttagcggcacgtttagagcaagaacaagtagcggtggcagcggaagatcccgttgaggaagaagttaagaaacctgagcctgtcatagagcctgagcctattcctgaacctgtaccagagccaccaaagccaaaggaaaaacctaaagaaaaaccgaagccaaaagaaaagtcaaaaccaaaagaaaaacctcctgtaaaagccattgagaaaggtgccgaagctaaacaaggtgttgtagcaaaagcaactccgagtgcggtgcaaggtgcaaaaaatcaagagggtattgtgactggctcaccaaaaggtagtggcactgtaaatagtggctcagcaagtggtggggaaattaacgcttataaagctcaattacaacggacgttgcagcaaagagctaacaatgcttatcctcaaagagagaaaatgatgcgaaaaacagggacagtaaccttatcattccagttatcgtcatcagggcaagtaattaatgttcaagtgattaattcgtcagggaatagcaacttggatgcggcagcaatgaaagcggctcaaagcacaaaaatgcactcgcctcctccagcaggtttccctacatcgctaacggtgccggtgaagttttctgtgcaataatgcttgtctactatacctgctacaactttatgaaaataagagctgtaaagttaagtaactcataaatgataagtttttatccattagtaataggttttaatgtcaactctaatttttgttcaacaatattaaataataagtcaatattcgggtgtttccctggatgttgagttgcatcttcaacatgctcagcaaaccaaataattccttgctgagcagatttaacattcagctgctgactaaatctttctgcaagtgcattatacagttttaatgaacctaatttaccttcaatagcgggaatatggtgaatgatatttccttgtctatccaatatagataagcctgacaaatgttcaatgctagggaaagtcgctaaataatctttaaattgcattttgtttccttttaattacataccaataatgacacattctgctacactacgagcattagataacgccgccattgctttagctctatctccagctggaccaacaacaacgcggttccattcaccattgctattaatacgagcattgtaaccagccatagctaaacgggcctgcatattttctgcttgagctttatttttaaatgcaccacattgtaaaccaaattttccgacattcttaggctgctctgaagcaggctttgctgttgtaatattttttgcctgttcttgtgtttttgggagttgctcttgctttggtttttcttcactaacttcttgttgttgctcttgtttttgttctgttgctgtcgaggtatttgcgactggatcagatgttgctgtttggcttaactgctgctcttctttttgtttctgaattgccaactcttgctctttggttaattgtgccaatttagaatttttatccacaggaacttctctggtttctagatctcgaatgtagctatatacttcttgcggtggggttggcaaggtacttttaggttgctgtgatggtgccatttgtgtcggcattacaggcgtggttggattgctttcttttaaaaaccagagaacaaagccacttcccatcaataataaaataatcactgctaagatcagtgcagtatttccaccttttttggctttagaccgaacagcataatcacgatttggcacaataacctcttttaaatccgatataaaataatctttaatcttactgaaaaaattagattttgactagtaaatcaaatgcccttgtttcacttcaaccacctgatcacaccacttgctcacttcttccacttgatgtgtcaccatcagtaacgtgagctgtttctgttggcataattccaccacaagttgttgcatttctattcgcttttgcggatcaagggcagaaaagggttcatctaacaacaaaatcggtttatccctaagtagggttctagccaacgccacacgctgtttttgtccgcccgataataaatccgaacggcgttctgagagttcagcaatgcccatctgctttgcaatttgtgtaatctgttgcatctgtgtagcatcaaaatgcaaacgagaaactagccctaaaccaatattttgagcaaccgttaaatgtggaaaaaggttattatcttggaataacatcgatacaggacgttgagctggttcagtggcaaaatgattttccccattgagtaaaatttccccacgatccgctttttcaaaacctgctattaggttaagcaaggtgcttttgcctgcaccactttcaccaatcaccgcaatgcgttcccctttttttacattgagttgaaactgcattagcatttcagggtaatcaaattcaacatttatataaatcacgtgtgtatctcattaattgtattcaacattgtacatctcggtattgatactgctcactttgattattttggttccaaacaaaataaataacattaacattcctagaatgctttcaggaatacgaatcggtattaatgggctgagcaccttacccaagtaaagtagtaaaaatagtattgtgattgctatgataaagcgtaataatttaattaacatagtttaattcttttattttcttgcaattaatgtatacctacttataggaagtgcatatattaataatacaaaagctcccctaatctggagagcttttatgatttatttccgatatctttcttggtttttacgcattttaatgttgataaactctacaatcaccgagaagcccattgcagtgtaaatcgctgattttggaatgtggatattaaagccttcacccattaatgcgataccgattaagattaagaatgcaagtgctaaattcttaacggttgggttatgatcaacgaaatccccgattggttttgcggcaaacatcattacccccacagcaatcataattgcaatcaccataacaggaatatcatctgccataccaactgcggtgataacggagtcgagagagaacacaatatctaaaaccgcgatttggataaggatcataaagtaatttgcttttttacctgaagttccttcggtatcgtgcggttcgtctttaatcgcttcaataagctccattgcacttttaaccacaaggaacaagcccccgaagaataaaatcaggtcacgtcctgaaataggtttatccataatcgtaaagagcggatcgactaatcgcatcatccacgctaatgaaagcaagagaagaatacgagttgccatcgctaaacccaagccgataatacgcgctgactgacgttgtttttcaggtaaatgagaaactaaaatactgattaaaataatgttatcaatacctagcacgatttctaacgccgctaaggtaaagagagcaacccacgcttctgggctggcaatccactcaaacatagaaagatccttgataaaattagacataacatcggcaaaaattgccgaactaaaagttgcacatcatatagagagctgtggcaaaattaaaggggcgaatgcaaaaaattttgtaaaatctctgcggtaaatggtttacgcaaataaaaccctagtggtagtgattgaattttttcaccatattgatttacagcccctgctaacgccttattatttcgcccttttggacgcaaatgaagcacttcccctaaactcgcattgatctcatttaaacgtccaagcacaatcagttccattaactcttcccagtcttgttgtaactgctgttcttgttgttgggacggcgaccataaaatcggctgtccgatatgccttttttcaaggggaattgaccgcttaccttcgactgggatccacaaaaccctttgcaatttatgtttaacatgtgacgtttgccatacaataccgtgattatccgttaaaggcgcaaggctgacaaaggtagtttctaacggcaatcctttttcattgacaggaatggttttcaactcaatgcctaaatgggcaaaatcttgttcaggcttactgccagcctttgcccctaacgccgtttcaataagcatacccacccaacctttatctcgacgtaaatcaggcggtacaaccatattcaacagttcggcaatttcccctagggtaaagcctgcgagccattgagctttggcgagaagctctgtttctgtggtggaatgggtggcaagttgcattgaagtgcgatctcttatgcgaaaataagcggtcacttgatcataaaaatttgcaaattttttatctgaaccgaccgctagttattcaaatataatgcttttcattttaccatattttactaacaatattttcattgagaactcttagtatttaagttgaaataaagtttgtaaaaaattaggggctgtcctagataacgactaaaagctctattttaggttaaaataaccaaatgagaaaaagtcgtctaagtcagcataaacaaaataaactcattgagctgtttgtggcaggtgtcactgctcgaacaacagctgagttggtaaatgtaaataaaacgacagcagcctattacttctatcgtctgcgattgcttatctatcaaaacagcccacatatggagatgtttgaaggtgaaattgaagccgatgaaagctattttggcggcactcgcaaaggtaaacgaggtcgtggagctgtgggtaaaaccgctgtattcgggcttttaaagcgtgatggtaaggtatatactgtcgttgtaccgaatactcaatctgcgacacttttaccgattgtgagtgagtttaatcattttcgtatcaatcacagtaacttaaaatcttaaatttccattttaaaacaattagttaagggcagcttaagttagttatctaggacagccccaaaatttatgaggagacaaatatgaacaaaacaaaaaaacttagtattacattacttgctagttgcatcttagtagcttgtggtggcggtggttcaagtggtggtcatcagcaagctgtagataaaacagaaaatcctattactaatcaacaagtaagtgaaaataacccccaatctttggataaaaataatgctagcaaagctcccgaagcaaaagaggataagcaaataaaagagccaattgttggtaagcaatctaaggaaaaaatagagcctccctctcaaaaattgaatgatcaagatatttggcagggcttctcgaaaaatggtggttattacgatgcgagcaattgggtgagtattacccttgaaggcaaagaaatcaagctagccccagtcaatggtagcaattcaaataatagtaaaatgaatacgttacgagatgccgatggaaatttggttggatattatggttatgcgacattaaataaaataaaagaaaatcaatataagcctggtgagaaagatgttgaacgcaaatatatggctttactagaagcgagagaagaagccaaaactcttccaactcacgatttatattatcgaggaaaaatgtactatgctctcaacgatgctcctgaacaagctaaagaggctaatgttacagcaacctataaacatatgaataaatcaatttcaattaatatttatggtgtgaatggaaacgatttaactactaatcaaacaaatgttagtgaaaatggttatattcctctcactcgtttatatttgatagatggtaaaccaaaaaaagtcgcagggcaatttgaaggtggtttatatggcaaaagtggcgagattttattaggaaaagctaaacaggaggattcaacaccaaatacccctcaaaataattgggaaggagttattggtgcaactgctaccaaagacaaataatagtttctattgttaaaaaaatgcctgagcctctcccacaatttgtgtaaataactgtttctgagataatacattcagacacaggtattttattatgaacgaaaaacaacttcacgccttggcagcggaatttgccaaaaacctaaaaacaccagaagacctcaatcaattttcacggatgctcaagaaaatcaccgtcgaggctgcgttaaatggtgaactgaccgaccatcttggttatgaaaaacatcagcctagaaaaggtaaaaatgcacgtaacggttacacatctaagaccgtcatttgtgatgaaggtgagatagaaattgagacgcctcgtgaccgtgattggattgctgaaaatgaaggtgcgaagttctgggcaaatgtgctgacagagcttcaaaatcgaggcttaaaagacatttttattgcctgtgtagacggtttaaaaggcttcccagaagccatcaatgcagtctatcctaaaacgaagattcagctttgcattgtgcatttagtgcgtaacagctttgaaattcgtttcgtggaaagattacaaagccgtcaccgcagatttaaagcaggtttatcaggcctcgacggaagcacaggctcgcgaaaatctgaccgcactttcgcaaaaatggcaggcaaaatacccgcttgtggcgaaaggctgggaagataactgggcaaatattgccacattttttgattatccggctgacattcgtaaagcgatttataccacgaatgccgtggaatcgcttaatagcgtgattcgtcgcgtgattaaaaacgaaatgtattcccgacggatgattcagttttcaaagtgatttggcttgcgattaaagatgcatcaaaaaaatggacaatgccgattcagaactggaaactggcgatgaatcgatttatgattgattttggtgatcgcctagacgatcaccattaagttgaaatgggtgtttacacagaatttgggatagggtcaaatgcctttgttttctttaacaaaggcatttttgtattccactgaattaaccctgttctgccaaatctaacatttcctgagcattcgctaacacagcatcggtaattttttcccctcctaacaatcgggctaaggcttttactcgttcttttggtgtcagcaagctcattttggtttctgtttgattattttcaacttgtttttgcacgttaaaatgatgattaccgtgacttgccacttgcggtaaatgggtcacgcatagcacttggcattttttacccaactggcgtaataatctgccgaccaccgttgccgttggtccgctgatcccaacatcgacttcatcgaaaataatcgttggcgttgaaagtttattcgccgttaaaacttgcaccgcaagggaaatccgtgatagctcacctccagaggcaattttggctaatggttgggcattttgccctaagttactgcgaagattaaattcaacgaaatctgcgccattggctgataatttgtcgagattatattgaatatcaatgaaaaattcgccgttttccattgctaattgtttgatctgtttggtcacttcggctgacagtttttgcccagcatctaccctcttgtgataaattttttctgctaattcaacacattgttgataggcttgttgctcgtctgcaattaactgttcttcattttccgcaaaatctaatagggtttgtagctcttgttttaagctcagatgtttttgccataacttatcaggggtaatgtgatgtttgcgagccagttgcattgtttggctaatgcgttgatctaattcatttaatagctcaggatcttgctcaattttattggcaagatgattgatttcggaactggcttcctgtacctgaattaaggcttcattgagcatttctaatgccgattgatattggctatcgacttcgactagctcttctaaatcccgaatagcacgatagagcattgtatctacattggcattatcatcacttaacaaattcaatacagattgtgacagttccgttaattgctcggaattagcaaggcgagcgtgatcttcttctagttgctcaaattccccttctttaatcgcaaattcatcaagttcttccacttgatattgcaaaagctgtttgcgagcttcattctcttgacattgttgatggaaatttttcacctgtttatgcaattttcgccaactatgatattgcgttgccatttccgctaataatgggtgtaaattggcataattatccaccacttcaagctgatactcacttttcagcaagagttgtggggcgtgctgaccgttcaaatgaataaggtattgcccaagctctcgcagttgtgaaacagggattgggtgattattgacaaaagctttggaacgcccttcttggttaatcatacggcgtaaaatgcactcttgtggattatcttcatcaagtagctcgtgttcctttaaccataaataggcagggctagtaggttgcatagaaaatgtcgccgaaatatccgctttatctgcgccattacggatcattgagctttcagaacgatagcctaagcataagccaagcgcatcaatcccgatagacttaccagcccctgtttctcctgtaatgacggacattccttcatttaattcaagggttaggtgacgaacaatcgcaaaattattgatggttaattgagttagcataagaaaatacccatacgaaacactgtatgagtatatagtatcactgtttttatacacagtaaataaaatacagaaaattttatggtaaagaataggacaaatttattgttattttggaagatatattcagatgcaatgtacattacaaggaatacatccgaaattagcccaagtaatagggctaatttcagattgttgacaaagatatctatactatttccatagcttaagataaatattaactacaccaactccgccctcaatttcttggttacttccaccatcacttgcaactgctcaatggtttctttccagccacgggtttttaagccgcagtctgggtttacccataaacgttcttttggcaccactttcaaggctttacgcagcaggtgttcgatctcttccgctttgggtacgcgtgggctgtggatgtcgtatacgcccggtccgatgtcgttcgggtatttgaaatcggcaaaggcggtgagtaattccatatcggagcgtgaggtttcgatggtaatcacgtccgcatctaagccggcaatcgcgggtaaaatgtcgttgaactcggaataacacatgtgggtgtggatttgggtgtcatcttgcacgcccatatagcttaaacggaaggcttcacccgcccattgcaaataagcatcccaatctgaccgcttgagtggtaagccttcacggattgctggttcatcaatttggatcactttgatccctgccgcttctaaatccaacacttcgtccgacaatgccacgccgatctgtttgcagaccgttgagcgtggaatatcgttacgcacgaacgaccattgtaaaatcgtcacaggtcctgtcagcattcctttcatcactttgttggtgaggctttgagcatattgcgaccaacgcaccgtcatcggttcaggacgagctacatcgccataaatcacaggcggtttgacacagcgtgagccgtaactttgcacccagccgaatttggtaaaggcaaagccgtcaagcaattcgccgaaatattccaccatatcattacgttccgcttcgccgtgaaccagcacatctaagtctaactcttcttggcggcgaaccacatattcaatctcttttttcatcgccgtttcgtaatccgcaaggcttaaatcgcctttcttaaagctcgcacgagcgtggcggatttctctggtttgtgggaatgaaccgatatttgtcgttggtaaaagcggtaagtttagccacgcattttgcttcgcaatacgttctgcaaatggcgattgacggcgatccgccccttcaggtaagttggctaaacgagccgctacttctgcacggtggatctcttttgatgtcgctcgggcattagctgccgcttggcttgcgtctaattgtgcttgtacagctacacgaccttgttcaagtgcggtcttaattaccgacaattcttcgactttttgtagcgtaaaggcaagccattgatatagttcaggtttattcgcttgtaattgcgtttccaccgctaaatcaaaaggtgtatgcaacaaagaacagcttggggcaatccataaacgctcgcctaatttcgcctttaacggctcaagcagatctaacacttgatttaagttcgcacgccaaatgttacgcccatcaatcacgcctgccgaaagcactttgcggtaatcttcaaatgccgtaagttgttcaggtgcacgtactaaatccaaatgcaagccgtccaccgctaagcctttgagcaattctgcgtgttctgccactgagccaaaataggtggctaataacaatttcgcattcacttggcttaattccgcatagaccgcttgataagctgccaaccattgtgccggtaaatctaaggctaaagccggctcgtcaatttggatccattccacgccttccgctgcaagtgcggttaaaatttcacggtaaacaggcacaagtttgtttaataactcaaaacgattaaaggcttcgcctttctctttgcctaaccaaaggaaagttaaaggcccgacaatcacaggtttaaccttcaagcctaaggctttcacttcacggatttgattaacgtagtgagcagggttggctttaaattcggtgtttttgtggaactcaggcacaagatagtggtagttggtatcaaaccatttggtcatctcaatggcaaattgatctttgttaccgcgcgccagttggaagtattgcgaaagggttaaattttggctgtcaaacccaaaacgcgcaggaattgcccctgttgccacttgcagatctaaaatatgatcgtaaaaggtgaaatcgcccaccgccacaaaatcagcatttgcagccgcttggtgccgccagtttttctcacgcaaggctttggctaaatctaataaatcttgttctgcaatttccccacgccagtaacgttcttgtgcaaattttaattcacgtttcgccccaacacgtggaaagcctaagatgtggaatgttgtcataatgtgttctcctttgatagatttgatatttcttttatttagacgtttagccgtctaaatggctagttatataatctacaaaacaacaacattatgcaagttcataattttcacaaacattatgaaaatttttcatggcaacttatacacccaagctcgaaaatcattcaatataccttatgggtatagatggaatagatagagattttttctctaaagatttattagtatttcttcaaaatccacttcaactctcaacgcctctaacatcgctttccccctcggcagcacttcaacctccgccaacaacgccaccgcttcactcaaactgctagcggttggataagtcgcattttttgcaaaaaattcggcacaatcgaccgcttgttgattgaatagactaaacagcagttgttgcagattttgttcgcgtaaacaagttgggactttttgaatggtaaggcgagtttgcccttgccactgttttgtttgaatatcaaaacccaagtctgccaaagcggtttgcgattgttgccaagacgctgtttgctgttcatcaagggttaaacttagcggtatcaacagagcttgattttcccttttggctaactcagcttgtagttttaattgagccaatttttcaagggaaagcagataaaaggtttcgccctgtttcatcaacaatgctttctgtttcactaccgctaaggcttgagcatagggcgtggccggctcggctatcggttcaacaagcggtgtgatcttggctatttttgacaaatcttgaacaggttctgaccgcttatagtcttgcataggtgacgtagaaagcaattcgccataccacttctgttcgcttttgcttacccctgatgagcgagtattgctgtaatttgggcgttctgcgtgagttgatgaagtcaagcgtggttcacgataactgtgagcgaaaatattctgccccgaagccacacggttggtgtcggcaatataattcggcaatgcttcactgacattcgttgtcagcggtaaatgatgttgatcttcaagagcattcaaaacaccttggtagataaaatcgtggactaaacgactttgatgaaaacgcacctcgtgttttgcagggtgaacattaacatcaacgtggcttgggtcaagatctaaaaatagcacaaagacagggtaatgatccttcggcaaccgttccccataggcttggcgaatagcgtggttgatcgttttatctcgcatcattcgcccattgacgtagctgtaacagagatcgttttgcactctcgctaaacttggtgagccgacccagccgtaaatatgtagatcgtcgtgttgccaatcaatgtgtaccgactgctgaataaactcatcaccgcaaatcgttgcaacccgttttttttgctgttcaagctgttgtgtcgccaccgctttgtagtaacgcacttttttctcattatgggtcagcgtaaaagtcacattcggttttgctaatgcaatacggcgaaccacttcatcaatatgggcaaattcggttttatcggtacgcaaaaatttacggcgagcaggggtattgaaaaacaagttagccacttcaatagtcgtgccgacagggtgagaagcaggcttgatttcaacctccatttcacgcccttgtgcataggcttgccacgcttctgcctgatattcggggcgagaagtgagcgttaaacgggacaccgagctgatactggctaaggcttcaccacgaaagcccagacttaaaatactctccagatcttcaagggtagcaattttgctggtggcgtgacgagccaaagccaaagcgagatcttgcttgccgatcccacagccgttatctcgaatacggatcaactgcgatccgcctttctcaatatcgatctgaatttgcgttgcccctgcgtccaagctgttttccaccagctctttaaccaccgacgcaggacgttccaccacttcgcctgcggcaatttggttggcgagttggggagggaggatttgaataaggggtttagatcctttaacgctcatatgtaagaaaaatagagataatttgaaatagattctatcacaaataatatttattacgttgagtatcaaataaattctcttattctatttctatgcttattagaattagcttttacacattaaattttatgagatttgatacgatgcttactattctcaaatagataagctgtaggaaagcatttttatgcaaatcaaaaaaaccgaccaagcggtcggttttccaaaaaatttgcaaatttgtttaaaaaagcaattacgctaattttttgatttgagcagctaacttagatttgtggttagctgctttgttagcgtggattaagcctttagatgccatacgatccacaactttttgcatttcaacgaaagctgcttctgaagctgctttatcaccagttgctactgcggcgtatacttttttgatgaaggtacgcatcattgaacgttggcttgcgttatgttggcggcgtttttctgattgaaccgcacgtttttgtgctgacttgatattagccaaggtcaaactcctaaaaatatctgtgtaaaaataaaaacataaaaaacaattttttatgcagtgctatcgatagtttaaattcattttcaacgagacacgggcttgaaaataacatcgtttcacacaagaagtgttcttgagtaaaagataggggcggattttagcagtttttttctgattttcctataacaaactgctaaaattccgatcaattttttaagaagataaagagaacaaattgtgagcaagaaattattaagatcaggaatgattgttagcggtatgaccctactttctcgtattcttggtttagtgcgtgatgtggtagttgccaacttactgggtgcaggcgttgccgccgatgtatttttattcgccaaccgcattcctaactttcttcgccgtttatttgccgaaggggctttttctaaagcctttgtgcctgttttagcggaatataatgccgataatgatccagacaaaacccgtgagtttatcgccaaagtatcgggaacgttggggggattagtcactgttgtcaccttagtcgcaatgcttgcttcccctgtgattgctgcattatttggtacgggctggtttttagattggctcaatgatggacctgatgcagaaaaatttacccaagcctcgttgttactcaaaattacatttccttatttgtggtttatcacttttgttgcattatcgggggcgattttaaattcgttaggtaaatttggtgtaatggcgttttcccctgttctgttaaatgtggcaattatttgcgttgcaatttggggaaaagatttctttgcctcgcccgatacggcacttgcctggggggtatttttaggtggcttatcacaattcctattccaaatcccttttatgaaaaaggaaggtttattggttaaacctaaatgggcttggcatgatgaaggggtaaagaaagttcgcaacttaatgattcctgccttattcggtgtatctgttacccaactgaacttgctcattaatcagattattgcctcatttttaatcacaggctcaatcagttggctctactatgctgaccgtttaattgagttcccacttggattattcggtattgctatctctacggtgatcttgcctagcttatctcgtattgccaaacagaaagatttgacggaagaacaacgtaaatttaactttgagcaaacaatggactggggtgttcgtatggtattactgcttggtattcctgcgatggttggaatgatgatccttgctcaaccgttgatgatgacaatgtttatgcacgggaagtttcaactcaatgatgttatcgcatcttcacaagctctgtttgtgatgtgctttggcttaattagctatatgttaattagtattttggcgaacggcttttatgctaaccaaaacaccaaaacaccagtcaaaatcggtatgattgcagcggtaagtaatatctgttttggtgtactggctattcctttcggttttattggactagcaatggcttcggcactttccgctacggtaaatgctggcttactttatcgtggcttatctcaaaagggcatttataaagtcacaacaaccacggcaatttttacccttaaactgctgattgctgcctgtgtaatgggggcgttagtgtcctatttttctccggatttaacaggttggaacacattgaatttttgggcgaaagtccattggcttgcgtggttaattgtacttgctgcaatcagctattttgccactcttggggtgcttggtatgcaaataagatcattcaaggtaaattaaagtgactatttttagatcgtatagcaatatgagaatatacattgctacacgatattttgtacattaactttcaatcccctcaaacaacaaggtacttaaataacgttctgaggcggaaggtaaaatggccacaattgtcttatccgcaaattcaggtaattttgctaaacgatctgcggcagcgacagctgcaccagatgaaatcccgaccaaaataccttcttcggctaacaaacgacgagcggttgcaatggcggtttcgctatccacttgctcaacacggtcgatcaaacttaaatccaagtttttcggaataaagcctgcaccaatgccttgaattttgtgtggacctggtttgatttcttctccgtttaacgtttgtgtaatcactggcgactcggctggctcaaccgctacgctgatgatttgtttacctttatcttgcttgatataacggcttactcccgtgatcgtaccgcccgtaccaacacctgcgacaaaggcatcaatattgccttctgttgcttcccaaatttcaggacctgtcgtctgctggtgaatagctgggtttgctggattttcaaactgtttaagcataatataacggttcggatcactcgcaataatttcttcagctttggcaatcgcccccttcattccttttgccccttcggttagcaccaaatttgcccctaagccacgcagcaatcgacgacgctcaatactcattgtttcaggcattgttaatgtcaatttataaccacgagcagccgctacataggctagcgcaatgccagtgttaccactggtggcatcgacaatttccttatctttcgtcaagataccatctttttctgcctgccataccatatttgcaccaattcggcatttaacactaaaacttgggttacgagcttctactttaaccaataaattcccgttgtgaccgaaattctttaaacgaacaatcggggtatttcctatcgtttgtgagttgtctgcataaattgtcattgttatgttcctcgtgctagtttgaatgcggttagcatacggatttttagcctaatgttaaggataagaatggcatttaatataactaaaagaaataacaagcggagattttctcagggaattttgcaaccactgacgcaagtggtatagtaaccctttatttctaatgcttagatttaccaatgaaaaaacagcaatccactcaaaaacatacgcttactcagctcatttcccttgtggtgatcggtattttttccgtcattacttggtttaacaatgaaaagaaagaacaagaacgtaagcaaccaacgccagcaccaacggtttcacaaagcaccaacaatgttgaaatcccaagccagttaggcaattacgataccaatatggcaaaagataagtttgggcaaaacctacaagcctctgtggattactatatgttagcactttcgtggtcgccaagtttttgcgaagaacagagaagcaaaaataacggcaacgtcccagctcatcttgcattgcaatgcaaccaagtctcgaaatttggttgggttattcacggtttatggccacaatcggcagatgcaaaatcggctgatgaacacccacgtttctgccaaggcgatttggctcaactacctgaaaatctgattaaacaatatctaccagagtccccaggggcaagtttgttacaaggacaatgggaaaaacacggagcctgtgcgttcaataatgcagaagcctattttgagaaacagaaacagcttttccgtagcctcaacctaccaggacaagaactctcacgcaaagaactatttgcgtggttaaaaaaatttaacccacagcttaaagaggcttatcttggagccagtcgcaacgaactttatatttgttacgacaagagctggaacgtaatggattgccctcgctagtgcaacatcttcgtgaactcaaaatgcaagtccaacgccagttaaaacgagatttggacaaggcaaaccgctattttaacaaacactttacgcccccaacgataagttacacagtgcgagggcgaaaagctggcgtggcttacttgcaacaaaatgaaattcgcttaaaccctattttattgagtgaaaatagctcaaacttcgtgcaacaagttgtcccacacgaacttgctcacctgctggtttatcaacaattcggacaagtacagccacacggcaaagagtggaaaatgatgatgaaagaggttctcggcgtgcctgccgaaacgtaccattgctttgatgtaaccaatgttgcgggacaacaattcccctaccgttgcggttgccaaacgcattttttatcaatccgccgtcataacgctattatgcaacacaagcggtcttatatttgcaaaaaatgcaaagagatattggtgttgaaggtcaagtgaacattgctacttaagaaaacgttccatctgaatcataaatgtcgacttttaggtatagtagacaaattttttctgaactgttttgtctactatacctaatatctcagggcaatcaatatagctacaaagcattttttaaagcctctcgaataagttgctcacttgttgattcagatttcctgtttacttttttaaccattttttcagcatctgctgccttatatcctaatgaaatcaaagcatcaatcgcttcatttactgggctcatagacgccattgataaaagatttcctgatggttgtaaaatagaaatttcatgatgaaataaagttgaaaattttcctttcaattcaaccaacaaacgctctgccgttttacgtccaatccctggtattttgataagttttgctaattcttcctgttctatagcagacataaattcagaaactgacattgctgacaaaatagctaatgctaacttaggccctacaccgtttgttttaattagttcacgaaatagcatacgctcttgcttctgaacaaatccaaataaaaggtgcgcatcttctcggattaccagatgagtgaaaatcatggtatcttcattaagatcaggtagattatagaaactagtcattggcatcaatacttcataacccactccttgaacatcaagtaccattgatggaggagatttttcaataatcctaccacaaagtcttccaatcatttttgtttatccattaagtaatagagcaattagaataatagaaaataagatcacagtattttattttttaatacacaaataaaataaatttcccgatagataaccattctgaaaggaaaactgagatcaaaaaggctgtgttccgtactcctaaacacaccctaaaccacagattctctaatttaccgcaaaattatttcggtgcgccgattggcaacacagtgcgtccaaaactttcgttaagaatttcagcagctgctaaatagaatgctaataacgcagttaataagccgaagttaccaccaatgtgagtaatagttgcattgtgagtgaaatcacctgctgctaataggtagaatgtgatggtaagagcaaggaaaatcgcttgtaatgcacgcggttttgttaaggtgccgaagaacatcattaaggtaaatgtaccccaaactactaagtaccaaccgataaattcaggtgatacggttgcaccgaagaacacttttaataatgcaaatgaccaccagaatgcaccatagctgataaatgcagtgaaaccaaaagtgttaccttttgaatattcaaacatacctgcaatcatttgtgcagtaccgccaaaagcgaagcccattgcaagcactaagcctacattttcgccaccgaaagtaccgttgttgattaaacttaatagccacgttgttaatgcgaaaccacataaaccaagtggaccaggatttgctgttgctgtattgtgagcagacattttttaacctctaattaacgttttgttctaagtaaattccagtatttttcataagtttcaacggcatcgccgacatcactttgtaaaacacctttttcaatttctgcaagcggtgggaaaatcagtggatcttgcactgtttctgcaggtaataatgccttcacattttcgttaggcattgagaaacccatcgtttcaattaccatttttgcactttcaggacgcagcaagaaatcaataaatttatgtgctgcttccttattttttgcatttttaggaatgacgtaattatccatccaaattaccgccccttcttttgggaagataaattttaagtctggattttcactcttcgctctatatgccgaacctgtccattgcattccaatcgcaacttcgccttgtaaataaggcatttcaggagaatccgagttaaatacaagtacatttggcacaagttttgttaaacgctcgtaagcagttttaatttcatcagcattagtggtgttcggtgatttaccgtctaacaataatgctatatgaaacacttcacgagagtcattcatcagcaataccttgcctttgaattctggtttccataagtcgccccagcttgtaatcgtgcttgggtcaatatctgacgcattcacaccaatacccgttaagccatagacataaggaagtgagtatttgttttcggggtcaaactctttacccattaaggctttgcttacgttgtggaaattgctcaatttgcttttatcaatttcggctaacattccgtcttttgccattttcccaacataatagcttgacgggaaaacaatgtcgtaacctgacccattcgttaattttaactttgagtacatttcttcgttactttcaaaggtggagtagatcacctcaattcccgtttctttggtaaattgttcgagtaaagaagatggaacatattctgtccagttatacacatacaatttttcggctgcctgtgcagtaagtgcaaaaaatgcaacgcctgcgacagcaagtttattcaaaaatgattgagcaaatttaaccaatcttcaaatcctcttaatgaaaaagataaatgatttctttgcaaagatcggcagctaaacgaccgcttgtttgcaaattcctcttgctgaaaagcggtgaagtatagcgattttgtggcgatttttctatcaaaagttatcaaaaggaataaaaaagcgacccgaagatcgcttttctagcaagagattacgcctcacaactactacaacttaacaagttacggttaaacacttgtgccgcactcattgagtattggtagtaaattgatttcaagcccaattcttctgccgttaagtaaagttggtttaaatcacgagcaggggtagcagggtgaaccataatgttaatactttgcccttggtcaatgtatttttgacgctgtgccgcttgctgaataacgcttaactgactgatttcagagaaagttttaaagacctctttttcgtgttcagagagctgtgttaaatgctgaacagagccatcgttcaataagatactttcccaaatttcttcggtatctaaccctttttctctgagaagttgctctaagaatgggtttttataaaccgttttaatcttcgctaagtctttaacatagtagtttgatttaaacggttcaaccgacggcgatacactgcctaaaataaagctacttgattttgtcggagcaatactcattaaggtggtattacgacgaccatagccttttaacaattcaggttcaccaaagcgttgagcaagttcttctgaagccttcattgtcttttctttcaacgttttaaagatgatgttgtttttctgcattgcctcaaaactatcaaaaggaatattattggcttgtaaataactatgccagcctaacacaccaattcctaatgcacggtgacgtttagcaaaacgatttgcacggtcaaggaatggaatttcagcacttttctcaataaattccgacattactacatctaagaagtaggttaatacttcaggagcatcagtatctttccactcatcaaaataaagcaagttcattgaagataagcaacaaacgaaactctcttcattatttgacggtaacataatttcggtacacaaattcgaggcgtgaaccgtcatatttttatctttatacacatcaggacgacctgcatttgcattgtctttgaagaacagatatggaatgcccgtttctgttttacgttgcaaaattttcgcccaaagttgtcgcttgtatggatcacctgctttcattgactcaagccagtcgtgtccaacacatacgccatagtacattaactgaattggattaccttcggtatgaatatccaaccactcatcaatgtcgccgtgttcaatatcaatgtagcctgcgaattgtcctttacgagaagtaccttgtgaaataacatcgatcaccgtatcaaacaacttactaaagttaaatgaaccgtctgattttccgttatttttaatcaaactaccacgcggacgaatatcaccaaaataggctgacgtaccgccaccgattttactcatcatacccacttcagcggttgtcaccataatttcgtggatcgaatcgccaatatagctaccaaaacacgaaatcggcaagccacgatctaaaccgaagtttgaccaaatcggcgaagagagcgagaaatagccacgtcccatatagtagtagaacttatccgcatagccttcaatacctagcttacgctctgcgtgttctgcaataaaacgaatacgatctaaagcagttgttccttccaacaaatagccacgttgcaagaaaagacggctatcgtcattcaaccactcaaaatcaggacggtttacgttagtgtagccaagttggaataactttggctgataataatcattagaataagtcatcggcagtaatctgtttcatttttttactataatcggtactacgtttgttaaagaaatctgtttctttagttgaaataatttcaatatcaaaccactctgtttcttttaacaactcaggatctacatcgtatggtggttctaaccccaaaatagataatgaattgttatagcgattcataatatagttttcgacggttttacgagaaataaaacttaaatcaccctcttcaaaaatccagtctaaaatgcctctctcagcttcaaaggcttgttgagataaagttttgagttcttcaaaaaactcagaggtaaataattcactatgctcatcactcaaaatttcatataacgcaataccaaaacgcccgtgaatttcttcttcttttgaagtcgcttccaccgcattagaaatccctttaaacagatttttatgcttattgaaagacatcataataatgaactgaccaaacaacgaaatatgctcaacgaacaacgagaacaacacaagagatagcacaaactgccctttgcctgtatccttctcacgcataaaatcttccatataacgaatacgtttcatcaacggctcaatttccgtgatttgcgtaaacatatcgtttaagcctaatttttctaacaagaaagagtaagcatctttatggcgaacctcactttccgcaaaagttccccccacatcgtccatctctggttttgggaaataatgatatagctcaccccagaaacgtttaacgttcacttccacctgtgaaattgccaacattgcacgggttaaaacgtggcgttcgtggtcattaatattagtacggtaatcttgaatatcccccgtaaaattaaattcggtatgcaaccagtacgagtgacgaattgcatctttaaactcaagtaattcggggtattcataaggtttgatttgaatgcgtttttcaaaaatgttgcgtgccataatgatttgagcttcgtggttgattattcaatggggagtattttagagatattttttcgttctacaagatcttgacaaatggctatccctgattgtgtcgtcctagtgattgattttaaaaggaaaaattttttgtaaaaattcagtttcgctcaaaaactatatcttgtgtttttaaaaattagaaacacaagatatagtggttgcaagtggttggatttggttattttttacaaaaacttgatatgatgaactattgcataatattcattttgtaggagctgagttccctcagcccttatccaattatcttaaaattaatccatctcactcatcaaactcgcatttccaccagcggcagcggtattaatgctgatcgctttttcgtgtagtaatgggaataatgaaagggcaaggtcaagattttccacataggtgagaattgcccctgtgcgttctgcatagtgagctttttcttctaatgaaagcggttcaagcacaatcaagccacttaaatttgctaagctattgaaatcattgctaataatcactaagcctgcaaaatgctgagcctgtttagccagtggcgaattagaatgtaccgcagcacggctacccgacaccactacggcaatcaaggcttgaatttgttgctctagtgaaccattaccgatcgcaataactgggcgagcttcaaattgcataaagtttacttcccctgtaatcccttgcattttaaagactttccctaacggcgactggcgagaaagacttgcaataagatcttgggcattttgtaattctgtgcctgaaagcaccgcttgtatgcctgtgagtaagcctgaagtgtcggctggtttgcccccttctaaacccgataatgtccattcacagcgattaactaagcgttgtaggtaaagtggcccaccggcttttggccctgtgccagataatcccattccgccaaatggctgaaccccgacgactgcccctacggtatttcgattaacatagagattgcctgcgtaaatactttcaagccataaatccacggtttcatcaatacggctatgtaagccactggttaagccaaagcctgtcgagttaatgtctgccatcacttgcggtagattatctgcatcaaatcggataacgtgtagcacagggccaaatacctcgtgttttaattgattgatatgctcaatttcgagtagcgtcggcggtacaaaaatgccagtttgagacagttcaggatcaatcggaacttgatagcacgatttcgccacttttttcatttcgtcgatatgattaagcagacgctcttgggcgactttatcaatcacaggaccaacgtctgtattaagattttgcggtctgccgacttttaactctgccattgcccctttgagcattgtcaggatatgctctgcgacatcacgttgcaaataaagcactcgcaatgcagaacaacgttgtcctgccgaatcaaaggctgagtttaaaatatcagcaaccacttgttcacctaacgcagaactatcgacaatcatcgcattttgtccgcctgtttcagcgataagcggtacgatatgggctgatttttgcaaattgcgattgatgtttttagcggtatccgttgaacctgtgaaaatcacgccatttactcgtggatcgctcactaaggcagagccgatcacttttccgctaccggttaaacattgtaaggcttgctcagggatacctgcttgatgaaataaactcacggcataatatgccattaaagaggtttgctctgcaggtttagctaataccacattaccagccactaaggccgaggagacttcgcccacaaaaattgcaagcgggaagttccacggactaatagcaacaacaattcctctcggattgcgataaccttcagggttttgacgaacttcttttgcataataacggcagaaatcgaccgcttctcgcacttcggcaatcgcattatttaaggttttgccagcttctcgtacggctaaatcaaagagctgaggcatatttgcttccatcaaatctgccattttttcaagtgcttcggctcgaactataggggacgtgttttgccactcagctttaaactgttccgcaactgcaaaggcttttgccacatcattttctgttgcctcaatcacctcaccgaccacttctgcgatatttgcagggttgtgaacttggcgagaatgaagattttcagttttttcgcctgcaatttgtggctcggcacgatattgtcggcttgcaagttgatttaattccgcttctaatgtttttaagtggatcgcatcggttaaatcatagcctttagaattttgacgttgttccgcaaaaagtttaactggcaatggaattttcgggtgcattgtgccttcggttatttgggcttttgcgacaggatcgcaagctaaatcatcaatactgagattttcatcgacaatctgattaacaaaagagctgttcgccccgttttctaataaacgacgaaccaaatatgctaagagcgtttgataagaacctacaggggcataaattcggcattgaacattgagattatgtgagccaacaacttcatcatacaaagtttcccccattccgtgtaagcactggaactcaaaatgtttaccctgtgctaaatggtaaatggttgaaagggtttgagcgttatgggtagcaaattgcggataaatcacatcttgtgccgacaataattttttcgcacaaacaacatagtttaagtctgtatggactttacgagaaaatacgggataaccttctgcaccatcagcttgagcgcgttttacttcgctgtcccaataagcccctttcactaagcggatcatcaatttacggtggttcgcacgggctttctcaatcaaataatcaatcacataaggacaacgtttttgatacgcctgaaccacaaaaccgataccagcaaagtcagctaaatcaggatcggcaatcaagcggtccatcaaatccaaagaaagctctagacgatccgcttcttccgcatcaatgttcaaaccgatgtcgtactgtttagctaataaaaacagatctttcaaacgtggataaagttcatcaattacccgcttgtgttgagctaaactatagcgagggtgaatagccgagagcttaaccgataccccggaagatttatacacccctagaccacgagaaaccgcccccacagcgtgaatagaagcaacataatcatcataatagcgtttagcatcttgttctgtgaatgccgcctcacctaacatatcgtagctataacgataccccattgcgaaccgcttctcgccatttttaatcgcctgctgaatggtttcccctgtcacaaattgtttgcctaacaaacgcattgccacatcaacccctttacgaataagcggttctccgcctttttgaataaggcgagaaagcgaagaagccagactactttcactgtgggtagctaccagtttacccgtaacaactaacccccacgctgccgcattgacaaatagagaagggctattgccaacgtgggaacgccaatcccctttggcaattttgtcacggattaatttatcggctgtcgctttgtccggaatacgcaataacgcctcagcaagacacatcaatgccacaccctcttcactagacagggaaaattcgtgcatcaacgcatcaacaccactggctttctgacgagcatttctgactttttcaacgagttttttagtaagcgttttaatgccttcgacgtgttcatctactctagcttgcggaataagttgtttgacgagttgctcttcatcacaacgatagtgttcacttaacgttgggcgaatagcggtaccttgaggcaaaatatgataatgagatgtagctgacattgtttttctcccgtttcattgttgttattgagatgattgcaaaatatcactgcaatctcaccgcttgttaaaagcaaaaaacggcttgccaaatggcaaaccgtttctagataaattatttcattgcatctgcataggctttttcagctttatcaaacgtttccacgatttctgctttaggggcaggggtaatcaaagaaaccacgatgattgcgataaaggcaaggataaagccggggatcatttcgtagacagcactctcaggtaataatttatcccaaaataccaccactaaagccccgactaacattccagccattgcaccagccgcattcattcgcttccagaaaagcgaaagaataaccacaggtccaaaagcacagccaaaacctgcccacgcattttcaactaattttaatacttggcttgttggatcttgagcaatggcaatggcaatcactgaaatcacgagaaccataatacgacctaaccaaactagctctttttgacttgcatttggtctaatcatacctttatagaaatcttctgtaatcgcacttgaacagatcaacaactgacaacttaatgtactcattaccgctgctaaaattgctgataataaaatcccaacaatccaaggattaaagagtaatttagataattcaataaagacttgttcattattttgattaaccacagccgcctgttcaggatttgcgaagaagtaggcttgcccaaagaagccgatccctaccgccccaaataaacagataatcatccaagtcatactaatacgacgagcatttggcattgatttcacactatctgcagccataaaacgagctaaaatatgtggctgaccaaaataacccaatccccaagcagctaaacttaatagaccgacaaaggttgtgcctgtgaatatatcagtaaaatccttaccgacatattgccctgcagcaataatcacattatgcgtatccgcaaagccacctaaatgaattaacacaaaaataggggttaagaaaagagcaaataacatcagactagcttgaatagtatccgtccagcttaccgctaagaaaccaccaataaaggtatagatgatagtggctaatgcaccataccataacgctgtggcatacgacacgccaaataaattttcaaataatcttgcccctgcgactacgcccgaagcacagtaaatggcaaagaaaaatagaataatagtagcagacacaattttgaggatttttgtgttatcgccaaaacggtgatggaaatagtcaggcaaagttaaagcattcgtattgtattccgtatgcatacgcaaacgaccagctacaaataaccagttaaggtaagcacctatggtcaagccaattgcaatccagccctcaaccaaacctgccgcataaaccgcaccaggtaaacccattaataaccagccagacatatctgatgcccctgctgataaccctgttacaaaactacctaatcgacgaccgcctaaaatatagtccgataaattattcgtaaatcgataagcaacaaaaccaattaagaccattccgataatataaatcagaaacgtcgttgttgtcggatcaaagccaaacataaggtttctccctagtaatacaaaattctaaactgtccaatatagcagaaatcacagcatcttaacttttccttttaatcaactgactactatttgtcctacatcttaaatttgttcaagtatagaacaaaaaaatttattttgtaacattttttaaactttttaattaaaattatacaaaaatgagagtgttgtatattcactctatttatttgctctaaccgttatcaaggacgcccctttaaaattttccctaaaaacaaaaaaccgcaagctatctctaacctgcggtttttctctttaataaaaccccgacgatgctctactctcacatggggaacccccacactaccatcgacgttacagcttttcacttctgagttcggtatggagtcaggtgggacaactgcactattgtcgtcgggaaaatcttttgatgattctctctatcttcttttttctgttctttaagggcaaatgtaatttgcccctacatctttctgttctttaagggcaaatgtaatttgcccctacactattctaatttcgaaacaagctgttctgagtctctttgttttattttgtttagttagtttgttgcttttattcagctctctaactctctcacgtctacttcaaaaacgcttgaggttgtatagttaagcctctcgggcaattagtatctgttagctcaacggctcacaccgcttacacaccagacctatctacgtcgtagtcttcaacaacccttactagcttatagctagggagaactcatcttaaggcgagtttcgtgcttagatgctttcagcacttatctcttccgcatttagctacccagcaatgcctctggcgagacaactggtacaccagtgatgcgtccactccggtcctctcgtactaggagcagcccctctcaattctccaacgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgacttgtctgtctcgcagttaagcttgcttataccattgcactaacctcacgatgtccgaccgtgattagcaaaccttcgtgctcctccgttacgctttgggaggagaccgccccagtcaaactacccaccagacactgtccgagaccacgtttcgtaatcttcgttagaacatcaaacgttaaagggtggtatttcaaggtcgactccacaagcactggcgtgcctgcttcttagtctcccacctatcctacacatcaaaattcaatgttcagtgtcaagctatagtaaaggttcacggggtctttccgtctagccgcgggtacaccgcatcttcacggcgatttcaatttcactgagtctcgggtggagacagcctggccatcattatgccattcgtgcaggtcggaacttacccgacaaggaatttcgctaccttaggaccgttatagttacggccgccgtttactggggcttcgatcaggagcttctctttcgataacaccatcaattaaccttccagcaccgggcaggcatcacaccctatacgtccactttcgtgtttgcagagtgctgtgtttttaataaacagttgcagccagctggtatcttcgactggttcagccttcggaggtatactcctacaacctacgccagcgcaccttctcccgaagttacggtgctattttgcctagttccttcacccgagttctctcaagcgcctgagtattctctacctgaccacctgtgtcggttttcagtacggtttagtaaagcctttcgcttagtggcttttcctggaagcgtggtatcagttacttcatttccgtagaaactcgtcatcatctctcagtgttatggaagtccggatttgcctaaactccccacctaccaacttaaacagacatccaacagtctgctaacctaaccttctccgtccccacatcgcagctttaccaagtacgggaatattaacccgtttcccatcgactacgcttttcagcctcgccttaggggccgactcaccctgccccgattaacgttggacaggaacccttggtcttctggcgaacgagtttttcactcgttttatcgttacttatgtcagcattcgcacttgtgatatctccagcatacttctcaatacaccttcatcgacttacacaacgctcccctacccaacaggcgtatcacaaatattcctctgatttctatccgcactttatgccaactcaacgtgttgggtgcttgaccaacatctcattccgtttcacttcattcgatgttgttaatcgaaggcgtatttgtgatacgcctgatgccgcagcttcggtgctatattttagccccgttacatcttccgtgcaggccgactcgactagtgagctattacgctttctttaaatggtggctgcttctaagccaacatcctagctgtctaagccttcccacttcgtttcccacttaatatagactttgggaccttagctggcggtctgggttgtttccctctccacgatggacgttagcacccaccgtgtgtctcctatgcattactcttcggtattcgcagtttgcatcgggttggtaatccgggatggacccctagccgaaacagtgctctacccccgaaggtattcacataaggctctacctaaatagatttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccttgcaactatccgcccagttaagactcggtttcccttcggctcccttattcagttaacctcgctacaaaatataagtcgctgacccattatacaaaaggtacgcagtcaccctttcgggctcccactgcttgtacgtacacggtttcaggttctatttcactcccctcactggggttcttttcgcctttccttcacagtactggttcactatcggtcaatcaggagtatttagccttggaggatggtccccccatcttcaaacaggatttctcgtgtcccgccctacttgttgcaagtttagtaccacaacataaacttaaaatacggggctatcaccctgtgtcgcttggcttcccagccaattcttctgtctttgctgctatcacttgctggctctttcgctttcgctcgccgctactgacaaaatctcggttgatttcttttcctcggggtacttagatgtttcagttctcccggtttgcctcaacagactatgtattcatctattgatagtagattcttcatctactgggtttccccattcggatatcttggattaaacgcttcttatcaactcatccaagcttttcgcagattagcacgtccttcttcgcctctgattgcctaggcatccaccgtgtacgcttagtcacttaactatacaacctcaaacatttttatctaaaagaaaaaacatttaagactgatattaactactaaacacttaactgcttttgttcagttaagattttttactactcagactttcttgtttcagggcaaatatgatttgcccctacagaaaatctctcagttttcagcttgtttccaattttttaaagaacaatcgataatcacctttcggctaatcatcatatttaaataaacaactcactgttcgcttaaatatgatgattggtggagataagcgggatcgaaccgctgacctcctgcgtgcaaggcaggcgctctcccagctgagctatatccccaatgtcatcacatcgctttcttcgtttcactcactattcagtatagatttctcttcaccgtttagagtggtgggtctgagtggacttgaaccaccgacctcacccttatcaggggtgcgctctaaccacctgagctacagacccaaaaggatgtcttcgttctctttcttgtctacaattaccaaacaatctgtgtgaacacttgcaaatctcttcattcaggtaaggaggtgatccaaccgcaggttcccctacggttaccttgttacgacttcaccccagtcatgaatcataccgtggtaaacgcccccctttcagttaagctatctacttctggtacaacccactcccatggtgtgacgggcggtgtgtacaaggcccgggaacgtattcaccgcgacattctgattcgcgattactagcgattccgacttcatggagtcgagttgcagactccaatccggacttagatgcactttctgagattcactccacctcgcggcttcgtcaccctctgtatgcaccattgtagcacgtgtgtagccctactcgtaagggccatgatgacttgacgtcatccccaccttcctccagtttatcactggcagtctcctttgagttcccgaccaaatcgctggcaacaaaggataagggttgcgctcgttgcgggacttaacccaacatttcacaacacgagctgacgacagccatgcagcacctgtctctaagttcccgaaggcacaaactcatctctgagttcttcttaggatgtcaagagtaggtaaggttcttcgcgttgcatcgaattaaaccacatgctccaccgcttgtgcgggcccccgtcaattcatttgagttttaaccttgcggccgtactccccaggcggtcgatttatcacgttagctacgggcaccaaacataaagcccaatccccaaatcgacagcgtttacagcgtggactaccagggtatctaatcctgtttgctccccacgctttcgcacatgagcgtcagtattttcccaaggggctgccttcgccttcggtattcctccacatctctacgcatttcaccgctacacgtggaattctacccctccctaaaatactctagccacccagtatgaaatgcaattcccaagttaagctcggggctttcacatctcacttaagtcaccgcctgcgtgccctttacgcccagtcattccgattaacgctcgcaccctccgtattaccgcggctgctggcacggagttagccggtgcttcttctgtgactaacgtcaatgtaatgctctattaaaacatcacccttcctcatcaccgaaagaactttacaacccgaaggccttcttcattcacgcggcatggctgcatcagggttccccccattgtgcaatattccccactgctgcctcccgtaggagtctggaccgtgtctcagttccagtgtggctggtcatcctctcagaccagctagagatcgtcggcttggtaggcctttaccccaccaactacctaatcccacttgggctcatcttatggcaggtggcccgaaagtcccaccctctagtccttagacattacgcggtattagcgacagtttcccgtcgttatccccctccataagccagatccccaagcattactcacccgtccgccactcgtcagcaaagaaagcaagcttccttcctgctaccgttcgacttgcatgtgttaagcctgccgccagcgttcaatctgagccatgatcaaactcttcaatttaaaaagtttaatcgctcaatatgtactgactataaaaaaatcacgactgaatttattcaatcattatgaatttcaagttaagcacctatcaagacttcaaaattaaaaaaatatttttaaacaaagtcaatcaacaagtgcccacacagattgtctgataagttgttaaagagcaaaaaagaacgacgcactgtcaaatttaactacttcacaacagcgcgtcgttgtgtggtgcacattatagagaaattcaaatccaacgcaagtacttttttgcaaaaaatttgaaaaaaatgatcgcttgttcaaaataagcccataatgtttatttcaaaaacaataaatgcctataccttactatattcttatcaaacatcatctgaatatatcaatcatagaaatcttattaattccctacacatcatactcaatcaaaaaatctattgtctttcattaatttttctaatatgcttacaccacttaccgatttaaaaagaaataactaggaagtgatttgaatgacaaaactttataacagctcatttgagcgtgagaattgtgggtttggcttgatagccaatatagatggggtgcagagccacaaggtggttcgtaatggtattttaggtttatcccgtatgcagcaccgtggggcgattttggcagacggcaaaacgggggacggttgtggtctttctttgcagatgcctgagagctttttttgtgcggttgcggcggaaagcggttttaccttggcaaaaattttcggtgttggacagatttttttgccacgtgatgaagccttagtcaaagagtatattgagattatcaatgaagaattaacccaggaaacgttgggtattcctgcgtggcgtgatgtgccgattaatccgtctgtgttgggggaaattgctctggcggatatgccaacaattaagcaggtgtttgtgaatgcacctagcggttggcgtgtgcaggatttgcaacgccgtttgtttgtggctcgccgccgtattgagaagcgtatcaatcaccctgatttctatatttgtagtttttctaatcaaacgattgtctataaaggcttgtgtatgccgaaagatttgccaaagttctatttggatttggcggatttgcgtatgcagacggcaatttgtttgtttcatcaacgtttttcaaccaatactcaaccgcgttggaagttggctcaacccttccgttatcttgcccataatggtgaaatcaatacgatttcgggcaaccgtgcttgggcaagagctagggcgtataagtatcgtacgccgttaattcctgatttgcagacggcagctccttttgtgaatgaaacagggtcggattctagctcgttggataatatgttggagctgtttgttagcggtggtatggatttattccgtgccatgcgtttgcttgtcccacctgcgtggcaacaaaatcctgatatggacgatgatttgcgtgccttctatgattttaactcaatgcatatggagccgtgggacggccctgctgggattgttttaaccgatggtcgttatgccgcttgtaatcttgaccgcaatggtttacgccctgctcgttatgtgattacgcaagaccgtttgattacgattgcgtccgaagtggggatttggaactatgcccctgatgaagtggtagagaaaggacgtgttggaccagggcagttgttggtgattgacaccaaacacggtcgcttggtgcattctgatgaaattgacaatgaagtgcgagccagacacccttaccgtgagtggttaaacaaacacgttcaacgtttaattccctttgagcagttgcctgaaaacgaagtgggtgaagcgacacttgatgagttacaactgaaagtgtatcaaaagcagttcctttatgataaggaagagctggaaaatgttattcgtgtgcttggtgagagcggacaggaagcggtcggttcaatgggtgatgatacgccttttgcggtgttgagcgaacgcccacgtgtgctgtttgactatttccgtcaatacttcgcccaagtaacgaacccaccgattgacccattgcgtgaagcccatgtgatgagccttgccaccagtatcgggcgtgaaatgagcgtgttctttgaagcagaaggcatgtcgcatcgagtgaatttcaaatcaccgattttggtctattccgatatgcaacagattttgcgtttgcctgcggaacactacaaacacacgatactagatgcaacctttaatcctgatgaattgaccttaaaacaggcgattgagcaattatgcgagcaggcaaaacaagcggtgcgtgaaaaaaccgtgttgttgattgtgtccgaccgcaacatcacggctgaacgccaacctattccaagtgccttagcggtgggggcgttgcaaacctgtttggtggaagccaacttgcgttgtgataccaacattttggtggaaacggcagaagcacgcaatccacatcattttgcggtgttaatcggtttaggggcaacagcagtttatccctatcttgcctatgaaaccattgccgatatggtgcaaaaaggggcaatcaacaaaccgcttcgtgtggcaatggcaaacttccgcaacgggatcaacaaaggcttatacaagattatgtcgaaaatgggcatttcttgtgtgtcgtcctaccgttgtgccagattgtttgaagtggttggtttaaatagtgaagtcatcaacctttgcttccctggtatcaccagccgtatcgaaggggctagttttgcagatttagagcaacaacagaccgcttgtcgtaaacgtgcatggcgacacagccaagatattgaaatgggcggttatctcaaatacaaaccgcaaggcgaataccacgcttacaaccctgatgtggtgaacaccttgcagacggcagtcaatacaggcgattatgaaaaatacaaagccttccgtgatgtggtaaacaaccgtccgattaccacgatccgtgatatgttgcgtttaaaaaccgaagcaggcaaagcgattgagcttcaccgtgttgaacccgcggaaaacttatacaaacgctttgacagtgcggcaatgtctatcggtgcattaagccccgaagctcacgaagccttagccgtggcaatgaaccgcttgggtggctattccaactcaggtgaaggcggagaagatccaaaacgttatggcacagaaaaagtgtcgaaaatcaaacaagtggcatcgggtcgctttggcgttacccctgcttacttaatgagtgccgaagtgatccaaatcaaagtggcacaaggggcaaaaccaggggaaggcggtcaattaccgggggataaagtcaccccatacatcgctcaacttcgctatgcggtaccgggttcaaccttgatttcaccaccgccacaccatgacatttactcgattgaagacttggcacaattgattttcgacttaaaacaaatcaacccgaaagccttaatctcagtcaaactcgtttccttaccaggtgttggcaccattgccacaggcgtggcaaaagcctatgcagatttaatcaccattgcaggctatgatggcggtacgggtgcaagcccattaaccagcgtgaaatactgcggttcaccatgggagctgggtttggcagaagcccaacaggctttggtggaaaacaatttgcgtcataaggttcgtttacaagtcgatggtggtttgaaaacaggtttagacattgtaaaagcagcgattttaggggcagaaagtttcggttttggtactgcacctatggttgcacttggctgtcgctacctgcgtatttgccacctaaacaactgtgcaacaggcgtagcaacacaagacgatactttgcgtaatcagcattaccacggcttacctgaaaaagcgatgaactactttaaattcatcgcccaagatgtgcgtgaaattttggcagaactcggcgtagagaaattaaccgacttaatcggttgcaccgatttattagaaatcatcaatggcaaaaccgctaaacaacaaggtctagacttggctaaattgctctattcgccaaaagtgccagacggcagtagccgtttctgcacccaagccaaccctgcttttgaccaaggtttgttgaataaagcgattgtggcacaagcccaaaatgcgtttgaaagcggtttatcagcggatttggatttcgacatcagcaatttagatcgctctgtgggagcaaccctttcaggcttggtggctcaacgctatggcaatcgtggcaatccattgcaaaccttcagcatcaacctaaacggcacagcaggacaaagttttggcgtgtggttagcaggcggcgtgaacctgaacttaactggtgatgccaacgactatgtgggcaaaggcatggcaggcggtcgcattgtgattaaaccgcacaatggcgttgcctttaaaaccgaagaagccgctattgcaggcaacacttgcctttacggtgcaacagggggagaactctttgcatcaggtcgtgcaggtgaacgctttgcggtgcgtaactcaggtgcattagccgtagttgaaggcattggcgacaacggttgtgaatacatgacaggcggtgtcgttaccattctcggcaaaacaggcattaactttggtgcaggcatgacaggcggtttcgcctatgtgttcgatgcagacggcaaatttgccaaccgcattaaccctgaactggttgaaggactaagcatttgcgatttaccaactcaccaagagcatttgcgtggcttaatctctcgccacgttgaacttactcgcagtgcgattggcgaacttatccttgccaactgggacgattatgtcgcacgctttgtcttggtgaaacctaaagcgaatgacattaatgccctactaggacacaaacgccgtgcattagatgagttaggtgtgattgtgcagtaaaaagtgaaaagatgaagatgcaaatttctttcttccatcaaagtgaacgctaaactttttgaagtaatcagcaggtagggacgcactgcgtgcgtccgcttaatcgaataagctctattcaatggacacacacagtgcccctaccgctcaaaatcgttcattcatcgaaaaaataggactactctctgctttgtagaagaaagataaagtaaaaggaacacaaaaaatgagccgtgataatgtttaccaatttatagatttaccccgtgttgatccgtcaaaaattccattaaacagtcgtaaaagcgagtttatcgaaatttaccaaatgtttagccaagcacaggcagagtcgcaagccgaccgctgtttagagtgtggcaacccctattgccagcacaaatgcccattacacaataacattcctaactggctacgtttggcacaagaaggacgtatcattgatgctgcagaactggcacacagcaccaacagcttacccgaagtttgcggacgtgtttgcccacaagaccgcttgtgtgaaggttcttgcaccttaaatgccgaatttggtgcggtcaccatcggcaatgtcgaaaaatacatcaccgaaaaagcctttgaaatgggctggcgaccaacagtgaaaaatgttcctaaagccaacaagaaagtggcgattgttggtgcaggtccagcaggattaggttgtgcagatgtgttaatccgcaacggcgtagatgtggtggtgtatgaacgccaacaagaaatcggtggcttgctcacctttggtattccgtcattcaagttagaaaaaaacgtaatgagccgtcgccgtgagatttttagtgagatgggcattgaatttaaactgggcatagaaatcggcaaagacatcagtcttgacgatttgcttgcccaatatgatgcggttttcttgggcgttggcacctatcaaggcatgaaagccaatattccaaatgaacaggcacaaggcgtttattccgctttgccattcctgattggcaacacacaacatttgctcggtttagctgcccctgattacgtttcaatggcaggtaaaaaagtggtggtattaggcggtggcgataccgcaatggactgcgtaagaacatcggtgcgtcaaggtgcatcagaagtgacctgcgtttatcgccgtgacgcagccaatatgccaggtagccgtaaagaatacagcaatgccaaagaagaaggtgtcgagttccaattcaacgctcaacccgtagaaattgaagccgaaccattagctgtggaaaccgaccaatcaggcaaagtaacagggattaaaatcgtcaaaacccaactgggcgaacccgatgccaacggtcgccgtcaagccgaaatcatcgaaggtagcgaagaaatcatcgcttgtgatgccgttatcatcgccttcggcttcgctccacacgaaatgccttggctatcgtcaattggtgtcaccacagacaatcgtggcagaattgcaacggctggcgaactcaaacaacaaactgccaatccaaaagtctttgctggtggcgacatcactcgtggctcagaccttgtggttaccgccatcgccgaaggacgtgatgcggcggagagtatgatggagtatttagatgtatagcaagcggtgagattgtattaaatatttacaagacacattgtgttatatagtctgataaagataatttgctctcccgaaatatttctaaaaatatattaatacatagagagagcatttttctttacaattaattcttattaaatgaatctaaacgaataaataattcattttctaaatttaaggtaattaaaacctgttttaatcgagctaacttatcattattactataattagtttccatttggtagttattaggtaaagctactgctactcgtagttcgtctttttttccatctggaacaatacgtaacttttcagccaattgggtttctaaaaatctagtaggttcctcttggaataattgttcaattacaactctataaagctctgtaacattattaacctctaactgaatatcttggaattgtgctgaaatcaatttcctataggttaaatcatttacatccattaaattaatttctgagtcttgctcttcatattcaggttgtttccaaatattaagaaaacgttccgataataaagtaaatcgatcttcccactcattttttccccatttcgatagagaacttaatgagctatttaaccataatcgactatccttgtacaattcacgttttttgataaaacctttattagatagctcagaattatatccagttaaagtcaaattagccaaagtatgtaatttctgttgcataaattcgtattgctgcgaatctaaatcctcataccaattatcacctgcattttgaggaaaaatatgttcaaggctaatttttttattatttataatggatataaactctttattcttaaagttttctagtctttcaaacaaataggttctatttttagaagcccaattatatatagaacaattttttaatgcctcaatcacctcaacatcattcggaaaacgctgattatttgtacgttttgacaaagatttaacgattgttgctacataattttctgatactactaactcattttcattatatagtgccataaaaattttatttaatgcatttgttgggagtccaacaactagacgtcgaacaataaaagactgtaaccattctaaaatttgaatgaattgctccttattaattttatttaaataactgtaatcatgataaatatttaataaaaaaggatacgcagttttaacctccaataatttaatatattgtaagtgtaatcgaatacctacatcttcctctctttcaggatttattaatataccataatactttgaaaaccgttttaattctaataaatcatcttcctgcacccttggatatttacttttaaaagcttcataaattctagttttatttggaatctttttatttattttagtaagataatcacgaataaagtcagaaactttactttcattatttgtatcatctttagcaaacttctcaattatatcccaatattggaagaatatattttgcttatcactttctaaatccatcaatatataatttctaattaaatctgcctcacttaatgctaaacccgttgaatttaaactctcaaaaatacgttgtggattatccttccctctctctaatgaaacttctacaaacattaatttatccaatccttgtctgactatatcgaagttttctagcgtaatacaagatttaaaatatttaaaattttccaccaatcgtgaaaaatatcctaacccttcactaaaatttcctttataaatatactccatagctgaaacatgattatctgttggcttaagttttaatttatatggtgcagaagaaaacttattaatcagaatagtttcattaatttcgtcagctaagtcattttttccttgagattttgtgagatgatataacaccaaataaattaacataatggtcgttaatctctgttgcccatcaataataatccactccttaatttgtgaacttgtgtaagcaccattattgtgaatataaacaatacttccaataaaatgattagaaacatcacaatcttgccctatactcaaaatatcatttagaagttgctggcattgttcaactttccaatcataattacgttgatatacagggatagtaaactgtacttttgtgctagttaaaaaatcagcaatttttaattcacttgctttcatattcattctcctgacgatatcaatatatccattattgtgtacaaataaataacgctattaataatttttcggggggagggggtaaatctcaatattctaaaatcctacaccatattttcacaccaaattacctactcgcccagtaaagagtttaaacaaatgtgcttgtattccgaatcgtctgcaatggcaatggataaatctgctacgctgatacctgctgaggcttctccgttcatcagcatataatcatcgtctaaacaatattcccccccccttcgtaaccacaacccgttacgcctattcgttcgctaaaatacgcaccgtgctaacagatgaatttcttgtggaaatgctggtatatcaaccaatttcacattcaatgcaacaaatcaactacctgcactgcctacgatcaacaaataagggtcttgtgctgcttttgccactttgtcagtattacgaacataagttattacaaaccacttagtactcagatgctcaatttttattaatctgatgcaaaaaccgcttcgtccgttcgtgttgaggattgctgaaaagttgctcaggcgagccttgttccacaatttcaccgccgtccatcacgaccacaacatctgccacatctaacgcaaatttaatttcgtgtgtaaccacaaccattgtccggccttcgtttgccagctctttcattgtgtttaacatatcttgcactaattcagggtcgagggcagaagtcggctcatcaaacagcattaattcaggttgaatggctaaagcacgagcaatgccgacacgttgttgctgtccgccagaaagctggaatggatagagatcgactttatctgctaatcctactttggctaacagtgctaaggcttcttcccttgcttgttcaggttttttgctctgtacaaacacaagaccttccatcacattttcaattgctgttttatgtggaaagagattgtagttttgaaaaaccataccggatttacggcgtagggctaggatctcttttttggctgatttggttgcaaagtcaatgtacaacggggcatcgttatcaaaggttattgtgccttgctctggcacttctaacgcatttaaacagcgaagaaaggtggttttacctgagccagacggccctaaaatcacaaccacttgccccttttgaatgtctaaatcaatcccacgcaaaatggtgttattgccaaaagttttatgaatgtttcgtactttaatcattgttatttcgccacatatcgatcaaaacgtttttctaagcgtgcttgaataaagaacagcacccaacagaaacaccagtaaatcaagccagcttcaatgtagactggtaagaagtcataggacatatttgccacttgttgagctacacggaacatctctgtgaccgtcacaacagatgccagagaagtatctttgaatagaccaataaaggtattactcaatggcggtacggcaacacgaaacgcttgtggtgcaatgatacgacggaatgtctgcatataggtcataccgatggtataaccagcttcccattgacctttcggcacagaaagaatagctgcacgaatagtttcagaaccgtaagctccgatattgatcgaaaaaccaataattgccgctgggatcggatcaataaaaatgccaatcgcaggtaatccgtagaagacaatacagatttgcaccaacattggcgtaccacgaatgatcgagatatagcctttgacgaaccagagtaacagacgatggaacgcgctattgacgggagtaacacgaactaacgctaccccaacggcaatctccataccaataataaaggaagcgattgccaaagggatagaaactaaaaaggccgcttgtatcatcggccagaaaccatttatgaccagctcaacacgagcttccgtcataaatggtagagaaagtaataaactatttaacactgatatctttaccaaagaattgttcacctaatttcttaagtgtaccgtcttttttcaattcttcaactgcttgactgatttttgcaagagcttcagtgttacctttgttcacaataaaaccagcgcccactttatctgttgcttcccaaactggttttaagcctgaatttgggtttttcttcaagtaatctaacaatgcaagtgagtcattgaaggtcacatctgcacgtttttgttgaagtaataataacgcttgagccataccatcaacagcaacgatttctgcaccatttttctgtgccagttcaccatagttagagcttaaggtttgagcggcttttaagcctttaacatcttcagctttgctcacatgggtttcatcattacgagctaataacatcgcgccagaccagctatattctgcagatttatcaaatgttgcttgacgttctggggttgttaagcctacttggtttgccacaatatcaaaacgctcaccttttaaacctgctaacattgcgtcccattgagtttctttaaaatcaacttttacgcctaatttttcagctactgcacgagtaacttccacatcgtagcccgttaatttaccgcttgcatcgtggtaagtgaaaggtgcataagttccttccgtacccacagtaatagtgcctttgttgttgatacgatctaataaagactcttttgccaatgctgctgtagaagtgaaaactgccgctaaagataatgcaacgattgataattttttaaacataataagttccttttgataggtaagattgattgcttgcaaatttaagggcaaattagaccgcttgcaaataaccaaatgaaatgtaaaacaacaaaaagtttggattgataagagattggtggctgttcagcgcctaacagttagactaagcagcccgattaacgtatagaggataaacctcacctatcgctaattcagggttttatttaatgatgaaattattgcttatgatttaacaatgactcccaagtttgaactattctcccgactgacgaaccaagttagctatatcgaatggcaagttattaaacgattcacatatattcaagtgcaattaaaagggctgaactagtctaacggtggggaagagattaatatacccatttatattatctataaggtcaagtagatactagttatttagatagaattgacctttttttcatctgataaaacaagataactagatttttgcccaaataatttctataattcaccgtaattttgagattccccccttagctcagtcggtcagagcaggcgactcataatcgcttggtcactggttcaagtccggtaggggggaccaaataacctttcttagcctatcgcaacctttcgcaaaacccttgatacacaaagccccaaagcctttttatcctttttgcttatcgttttttatcgtcttttttcgtatttaatcgcaaattttaggaacaccgttaggaacacaggttataatattgaaaatccagtgttcctaaaaatcgtgaaagccttgatagataaggcttgcagcgttttttatttttcatgttcctaaaattattgtgttcctaaggttcctaaattatggcaagaattaccaaacctttaactaatactgaagtagaaaaagcaaaacctaaagataaggattatagtcttatggatgggcaaggtttatttttacgagtaaaaaccaatggcaaaaaattttggcttttcaattactataaacctttctctactccacccaagcgaacaaatctaggtattggtgcttatcctgaaatttctttagcccaagcaagactgataagagatgaatggcgtgctttacttgcgaaaaatatcgatcctaaagttcatcgtcaaaatatcgtagatgaagaaatctcaaaaagagaaaacacatttgaagctgttgctaagaaatggcgtgaaaagaaatcgttagaagtacagcctaagacaatggaaaagaattgggcccgattggaaaatcatctttttagtaaaattgggaatgtggccgtttcagagattacccccaaaatggtgattaaggctgttgaacccctaaaagtgcgtggcgtgggtgatacgttgcatcgtgttattaggttgctgaatgaagtgctaaattttgctgtaaatatggggttgattgagtttaataaatgcgtgaatgtatctgcaaatttctcaacgcatactgcagaaaataacccgaccatacgccctgaattattacctgaatttttatctgatttagatgatagtaatagctcgatacaagtcaaaattctgattaaatggcaactgctcacaatggtaagaccaagagaagctgtatctgttgaatggcaagaaattgattttgctaaaaagacgtggactattcccgccccaaaaatgaaaggcggtaaacgttcgcatactgttccattatctcgtcaagcgatcacccttctagaaaaaataaaaagtatcacaggctataagcgttttgttttccagagcggaacaaacccgaatagatcaatgagttcacagacagccaatagagcaataaagctacttgttggcggtaaatataaagacagattaacagcccacggattgcgctctattgccagcacatacttaaatgaacagctaattaattatgatgtgattgaggcttgtttgtcccacatcatcgcagatcaaacaagaaaagcctacaaccgttcagattattttgagcaacgaatcgaagtgatgcaacagtggggcgattatgtagaacggtgctctataaaatctactctataactttgaacgcctagcctacccgctgggcttttttctttcccattcatcaccatttcataaaaaaataatttttttaaaaatttagtcacttattcacttattcacttattttttcttttaacttattgaaaaataaagaataaatagaagtgactaagatagtgataattaagtgactaagtgactaaatctagtgattaaaaattttctcaaaattaacctttcctagagttttgtaaatttagcctccgtttcttttcgtatcctaactataaaaattcccttactttacaacgagttataaggctatatattaagatattggcttattgtaagccgtcttaattaagagggtttttatgaaaattcacaatcaaattagaaaagaagtaattgattttctgacagagcatttacaggaaatttattactttcataacggtttaccgaagattatcgacactgataacgaattgcctttagttgcagtgtacttaaatgatgcttcaggtgaacccgttactattgggcattctgaatggactgcagatttaatcattctgacctacttacctttttatcaaggggaagaaaagctagatgaaattaacgaaaaaattaatgatgccattctattcaaagactttaaaaacttttctctaactgctgattttaatcagtcttacgattatgaatacgacactgaaaataatgtgtgggtaagttcagctttaaccttccgtattcagtataaatttcaacaactaaacaaatccaatttaggagatgaataattatgttcaaaaaattattagagttacgccagcaaaaagcacagattgaaacagaaatgcgttcaatacatctatgcatatccaaaaaccacgcaagaaattttagattttggcagcgtagatattcttagctggctcactgatgaaatcacagaatcttttgcagaaacagaagaaacggatttaaccaatggtacaggcacaaaacaagcaaaaggcttcttagcttatccacgcaccacagcaaacgataagacccgcccattcggtacactgcaaaaaatggaagtagttccatctaaattaaatgcagatgcattaatcgatctgctttattcattgcatagcaaataccgtaaaaatgcggtatgggtgatgaactcacaaacagcaggcactttacagaagctcaaaaatggcaatggtgattatatttggcgtgatggtttacaagtgggtgctccatctactcttcttggtttacctgtttactatgtggaaacaatgccaaatgctcaaggtacaaatccattcttagcggtgggtgattttaaacgtggctatacgattgtcgatcacgaaacaggcacacgcacaaaacctgatgcaatcacagaaccaggattctataaaatccacacggataaatatcttggcggtggcgtggtagattcaaatgctatcaaagtgttagaagcgaaagtatcttaatccattacaggggcgtaacagcccctttttgtctttatggtggcaataatgaaagatttagaaattagatccacaaccctttcaaccgatggcgaaaataaaaaattagtgggttatgtggtgcagtggaataaagaaagcgaagtgttatggggtgagtatgtagaacgattcgccccgaatgctttttcagacagcctaaaaagtggtaaggacgtgcgggcgttgtttgagcacgaccacacaaaactattaggcagaacatcaagcggaacattaacacttgaagaagatgcaacggggttacgttttgagctgattccacccgacacacaattagggcgtgatttattggttagcgtagaacgtggcgatattaacggaatgtctttcggcttcagaacagtaaaaaatgaatgggatttttccgtagagccaaatttacgaaccgtacaacaagcggagctggtggaggtgactgtaacaagcattcccgcttaccctgattcaagtcttgagattttaaaacgttctcaagcggtagcaaaaggcgaaaaatttacacattggcaagatgaaaaccgtcgtaaatggttagcggtactgggggcgtagatgttcggatttttcaagaagcaagagcctgaaacccgcagcttatctattgatgaagtgatggcaacaatgggagcaactaacacaggtgcgggggaatttgttagcccacatactgcagaagcgttgcccgctgtattaaatgcggtaaatgtgattgctcaagcggtggcatctatgccttgctatttgtttgaaataactgcagatgggcgaaaacgcatagaaaatcatagtgttgagtatctgcttaatgaaatgccaaaccgtaaccaaaccccataccagcttaaagaagtgatgatgcgccacttgcttttaaatggtaatgcgtatgcggtgattggttggaatagcaaaggacagcctgaaacattaacgccatacccaccctattccgtcaatgttcagcgaacactaaaaggcgattatctttaccaaatcaccgacctaaacggcaaagtaaaaaactactttcaagatgaaattttacatttgcgacacgcttcaaatgatggctttatggggcgttcacctattaccgtttgtcgtgaagccgtcggtttagggttagcccaacagcgacacggatcggcggtaatgaaaaatggcttaatggcgggcggtattgtcacaacatccgaatggttagatcaaaccaaagggcaaaaagccttagaagccttaaaacgctatcaaggtgcgaagaatgcgggcaagactccactgcttgaaggtggaatggattacaaacagctagggatgagtaatcaagatgcggaatggttgggcagtagaaaattcactattgaagatattgcccgcattttcaacattagcccgattttcttacaggactattcgcattcaagttatgcgaatttcagcgaagccagccgagcatttttggggcaaaccttaagaccgcatttagtcaattttgaacagcagttaaaagatgccttgatgattgatctcaccagtaaaagccgtaaacgctatgtaatcgagtttgacacaagcgacctactgcgaaccaatcagcaagaacgctttgcgagttatgacaccgcaatcaaatgcggcattcttagcccaaatgaagcccgtaagcgtgaggggttacttccttatgttggcggtgatgaatttagtcaagcgtggaagcaaacagtagaagttaaaaaaggcggtgaagatggcaagaatggttaaggctggcacttatgacaaggtaatcacactgcagcaaatcgccaaaccgaaacccaatgaacaagggaaaattattcgtaatggctctgttttaaaaaacgaatgggaagatattaaaaccctacgggcaagtatcgagcctattcaagggcgagaatatttcagtggcgtttttcagatgggtgataccgttgtacggataagaatgcgttatcagcctgatcttgaagtaaccagaaaaatgcgggttaagtacggaaaccgaatttttaaaattgaaaatgttatcgacagcaaagagcaacataaagaacttcaattaatgtgtaaggaaggagaagctcacaatggttaaacctgaaatagatttagatgaaatcaaagcccatttacgcatagagcacgatcttgatgatgaactactaaccttatatgcggacacggccctagaagtagcacagaaccatatcggcaaaacgtggggagaatcaaccacagccgaaacggtacagtttacgaatggcattaaggttggttgtttaatgtttatcgggcatctatatgcgaaccgtgaaaccgtgagcgatgttcaactgtatgaagtcccattcgctattaaggcattatgaaatccatacagagaacccgcaatctattaggggtacataatgccaatgcaacctttaaagcgttgctctttccctggttgtcgtaatcgtgtgaagtctggcagatgtgaagaacatcaacagaagaagcaagataatagattgcccgcaagcaaacgtggttacgatcatagatggaccaagtacagagccgaatacttaaagcataaccctttatgcgtgatgtgcttagcgaaaggaagctacacaccagcgacagtaatcgaccatatcaagcccgtacagaatgggcaagctgatccgctcttttgggtaatgagcaaccaccaagcattatgccgtgattgccatagctacaagacaagagtgatagataagcgtggatatggagcgaagaagtaaaaggtatagggcaaagcaccacacctacaacggattacagcgtaatgatgtgttgtaagggattcgtgttatacgaatacctacttagttgtggtcatatgaccataactgaaacatctcctcaattttgagctttgctttaaaatcaatgagttataaagaaattaaacaggtggggggagtttttgaaagaaaagcccaactgctaagaaccgccccccactcaatttttacgcacgacaattttttagaaaatataggcattcccgaaataatagggatttaattcccgaaaaagtagggaactaaaggagaatagcaaatgacaacaaaaaccccaaaagccccaagttatttagatgagattgctagagagcaatggaaattaaaaattaaagtgttggcggaacgtggtgatattactagcgaagattacaccaacctagaactttattgcgtgaattacagcctttatcgcaaagccgttcaggatattgcagaacgtggcttcagcattacaaacagccaaggcacagaagcacgcaactccgcacttactgcaaaaagcgaagcggaaaaaatcatcattaaaatgtcttctttgcttggttttgatcctgtaagcagacgaaaaaacccaatagacaccgaagaaacagacgaaatcaacgaaattttaacgatgtaaatagcttatgagtgaatggaataactacgctttagcggttaaaaatggcgaaatcgtggcgtgtaagcgtatcaagcaagccgtagatcgctattttgctgatttagcaaaccctatctactgttttgatagcgaaacagtagagaaatttatcaagttttctagattatgcccacacgttaaaggacacctatacggacaaccgatagagctttcagactggcaaatctttctctttgcgaatctactcggctttaaatatcgtgatagcggattaagaaaatatcgctctgcttacgtgcaggtagcccgaaaaaatgcgaaatctaccataggggcaatactggcgaattggttcttagtgatggaaaaaggacaacaagacatttacaccgccgccgtcagccgagatcaagcccgcattgtgttcgatgatgccaagaaaatggcgatgttatccaaaccactaagcaagcgattaaccattcaacagcacaaaatgctatttctgcaaaaaaacagcttaatgcgaccgcttgcgagtaaatcatcaaccattgaaggcacaaacccaagccttgcgattgtcgatgaatatcacctacaccccgataacagcgtatatagtgcactggaattaggacaaggtgcgagaccggaagggcttttatttgcgattaccaccgcaggcagtaacaccatttcagcgtgtaaacagcattatgattactgttgccaaatcttagacggcacggaaaaaaacgaaagtatcttcattctgatttacgaactggacgatgaaagcgaagtagacgacccgacacaatggatcaaagcaaaccccaatataggcaaatcgattccctacaaagattttgagaacaccatcacaaaagcccgtggtattccgtccgaatgggtggaaatgcttactaaacgctttaacgtgtggtgcaacggctctacaccgtggctaggcgaaggcaactggaaagcgtgcggacgaagctatgaagaagaaagcttacacggtaaggcgtgctatatggggcttgatttatcttctacgaatgatattaccagcctttgttacattttcccgactgaaaacaacaaagtaaggctacttacacggcactacattcccgaatatcaactgcagaacgtggctaataaaaatcgggctatctatcaacaatggcagcgtttaggctggttacgagtgacaaaaggtgactgtatcgactatgacaaaattcgagatgatatttttaacgatgcaggaaagtttgaaatcaaaatgatagggtttgatgtatggaacgccacacatctacgcacacagctacaaggctacggcttagaggttgaaccattcccacagacctaccaacgttacagccccgtggcgaagtcggcggaagtgctgatcaatagacaaatgatagaacacaatggcgatcctgtgcttgcgtgggcgttgtcaaatgtggtaggggaccattcaaggtttgataaattttcttacattcccctttcaatatccctccttacgcacatagacattttaaaaaacgaaggaagatgaaaataacatttttaatatttttcaaaagctataagcatacagggctaatagtctccactaaaaatattaaactgtccttcctcaatcagatagctattcttaatattatacagaagtatgaggtgattatataagcatcccagaaaacctagccactacacaaaacataagacaaatgagtttaagaatattcaaaccccattctaagcggcatcagtgaaaataaaaggcatagtagacaaaataaaaaatgtggcattacggattaaataatgccacataaactcgacgatattgaggaattttttcttattatttgacaacgattataatactctaaatacgaaataaaggcgaagaaataattcaacttttttttcaaaaattggagcaagatcacaaaatttttcacttcctcctaaaattctctacacatacccataacccatcaaccgctgataacggcgatcaagcaatgcttctgcatttaacggatccaagtctgctaaatcctcaagtaaacgttgtttcaaatttgctgccatctcatcaaagttacgatgagctccgcctaatggctctggtacgatattatcaattaactcaagttcttttaaacgtggtgcggttaaacccatcacttccgcagcggttgaggctttttcagcactcttccataagatagaggcacaaccttcaggggaaatcactgaataagtgctgtattgcaacatattcactttatcgcccacgccgatcgctaaggcaccgcctgaaccgccttcgccgataaccgtacagataacaggtacttttaaggtggacatttcacgcaagttgcgtgcaatcgcttctgactgcccacgctcttccgcaccaatgcctggatatgcccctggcgtatcaatgaaggtgatgatcggcatattgaaacgttctgccatctgcattaaacgaagggctttacggtagccttctggtgctggcataccgaaattgcgtttcactttttctttcacggtacgccctttttgatgcccaattaccatcactggacgaccatctaagcgagcaataccgccaacaatcgctttatcatctgcaaaagcacggtcgccagcaagttcatcaaattcggtaaaaatacgctcaatataatctaaggtataagggcgacttgggtggcgagccatacgagaaatttgccacgcatctaaatctgagaacgttttcttggtgagttcttcactttttttctgtaaacgtgcaatttcatcatcaagattgattttgttgtcattacctactgcggaacgcaatgcttcaatttttgcttcaagctctgcaatcggtaattcaaaatctaagtattctgttgtcataatttttcctatctgttttggcagaaataaaaaccgctgtattttatcagtgaatgtgacataagcggtaagatttccacatttttttgcaagttttctcgctgatccgaccgcttaatgctattccgcaacaacaaattgccccatacagccacgatctcgtaacattaaatcggataccccgaaggtgaatggctgttgctcagaggctgtatgctcaaacttaactaacaatgtagtttcttgggttggttctaaccatacacaatctcgccaagccaactgtttatgaggcacagcctgacgatttctcgtttccaccataaatttggcaccctgtaaggtaaaaccaaccgcttccgttgtggtcaaataccaacgttccactgttcctttttttaccgtaaaatcgatccgcttaggatcaaatcgttgctgattgattaaacggtcttgtgggcggagattgattttacgttcttgggtaatttttaagttaaactcttccacattaaatgggggaagttttggtgtcacatttaacgctgaaggcaacccctctgggcgaaactctaacaccacattatcatttaactcattgttatctttgaataatttcccaatttcatcaaaaaaatctcgcttcttgccagtgattaatgaaaccttatctccctcatttaagtccactaaaacttcaattcgttccgatggagcaagggaaatatgttccatttcaaccatatccgctaaaaaaccaatccccgttgcaattaaatagagcggtttgccattgtctaaacgtaaatcataatgacgagagagggaagcattcgcaatccgcaaacgaacccagccacgaggtacatcaaaataagggctttcttgcccattaacaaaaaggcgtttgccaaaaaattgattagtttgagtgtcaattacttgaacgccatcactgttaatcaactgatcttgcaaaatcagcggaatatcattaaccccatatttattaggcagtgacgcttttctactttcattatcttcaatgatccacaaacctgccaaaccacgataaacttggaaagcggaatttaacattgtgtctgcgtgataccaagccgtacaagcggattgattaaccgataaaatcggcgaccaactgctgtttttgtctatagcacggtgaatagaaccgaccatttccgttggagcttgtagcccttggatattgatcgataatgcttgtggcaggttgttagtataggtcagcttgacaaaatcacctgacttcactcgtaccgtgggggcaagataacgcccatttacaccccaaacatcaaccagtttccctttattaaattgcgtttgagcaggacgaaaatccaatcgaacaggacgaccacgccccacttcaatcatcggcggaatggttaaactaggacgatttttcgcccataacgacgtaggggcaaaagtagctaccccagctaatgtagagcgttgtaaaaattgacggcgagaaagtttcatattatttacgttctaattgtgcgacttcttgatctaattgttctattttagcctgcataatttggtgacatttttcaatcagctctttgagattttcacggtcataacccgacgtatcaatcggttctaattgctcacaaatcaccacgccattatccttacgatttaagtcaattttattatgagtcgttgaacagacaatcggcacaataggcacaccagctgcaatcgccgtatgaaatgcccctgttttgaaaggtagcaatccacgcccgcgactacgtgttccttctgggaacatccataccgagatttgtttgtcacgaataatctcgccaaccttattcatcgtattaatagcactactacgtttttcacggtgaataaaaatattccctgttgcccaataaactaagccaaaaaaaggaatacaaatcaagctacgtttacccatgctcacggttcttggtggtaccattgctgcaattgtcaccatatcatagttattttggtggtttccaatataaatagctggttgattaaatgtcgctttattgcgtgtaattaatttaatgccaaccaacttatgcagtgaaccaaacatatttgccacaacgctaacactatctggatggcgtaaccgtactaacgcataaagcgagccaacaatactgattaacatagcaaaggaagctactgcaacaatgcgaaatagttttaacatagtaaaaaacctttaagaagaaatattatagaaagtatagccgagatgtcctcatttgccaaaaagataagcatcaactattgctaaaattcattttcattttgttaagaaatcgttatattgagcaagttttttcaacctatttaggagttattatgagtcaagttacattagctggaaatgctatcgaagttacaggacaatttccacaagcggacagtttcgtggcagattttacattagtgagcaatggcttagaaaacgtatcactttccgacttcgcaggaaaacgcaaagttcttaacatcttcccaagtattgatacaggtatttgtgcaacttccgtgcgtgttttcaataaagaagccgccgaactcgcaaacacagtggtactttgcatttctgctgatcttcctttcgcccaagcacgtttctgtggtgctgagggaattgcaaatgcccaaacactttcaacattccgcaacaaagccttccatcaagcggtaggcgtagatattgcaacaggcccattagcaggtttaactgctcgtgcagtgattgtattagatgaaaacaataaagtgctacacagtgaattagtccctgaaatcaaacaagagcctgactatgcagcggcgttggcagtgttgaaataagacgattcattgaatgataaaggacgccagcatgacgtcctttatcacttaaacaatatctaataattccacttcaaaaattaacgtgctaaatggcggaattgacgcacctgcaccacgctcaccgtaagcaaggttatgtggaatggttaaacgccattttgaacccacaggcatcatctgtaatgcttcaacccaacctgcaatcacgccggtgactgggaactctgctggtgtaccacgtttcactgagctgtcgaataccgtaccgtcgattaatgaacccgtatagtgaacacgtactttatctgttttcgcaggcactttacctgtaccttccactaacacttcatactgtaaaccactttctgtttctttcacagctgggtgttttttattctcttctaagaacgctttaccctctgccgctaacgcttcaaaagcttttgcttgttctgcttcggcacgttgagataactcttgtaacgctttggttacttcattcaaatctaatgcaggtgggttttgatttaacacatcaaaaatcccttttaccaccgcttctggttcaacatctaaaccactgcctaataattgctgaccgatttgtaaaccgataccataaccaccttttgcttcaacgctttctaatttcacttgttctaaatttaaagacataatttttccttatgtgtagaggggatcccccgttaatgtgtttatataaattcgggcgaggataaacctcgcccctacattcattaaaataatgactgctgtaatatagagccagattggcaaattacaagtacaagcggtcggattttggcaaaagaaaccaccgtcccaaccgtaaacgtccactaatttacccattacccaacctgcacttgcagaaccaagtaagtaactgaataaacctgttaaacctgttgctgtacctgttgcaacacgtggcactaaatctaccgcttgtaagccgatcatcattaccggaccgtagattaagaaaccaatcgccactaagcagatgttatcaactaatgggttgccagctgggtttttccagtaaactacaatagcaattaatacaccaacgaggaataataacattggcggtgcacggtgacctttgaatactttatcacttaagtaaccgcttgcgagcataccaaagatacctgcatattcataaaggaagtatgcccaactttgtttatctacggtaaagtgtttaacttcttttaggtaggttggcgcccagtcaataatcccgtagcgaatgaagtaaacaaacacgttcgcaatcgcaattgcccataagaatttattgttaatgatatatttgtagaaaatatcttttgaagaaagggtatgtgctgattccactttttctaatactttctcgcctttccactcatcaacaggcggtaaaccttgtgattcaggtgtatcacgcattaagtaaagcaccacaaaggcaagtacaatcgcaatcaatgctggaaggtagaacaaggattgccatacaccgaagatagataaccccaaaatcgctagtggaccaatcaaactgccacctaagttgtgtgacacgttccaccaactccaccaagctccacgttcagaacgagagaaccagttggtcatcgttttagcacctggtggataacccataccttggaaccaaccatttaagaccgcaagtaagatcattaatggaattgaagaaagtacgcccagtactaaaccaaaaatcaagctgatgattgctgatccgaataaaccaatggtgatgaaatattttggatttgagcgatctgaaacatttcccataatgaatttactaaatccataagcgagagataatgccactgcgaccgtaccaagatccgctttgctaaatccatattcttcgattaaataaggaatggctaaagaaaagttcttacgaatcaaatagtaagctgcatagccaataaatacaccagcaaatacttgccaacgtaatttgcgatattctgcgtctgtacgagaactttcaattctcggtgcaggtgcagatgcctttagaaaagaaaacatacaagctcctttgtaacttttataatataaaaatttcgcttttaaacattttttgataattaatgttcgttttgaattatcggttaaaaatactttacattacaaatgcgtattgtaagttttatgatatagatctaatttttaaagtgggtttgcctataaaaaacaacaacttagagtgcaaaaacgtttacgtttttgcaaaaaatctcgcaaatctcaccgcttgtgattgactaacgaaggtgaacagatacaatcacatcatttgaattgtagggtgggggttgcctcaccacctacgagccatattttatggtgggtcaagacccacccaacacttaaaataacaaggacaacattaatgaacctatacaacatcaaacaccctgaagaacaagtaaactttgcccaaggcgttcgccaagggttaggtaaagatcagggcctctttttccctgaagtgttacctaaatttgaagacattgacgctttattagcattaccgctggttgagcgtagccaaaagattttatcggcattgattggcgatgaattgccacaagaaaccttaaatgcaatggtgaaaaatgcgtttactttccctgcaccactagcaaaagtgaataatgatatttatgcgttagagttattccacggtccaacccttgcttttaaagactttggcggtcgctttatggcacaggcattaagtgcggtgcgtggcgatggcaaaattaccattttaacagcaacatcaggtgacacaggtgcggcagtggctcacgctttctacggtttagaaaatatcaatgtggttattctttatccgaaaggtaaaatcagtccattacaagaaaaattattctgtaccttaggcggtaacattcgtaccgtggcgattgaatctgactttgacgcttgccaagcgttagttaaacaagcctttgatgatgcggaacttcgtcaagctatcggcttaaactctgcgaactctatcaatatcagtcgtttactcgctcaagtttgttactactttgaagcggtggctcaattgccgaaagagaaacgtagcgatgtggtggtttctgtaccaagcggtaactttggtaacttaactgcaggcttaattgccaaaaccttaggcttaccgattaagcgttttatcgcttcaaccaatgcgaacgacactgtgccacgttatcttaaatcgggcaaatgggaaccgaatgcaacggttgcgacattatcaaatgcaatggatgttagccgtccgaacaactggccacgtgttgaagagctgtttaaacgtaatggttggagcttgagcgagttaggttcagatgccttaaatgatgcagaaaccgaagaagcattaaaagcacaatatgcggaaggctatttatgtgagccacacggtgcgattgcttaccaagtattgaaagatcagctacaagtaggcgaaacaggtattttcctttgcaccgcacaccctgcgaaatttaaagagagcgtagaacgtattttagatattgaactgccgttgcctgaagcgttagacaaacataacaaaatggaactgttgtcggatacaatggcggcagattttgcgaagttaagagagtatcttttaaaataacattccctataagcggtaagatgaagacgaaatacattatcttaccgcttatttttataccaaaaacaacacaggaattaaattcatcaccatcatcgtcaaaatcgactggatcacgcgggacgatccgaagataaatccacgatttttaccgttatcaaatttcactaataaattcgccattgccgttaatgcatagacttcaagcaaggtaaaaatcaccagatagagataggcagaaaccaacgaagcataatgtaaggtgataaaccagggcacaaccataccgacggctaaaatcgggctaacgaaaataagttgcttacgggttaaattgatatgcttggagaaatacgattgtaggacaacggtcattaacccattgataaataacgcaatcgggatctgctccggggcattgagtttattgtcaaacagataagggaaaatcacaaaaaacgacattgcgacacttaacggtacaaacagcattaagtgaacaaaaataaactctttggtgatgatttcccgaatttgcccccaacgaaatttcactaaattgttcacattttccatttggtagaacggctttgccataaacacaaataacactgcttccaagagaaaacagcaccagattaacgcattgatatgttcatatttgataaagggaatagcgagcaacggggctgccattgacgacatactggtgacccgtaagaatttaccttgtaagcgagttttcgccgcatattcatcgccagccaatgtaagtaaacacgcccttgcattcgttgcaaacagacaacttcccataccaaagcacattgtcgccattaataacaccgtgtagctttccgctgacaagaagaaaacataggcgatcacatcgagcatacagccgactaacatcattttcgctaaaccatagcggtcgcctaatacccctgcaaaaatcgcaagggcttggctacaaaaaaacagtaccgacaatgaaaatgcgatctgagcgttagataagcctttttgttgcaggtagataaaaaagaccgtttgcattgaaaaataagcaagggtcgaaataaaacgacgagtgagtaataatttttctaaagacatttgaatatctataaacggctatctgaatatgtagctaatcctatgttatgaatatattttacaatgttgattttttatataaagaactattattcatatcgtgctttaattattctctatgatacagagatcatcattattggtaagcattttaagattcactcacataatacaagcgctcctattcccttcaatcttttgcaactcgcccccatagcgagtacaattcttacatttgcaatatttcggataaatcaaaccgcttgtatgtcatttgaacttcaatttcgtctgccgaaagcggacagcacacatcaagatcatcaaactttaggcaatttaatcgggcattcggatacccttgcgattgtacaggctagccagcagtttcaaggcttgacggtggtggtgacacctgatactcgcacagcgttgcggttggaaaaaagtttgccgagcttcacgaaactgtctgttcagctttttcctgactgggaaactttgccttacgacaatttttcgcctcatcaagacattatttccgcccgtttatctgcgttatttcagttacaacaagggcagaagcagatttttctgttgccaatcaataccttattacaaaaagtctgcccaccgagttatttggcaaacaatgtactgttgattaaaaaaggcgaccgtttttcgattgagaaattgcgtttacagctggaaaatgccggctatcgagcggtggaacaggtgctggaatatggcgaatatgcagtgcgtggggcgttgctcgatctctatccgatgggggcgaattcgccttatcgtttggacttttttgatgatgaaattgacacgatccgtacctttgatgtggataatcaacgtaccattgagcagattgatgcaatcaatttattgccagcccacgagttcccgacagatagcaacgggatcgagtattttcgtggcaaattccgtgaacaatttggtgaaatccgccgtgaacctgagcatatttatcagcaggtgagcaaaggcattttgaatgcagggattgaatactggcaaccgctcttttttgagcaaatggcgagcttgtttgactatctgcctgaacagacattgtttattacctttgccgatattcagcaaaaagccgagcaatttcaacaagatactgcaagacgctatgagagtcgacgtgtcgatccgatgcgaccactacttccacctgaacagctttggttcaatatcgatcagattaaccaacagctaaaaggctatccacgtttaactttaaccaaagagaaagtacgcagttcggcggcgaagcagaacgccaaccttgagccgttgcctgacattgcggtgcaatccaacccaaaagagccttttgccgcttttttacagtttcagcagaaatttaaggggaaaatcctcttttcggtggaaacggaaggcagacgggaaaccttgcttgagctacttgcaccgttaaatatcaaaccaaagcaagtgaagcaactggcggagatcaattcgccagtttctttactgatctcaccgcttgatcaaggttttattattgaaacaagcggtcaaaaactggcgataatttgcgaaacggagctgttaggcgaaaaagttcagcaaagtcgccgacaagagaaaagccgtaaaaccgttaatcctgatactttgctccgcaaccttgccgaactgaaaatcgggcaagcagtggtgcatttggaaaacggcgtggggcgttatggcggtttaaccacccttgatgctggcggtattaaggcggaataccttgtgttgcattatgccaacgatgccaaactttatgtgccggtggcttcgctccatttaattagccgttatatcggcggaacggacgaaaatgccccgttacataaactgggatcggaagcgtgggcgaaaactcgtcaaaaagcggcggagaaaattcgtgatgtggcggcggagttgcttgatgtctatgcgaaacgtgaagcacaaaaaggctttgcgttcgagtacgatcgtgatgcgttcgtgcaatttagcaacactttcccgtttgaagaaaccgaagatcagaaaacggcgatcaatgcggtgattagcgatatgtgcttgccgaaagcaatggatcgccttgtgtgtggcgatgtcggctttggtaaaaccgaagtggcaatgcgagcgaccttcttggcggtaatgaaccataaacaagtggcgatccttgctccgactaccttgttggcacagcaacattttgagaattttaaagatcgttttgccaattatccgatcaacgtggaagtgctttcccgtttcaaaaccgccaaagagcagaaggaaattctggcaaaagtggcggacggcaaggtcgatattttggtcggcacgcataaattattgcaagaagatgtgcagttcaaggatcttggcttgttggtgattgacgaagaacaccgtttcggcgtgcgtcaaaaagagcgaattaagcaactgcgtgccaatattgatattctcacgctcacggcaacgccaattccaagaacgctcaatatggcgttgaacggaatgcgagatctgtcgattatcgctagtccgccggctcgccgtttgtcgatcaaaacctttgtgcgacaaagcgatgatacggtaatcaaagaagcgattttgcgtgaaattctgcgtggcggacaagtttattatctgcataacgatgtagcgaccattgaaaatactgctcaacagcttgccgaactcgtaccagaagctcgtattgtgatcggacacgggcagatgcgagagcgtgagttggaacgggtaatgtccgatttctaccatcaacgctttaatctgttggtttgctcaactattattgaaactgggattgacgtgccgaccgccaataccattattattgagcgagcggataaatttggcttggcacagctacaccaactgcgtgggcgtgttgggcgttcgcaccaccaagcctatgcttatatgcttacccctccgccaaaaacactgaccaaagatgcacaacagcggttagaagcgatgagtagcattgataatcttggggctggctttgtactggcgacccacgatcttgaaattcgtggagcgggtgaactgctggggagcgaacagagcggacagattgagagcttaggtttctcactctacatggaactgcttgaaaatgcggtcaaagccttgcaagaagggcgtgaaccgaccttagacgaaatcactcaacagcaagtggatattgaattgcgagtgcctgcgttactgcctgatgattatctgcctgatgtgaatatgcgtttgtcgttctataaacggattgctagcgcagagagtgatgaagccttaaaagatctgaaaattgagctgattgaccgcttcggtttactgccggaagccacgaaaaatctgttccaaattactcagttacgccatttggcaaaagggttgcagttgaaaaaagtcgatgcagggatcaacggcggttatcttgagttcaaaccaacagcaacgcctgatccgatgaagttcttaaaactgatccaagcggataaaaatgtctataaatttgacggcccgttgaaattccgctttaccaagccaatggaacgggcggaagatcgcttggcgtttgtggcggagttgattgagaaaatacgttaaaagcaaaatagccacgttatgcgtggctattatctggtgacaatcattgaagttgaactaattaatgcagcgaacatcacttttttaggcttaaaggacaaaattaaatatctatagccaccctttgcgtttaaaataaagatatggtgtcgcagccgcacaaatcatcaaaccgatagccatcggataaccatattgaaattttaattctggcataaattcaaagttcattccataggtagaagcaaccaatgtagcaggaaggaacatcactgacactaccgagaaaaatttcataatacggttctgctcaatattgataaaacccattgccgcttgcattaaaaagtttaccttttggaagagagattcgttatgcggttgaagtgattcaatatctcgcataatatcacgagcctgttcaagctgattatttggcaaacgggttttacgcaataagaaactcaatgctcgctgtgtatccatcaaacatagacgaactttagaactggcatcttcaagttccgttaattcagcaagggcatcatcaaagttatgctcgcctttattttcaccctcatgagtactgagaaccacacggcttaatttttctaaatctgcatagatattctcaataacatctgccaactgctcaatcttagtttcaaataggtcaagtagaagctcgtaagcattgccatctatcaattttgcacgacgggagcgcattcgatacaaacggaaagcgggtagttcccgttcacgcaatgtaaataaacgcccgtcccgaatagtaaaaccaacagtagcaatatcggcatagtcgtcatcatctaagcagtagaagaatgagtgtaaatgtaagccatcttcatcttcaaaaaaacgtgcagaagcctctaagtcttccaattcgtgttcttccgcaagggtctgatctaatcgcgtttctaaaacaccacgttcttcatctgtaggatcaatcaaatcgatccaaatagcttcattaaattgattttgaatattttcatctacactgactaggcgatcgttatttaacgaaaaagctctgatcatttcatactcctaaaaattggatatgaggcgatgaacaaaaaggaacaaaatataagatactgataagaattaccgacgctcatcggcaaagaggttttggacgaggtgggttaaaaaactgataagtatcgactgtgactgtccaaaatgtgtatcctcaaagtgaaaaaaacgggcgaatggtacagatttagaattgagccgtcaaggaaaatgacattatttttagatggagaacaatgccttacatctgaacaggcgctattattcaagattgcgataacataaagttttgattaaaatgcacgccaacttttatatttaggaacagacaatggcagattggaacggtgaatatatcagcccttatgctgaacacggtaaaaaaagtgaacaagtaaagaaaattacggtatctattccgattaaagtattggaaattttgactaacgaacgcactcgccgtcaaattcgtaatttacgccacgccacaaacagtgaattgctttgtgaagcgtttttacacgcctttacaggtcagccattgccaaccgacgatgatttaatgaaagaacgtagcaatgaaattcctgaggaagcaaaactgaaaatgcgagagctaggaatagatccagataagtggcaatattaaatgatttcaaacctctcaactgcgaggttttattttagctaaaaaataggaggactatgaaggtgtctaaacaaatagatcgtgaagtgcgttgggcattatatctgacgctattttatgttatgggttgggtcggttttgcttatttttcacctgcagggcgaggttttttaggctttcccctctggtttgaattaagttgtgtctatcttccaatcgtattaacgttattgatcagcgcagtagtaaaatggatttatcaagatattgatttagggggaaaagatgaatcttgagttgttgttacctttaatcgcctatctcattttcgtatttggcgtagcctattatgcctatcgccaacgtacaagcggtagctttttatcagaatattacgtcggtggacgctcaatgtctggttttgttttggcaatgacgacagcagccacttatgttggggcaagtagctttattggcgggccaggtgcggcatacaaatatggcttgggctgggtattattggcaatgattcaagtgccagccgtttttctctcattagggattgttggcaaacgaattgccattttggctctccaaaccaaaagtttaacgatcaacgatttactactagcacgttatcaacatcgctttgtggtgtggattgctagctttgctctattgctctctttctttgcaatgatgaccgtacagtttatcggtgctggacgtttgcttgaaactacgcttggcatttcctatggcactgcgatcattatttttgcggtcactgttggtatttatacctttatcgggggctttcgtgccgtcgttttgaccgatacgattcaaggcttagtgatggttgtaggcacattgttactacttggcggtgtaatctatgcaacggggggcgttgaggctgcaattacccagttagaaaatatcaaccctcaactgaccgctccttatggtattgatgaacgcccactggacttcacctttatgacatctttctgggtattagtctgctttgggttaattggattgccacattttgcggtgcggagtatggcatataaagatagcaaggctttacatcgagctttgattattggcactgtcgttgtcgctgtactgatgttcggtatgcatttagcaggtgcgttgggacgagcggtgattcccgatctaaaagttgccgatcaagttatcccaaccttgatgttacaagtacttccgcctgttgttgcaggcattttcttagctgcaccaatggcagccattatgtcctcaatcgactcaatgcttattcaatcttcttcaaccctgattaaagatctctatctcgcaattaagccacaagcggttgaaaatgaagaaaaaattaaacgtttctcgacaatcactaccctagtgatcagcgttttattggtgatcgcagccattaacccacctgaaatgctcatttggttaaacttactctctctgggagggttagaagcgacattcttatgggtaattgtattgggactattctggaaaaaagcgaatgcaacaggggctatttgttcaatgattgcaggtttatcaagttatgtgttaatgacaagcctatctatcaaaatatttagctttcacgccatcgtgccagcattggtaattggacttattgcttttttagtgggaaatcggtgtgtaacattaaaaaaggactagaaattattagctaacaatactttttaaagagaaatgccttttcatatagcttaaagtcttataataaagactttaagctatttttattctatgagccatttttataagtaacgcttagacagataaaggtattgagattaaaccagaaatgtctgatatgtatcttcaaataaggataaaaggacacagcactattaaatatagcactcagcccttctattaaaaagtctagcttttagtgtagatcaaattgaagttctactagagtaaaacattcgctaatactaagccaaacactaaacagaatgccatgcttaataagcctgggatcataaagctgtggttgaaaatgaatttaccaattttggttgttccagtcgtgtcaaagtcaatagacgcaatgattggaccgtagttaggaacaaagaaataaccgtttactgcaacgaataccccgattaagattggtgctgggatacctaacgctacacctaaagggaatagagttgctactgttgcaccttggctgtttactaatacagaaagtacgaacaatgcgaacgcaaatgcccatggtgcagtttccactaagcctttcaccatatctttaacttcggtcatatgagcgtccattaaagtatcgcccatccaagcaataccgaagattgcaataaccgcacgcatacctgcgtggaatacagaaccttgtgtaatcgcattaccatttggtttgcagataagcataattaatgcagccacagtcagcatcacgatttcgatagtatgagccattcccattgctttgccgtcgaatactgggcgtaactctttgaatgaacccataaacacaacaagtaatgcaccaaataagaataaacttacagaggttttagccgttgggctaatttggatctctgctgggtttgtatctacgtgatttcttgccacatactcaggatcttgtaataaacgttgataattagggtcgtcttttaactctttacccattttatttacgaataaacacgcacagaaaagacctaaaatcgtgcctggaatagttactaataaaatgtcaccaatgctataaccttgtggttcgatcattgcagcaacagacactaccgctgcagcaatcgggcttgctacaatagcaaattgtgaggcaataacagccattgaaagtggacgttcaggacggataccgttatggcgactaacttctgcaatcacaggcaatacagagtaagcaacgtgacctgtaccagctaagaaagtaaatgtccaagttaccgctggtgcgatgaaagtgatgtgttttggattacgacgtaaaatgtttgttgcgattttgatcatatagtctaaaccgccagccgcttgcattgcagccgctgcagaaacgacagccataatcataaacataacgtcgattggaagacctgcaggttttaagccaaatccaaaagagaggattgccaaacctaaaccgcccattacccctaaaccgataccgccaaggcgagcaccgattaaaatacagagtaatacaacggcaaattcaataagaaacatagcagacataatttgctccattgtaatttaacgaaaaagccctcatactgaggaagaattggcgattgttcgccctttatacaaaaggcgtgcaatatagcataaaaatttataatcgttataatctagatcaataaaaatttctaatcataggaaaaattatgcaattttcaaaaatgcacggacttggcaatgactttatggtgattgatggagtaacgcagaatgtctatttaacggaagaactcattcgtaaatgggcagatcgccatcgtggtgtaggttttgatcagctactactggtcgaaccaccctatgatccggaactggatttccactaccgtatttttaatgctgatggcagtgaagtctctcagtgtggaaatggagcaagatgtttcgctcgttttgttaccttaaaaggcttaaccaacaagcaggatattggtgtaagtaccgcaaaagggaagatggttttaagcttacaagacgatggtcaagttcgcgtaaatatgggggaaccaatttgggaacctgcacaaattccttttaccgcaaataagtttgaaaaaaattatattttacgcacggatattcaaacggtgttatgtggtgtggtttcaatgggcaatccgcactgtgtgttacaggtggaaaatattcaaaccgccaatgtcaatgaattgggggctttacttgaacgccacgaacgtttcccagagcgtgccaatatcggttttatgcaagtcatcaatcgaaatcatatcaaactaagagtgtttgagcgtggtgcaggcgaaacacaagcctgtggtagcggtgcttgtggggctgttgcggttgggattatgcaaggcttattggatagccgtgttcaagtagatcttccgggtggaaccttgcatatcgaatggcaaggtgtaggttcaccgctttatatgacaggtgatgcagaacatatttatgatggggctgtgaagtcataagttatagaatatgagatatattggaataaacggagtagtttaagatccaaatatatattctggtactacaggcataaactacactatcgttatgcttttatgaactatagtcccaatcttcttgagattatctagcttggttttagtttactatttcagaataaagataattacttttggatgaataacccgcaatattctattcatcctattggagtattactggaatactttgtaggaacttaaaaaatattgattgtatctgagcaagggctttttcatgataaattatgatcttgttcaaattttaagtaaattttctacaaatgaagcaaatctttctttataatgatcgtcaatgaagttttatttcaaatttgactttttctaggaggatttatgcgtttagtgcctttggattgtgctgaacaagtgagccgttgggctgctcgttatattgtagataaaatcaatgctttccaaccaacagcagagaaaccttttgtgcttggtttgccaacagggggaacgccacttcaaacctataaagaattaattaagctgtatcaagcaggtgaagtgagtttcaaacacgttgtcacctttaatatggacgagtacgttggcttaccgccagagcacaaagagagttaccactattttatgttccataacttctttaaccatattgatattccagtagaaaatgtgaatatcctaaatggaatggcggaagatgtagatgctgaatgtgaacgttatgaagcaaaaattcgctcttatggcaaaattcatctctttatggggggggtgggtgttgatgggcatattgcctttaatgaacctgcttcatcgttaagttctcgcactcgcatcaagactttgaccgaagatacgttgattgcgaactctcgtttctttgataatgatgtcaataaagtaccaaaatttgctttaacagtgggggttggtactttgatggacgcagaggaagtattaattttagtcacgggttataataaagcccttgccttgcaagcctgtgttgagggggcggtaaatcatttgtggacgatcagtgcgttacaattacatcgtcgtgcagtcgtggtttgtgatgaacctgcaacacaagaattgaaagttaaaaccgttaagtatttcaagcaattagagcaaaatatagctcgctaggaggaaaagatggggcgttatgcactaacaaattgtgtgatttatacgggaagtgatgtgctatatcagcatgctgtgatcgtcaatggtgagcagattgaggctgtggttcatcaaagtcaagttgcagatggggttcatcagattgatttagagggcgcaaatctttctgctggttttattgatctgcagttaaacggttgtggcggtgtaacatttaatgaagatattagtgttaaaacccttgaaattatgcaagaaaccaatctgaaatcaggtacaacaagttatttgccaacctttattacttcgcctgacgaaggaatgaaacaagcagtgcaagtaatgcgtgactatttggctaaatataaaaaccaagcactcggtttgcatttggaaggaccttatttaagtgtggcgaaaaagggggtacatcgtcctgaatatatccgtgaaataagcggtgagatgttggattttctttgcaaaaacggcgatgtcattacgaaattaacactcgcagcagacaacccaacggcagatcatattcagaaatttgttgaagctgggattattgtgtctatcggacactcaaatgcgacctttgctgaagcaaaacgacgtattgagcaaggcattggctttgctacccatttgcataatgctatgtcgccgatcagctctgggcgtgatggtggagtagttggtgcagtgttggatagcgatatttacgctggtatcattgtcgatggtttgcacgttgattggagtaatgtgcgtattgcgaagaaagtgaaaggcgataaattggtgattgtaaccgatgcggttgccccagctggtacaactgatatggaatattttatctttgtaggtaagaaagtttggtacaaagacggtaaatgtgtcgatgagtttggcagtcttggcggtgcggcgattacaatgatcgagtcgatccgtaatatgatgcaacatactgatcttccgttagatgaagtgatccgtatgtgtacattatatccagctcgtgctattcatgttgaagataagttaggatccattgaagctggcaaaattgccaatttaactgcgtttaatcatcagtttgaggtattaggtacagcggtgaatggaaattggaagtggactcagctctaatgtgttgagtgagcttaaaaagatcgtttaaagatccttctctaaacgatcttttttgtttgtttttgaagaatttcaaatttttctcaatttctcgcttgctctcatttgagtttttgcgtagaattgtccacctattttatatgaatttgagagtgtcaaacgcatagcgataggcacatattagcggagtaaatatgtacgcagttttccaaagtggcggcaaacaacaccgagtaagcgaaggtcaagttgttcgtttagaaaaacttgaagtagcgacaggtgaaaaagttgagttcgactcagtgttaatggtcgttaatggtgaagatgttaaaatcggtaccccagttgttgctggcggtaaagtagtggcagaagtggttgcacacggtcgtggcgaaaaagttcgcatcgttaaattccgtcgtcgtaaacacagccgtaaacaacaaggtcatcgtcagtggttcacagaagtgaaaatcactgggattcaagcataatttcagaggagatcaagtagatggcaactaaaaaagctggtggttcaactcgtaacggtcgtgactctgaagctaaacgccttggtgttaaacgtttcggtggcgaatctgtattagcaggtagcatcatcgttcgtcaacgtggtacaaaattccacgcaggtagcaatgtaggtatgggtaaagaccacactttattcgcaactgctgacggtaaagtaaaatttgaagttaaaggcgagaaaaatcgcaaatatgtaagcatcattgctgaataatcttcaaaagaataagattaaaatgccccgctaatcaattagcggggttttttattaccattgaaacaaaaaatttatgtcaaaatcacaacctttacttggctttctctttgccttaactgctgtaatgatgtggggtatgttgccgatagccttgcaacaagttttgaaatttatggacgctcaaacgatcgtctggtttcgatttgtgactgcaatggctgggttgtttttgattttattctttgcaaaaaaaattgccgaaagtgaccgctttcactcgccgtcattattatctgctattgcttggggtatttggtttatcctgcaatttttatttatttaatttagcgttaaatcatattccacctgcagccagccaagtgattagccctttttcatctttgattatggcgtttatcggtgtctatttgtttaaagagagcttcggtttacatcagaaaatcggctttgttatcgtgctgattggcttgggattatttttcaatgatcgttttgacgatcttgctcagatgaatgaatacgcttggggaatgatctgtgctgttagtgccagcctgatttggatctgttacagcattgcccaaaagatgatgttagatcggtttagttcacagcaaattttactgtttatttattgtggttgtagccttgttttcacgcccttggcggctctttcacaagtcaataatctcagtggttttgcggtagcttgcttgatcttttgctgtttaaacacggtaattgcttatggcagttatgccgaagcgttaaatcgttgggaagtgactaaagtgagcgtaatgatgccacttattcctatctgtacgattttattttcacagttggcattttatttaagccctgaacattttgcggaacctgattttaatcacctaacgcatttaggggcggttgtcgtggtatgtggagcaatgctctctgccgctggacataaacttttttatcgacataaacggatttaatatgaaaccacaacgtccattacttggattttcattagccttgcttactgcaatgatgtggggttctgtgccgattgcagcacaaaaagtgttgagtgttgtgaatgctcaaacgctcgtatgggctcgttttattgtggcagcaatcggtttgttactcattttaggctttacaaaaaaattgccaaaactgaccgctttcactccacgttttctttggttaattgggttaggcgtggtaggcttatcgctgaactttttcttgtttagctatagtttaaactttatttcaccgacaactagccaagtattgtggcaattggcgccgtttacgatgattttatgtggtgtggtgatttttaaagaacaatttgggcgacatcagcaaatcggcttgctattgctcattattggtttaatcgccttttttaatgagcgttttgaggaaattttccagttaggcacttatgcttttgggttgcttgtcggtgcaggagcagcaattgtttgggtggtttatgcgatagcccaaaaaataatgttggcaaaatttagctcacagcagattttgctgattatttatacgggctgtgcattgctactcacaccatttgccagccagataaacatagatgaatttgatccgtttttattgggttgtttcattttctgttgtttaaataccttgattggctatggggcatatgccgaagcattaaatcactgggacgcatcaaaagtaagtgtagtcacgattttagtcccgatttttacgatggttttttcaagcattggacattgggcatttcccgatacctttgcaagccctgatatgaatttattgagttatatcggcgcatttattgtggtgtctggcacgattttatcggcggtcggacataaattagttaaaagaaaataagcatttccctagtttgtatgggaaataggagaagatatgaaatttattgacgaagccctgatccgagtggaagcaggcgatggcggtaacggctgtgtcagcttccgccgtgagaaatttattccaaaaggtggtcctgatggcggtgatggtggtgatggtggtgatgtctatttaattgccgatgagaacctaaacacgcttatcgactaccgttttgaaaaacgctttgccgcaggtcgtggcgagaatggtcgcagtgcgggttgtacaggacatcgtggtagcgacatcaccttgcgtgtccccgttggcacccgtgcgattgacaatgatacccaagaagtgattggcgatttaaccaaacacggtatgaaaatgttggtggcaaaaggtggctatcacggtttggggaatactcgctttaagtcatcggtcaatcgtgcgccacgtcagaaaaccaacggcacaccaggggaaaaacgtgatttacagttagaattgatgttacttgcagatgtgggaatgttaggtttaccgaacgcaggaaaatccacctttattcgtgcagtatcagcagcaaaaccgaaagtcgcagattacccattcacaacccttgtgccaagtttaggagtagcacgagttggtgcggatcgtagctttgtggtggcagatattccaggattgattgaaggtgcggcggaaggtgcaggcttggggatccgcttcttaaaacacttagagcgttgccgagtactcattcaccttgtcgatattatgccgattgatgagagcgatcctgcacaaaatatctctattattgagtcggaactctatcaatatagcgaaaaattagcggataaaccgcaatggctggtgtttaacaaaatcgacaccattggcgaagaagaggcaagagaaagagccgaagcgattgtagaagagatcggttgggaaggtgattactacttgatttctgccgcaacagggcaaaatgtatccgctttaacccgtgatattatggactttatcgaagcgaatccgcgtgttgaagaagaggaaaaagcgaaggaagaagttgcattcaagtgggacgactatcatcaacaagcaatgcaacacccgattaccgaagatgattgggacgacttagatgatgacggttggacagaagaagatgatgaaggggtagagtttatttataaaccctaactttaattgctggaatattttaaattaagggatgggataccatcccattgcccttaattcataattgttagataatgtaggtggttacaagttttgatttaggacaaataatgagtgatatcttagtgcctcttatttttacagatgctgctgcaaaaaaagttaaattcttgattgaaggcgaggaaaacccagagctccgtctacgtgtttatattacaggtggcggctgtagtgggtttcagtatgggtttacttttgatgataaacttaatgagggcgatttaaccattgaaaatttagatgtagctttagttatcgatccaatgagtctccaatatctaattggagctactatagactatgttgaagggttggaaggctcacgttttgttgtgcaaaatccaaatgcaagttctacttgtggatgtggggcctcatttagcatttgagtattattccttccaattattaattcccttaactaaagtggcagtgtcttaacagtagcgtcatctagttagcaaaaaatataaccctttcccacagataattcggtattcacaaagttgtgtggataacaattaacggcatagtagacaaaagtattggttttaattattttccctaattattaccaactctttttatttaaaaatcctttataaacataatcttatgctttttcgttaatccgctatgaaccgataatttctgtttcagttctttaaataacccttccaacctatttgttgttttttctatatttaaatgagtatattcttcaaaagtgagcttaaagccttgtactataaggctttagcccactttttaccaacacttttgtctactatgcaaaatatcctatctaaatcaccgctttcattagatttccgcctattatttctagcttttattgataaaagttgaaaaattcttgttattttattcttagttttgtgtaactcttgtttttttttttttactaatagcgtgcggggacatttgtgcatcctgaaaacgtaaataaaggtttacgatgttttattaggaaaaacagcttgtagggtgggtcttgacccaccatgtagccgtaacatattgattttattggtgggttaaaacccaccctacaatattcaatccatctaatatatggtttgtcaaggagttaacttcccccgcttgcgggggaagtgcccgagcgaaagcgagggcgatgggggcatttgtgcatcctgaaaatgtaaataaaggtttatgattttttattaggaaaaacagtagagaaggttattatgaataaaatatttagagttatttggagtcatgctcaacaggcttgggtggttgtgtctgagttagtaaagtctcatactaaaacatccacttgtacggataaaagagctcaagtatgcacctcagattattttttagataaacagcaagataaatttaaattaagtcttttaagtctagtattactaggtatattttttagtccatcagctgctgctaacgcaacaaataacgcaaaaccatatcttcaagatgaggctgagagatcgagtttaggatatgacgacggtactattggtattggtaaaaagagtaaggctgggtatggtgctattgctatcggtcagtattcaaaagctaaagctaggcataatgttgcgataggttatgaagcagattcaggaacagacgcaaactctattacgataggctacaatactaaagtaagtgggatggaaggaattgccatcgggaaagagtcaaaagcgggagagaaatctgttgtcttaggcggacaagccaaggggacaagtactcaaacagttgcaataggtaacttggctactgcaagtgcgtcacaatctattgctatcggtgcgagaagtaagtctaccgctgagtacggtattgcggttggtggtggtgcaactgctggaaaaaacgccgttgctgttggtagggactcgaaaggtgctggggaagattccattgcgataggtaattctgcgaaaacaacaggggcagactctgttgttgtgggtgccaatatcaatgtgacagatggacaattagtggcaattggataccaagcaagtgctaaaagtcattctactgccttgggttataaagcctctgccggtggtatgcactctgttgctgtgggtgataatgccgtgacaaatgatggtgctgctagagcaaccgcacttggtaataataccgttgtcaccgtgggcggcggtgtggcattaggttatggatctaatgcaagtacagctggcggtgtagaggggttaaaacaaaatcattctgtcacaacgggaacaagcactgaagctaacggctttaaatccacagaaaaggttgatggtaataataaaattggtgcggtttctgtgggtaataacctaatcaaacgccaaatcgtcaatgtggcggcaggtacacaagataccgatgcagtaaacgtggcacagcttaaatcgctcaccatgcaaacaggaggcgataacaacagcagtggcaaggtaggcatttggaatggtacgcttaaagtagtgggtacaagcggtgagattaagacttccgcaagcaatgataccatcacattgaaattagatgaaacattgaaaaataaaattgataagattgacaatttaggttggaaacttgcaattactcagggatcggggggtcaagctactcctttgaatagtccacatcttatcaaaatggaccagaccgtaacctttaccgctggaaataatattaaattagaacaagtgggcggaaatattacgatttctacgattattggtaagttaattacaaagactgaaagcctagcagatggtggtttgaaaattacttatacagataattcgcatgacattatcaagaaaggtgaaaaaggagatcgtggcgaaaaaggtccaaaaggcgatagaggagaaactggccctgcgggtccagcggggcctaggggtgaaccgggtccagtggggccagctggaccacaaggtacacctggtccagcaggaccacgaggaccgcagggaacagcgggtgctcagggacctaagggggataaaggcgaaccaggagaagcgggtccagcaggaccacgaggccctgcgggtcctaaaggagatgcaggtccaaaaggtgatacaggtcagagaggtgaaactggctctgcgggtccagcgggaccaaagggtgaaccgggtcctaaaggtgaacaaggtattccaggccctgcgggtccagcgggaccacaaggtcctgcgggtccagcaggaccacaaggccctgcgggtccaacgggatcacaagaccctgcgggtccaactggaaattcggaattaaaaggcattacgtcgattgccaatggtaacgacgccaccaaggcgaatggggctaagattaccttgtctgcaggttctacagataaaacagttaatgttaatgatgcgaaaattaccaatgtggcggctggtacagcagatactgatgcggtaaatgtgagccagttaaatactaaggcagcagccgcaagaactgaagttgaagcgggtaaaaatgtgaaagtgacttcaaaaacgggggcaaatggtcagaatatttacaatgtgagcgtgtctggagatttaagcgacattacttcaattagtaatggcgatacgaaagtatctttaggtaaagataagcaaggaaatccagttgtaaatatgaatggcgccagaattaccaacgttggagatggtagtgctgagggcgatattgtgaatgttcgtcagctcaacaaagtggtttcttctgtgaatacaggatttaatcaattatcaagagatattggtcgtgttgatgttaatgcaagagcgggtattgcttctgctggggcgatggctaatttgccacaaatttctttaccaggtaaaagtgctatttctgtttctaatgcacaatatcgcgggcaatctgcctatgctataggttattccagaatttctgataatggcaaatggcttattcgagcgtctgttagcagtaatactcagcgggatactatgattggaggaggggtaggttttgtgtggtaatctagcgcctataaattagaatttcatgctcaatgccattgttattttaacaatggcattgtttggcatagtagacaaaagtgttggtttttctgcaaactatgcctctaatggtcaaaagtgttggttttgaccctatcccaaattctgtgtaaatacccatttcaacttaacggtgatcgtctaggcgatcaccaaaatcaatcataaatcgattcatcgccagtttccagttctgaatcggcattgtccatttttttgatgcatctttaatcgcaagccaaatcactttgaaaacggaatcatccgtcgggaatacatttcgttttttaatcacacgacgaatcacgctattaagcgattccacagcattcgtggtataaatcgctttacgaatatcagccggataatcaaaaaatgtggcaatatttgcccagttatcttcccagcctttcgccacaagcgggtattttgcctgccatttttgcgaaagtgcggtcagattttcgcgagcctgtgcttccgtcgaggcctgataaacctgctttaaatctgcggtgacggctttgtaatctttccacgaaacgaatttcaagctgttacgcactaaatgcacaatgcaaagctgaatcttcgttttaggatagactgcattgatggcttctgggaagccttttaaaccgtctacacaggcaataaaaatgtcttttaagcctcgattttgaagctctgtcagcacatttgcccagaacttcgcaccttcattttcagcaatccaatcacggtcacgaggcgtctcaatttctatctcaccttcatcacaaatgacggtcttagatgtgtaaccgttacgtgcatttttaccttttctaggctgatgtttttcataaccaagatggtcggtcagttcaccatttaacgcagcctcgacggtgattttcttgagcatccgtgaaaattgattgaggtcttctggtgtttttaggtttttggcaaattccgctgccaaggcgtgaagttgtttttcgttcataataaaatacctgtgtctgaatgtattatctcagaaacaggtatttacacaaattgtgggagaggctctctatccgctttttttgttcacagattttatccctcagcccccatccccttcgctaacgctcagggacttcccccataaatgggggaagaattttgatctgcccccaaaaagttagactgtatttagttcaaggactgaattctgtattccacagggcttagtccttttaattttacttgaatacgctcatgattgtaataatgaatatattcgtgaatagcttgttccagttgctcaaaggtctcaaaccgtttaccaaagtaacattccgtttttaaacgcccaaagaaactttccattgcactgttatccaaacaatttccctttctcgacatactttgtacgatgccgctttgcttcaatatcgactgataacttgccattttattgtctttttcagcaagatgataaaagaacgtactccgttttaaatcaaccaattgcaataaaatctcaaacggaaattggtggcgtagttccttcacgaggtgtgattatactgattaatccaatatcttaatatggtttccttaacctgaaaatactgacgagttaatgaccgatttttattatgttgaagataaaattcgatcacttgttgtttaaaagattgggtgtatttagccataaaaaatctgcaccttaattagttggttgtttagtccaacttttggggtgcagatcacatcgacccgcccctaccattatctttgcttataatgcatctcttcactcaccgcccttaatttttcagcggcttgctctggggttaaatcccgttgtgcttcagctaacatttcatagccgaccataaatttccgtaccgttgccgagcggagtagcggcggatagaaataggcgtgaagttgccaatgttcaatatcttgcccatctttaaagaacggagcaaaatgccagcccattgaataagggaaagcacattcaaataagttatcataacgacaagtaagctttttaatcgcaagggctaagtcatctttttctgcttcgctcaattcgctcattcgtttgatatggcgttttggcatcaaaatggtttcataaggccacgccgcccaatatggcacaacagcaagccaatgttctgtttctgtaacagttcgtgtgccatcttttagctctgcttgagcataatctaccaataaatttgagccgtgttgttcatagtaacgacgcaaatttttatccttggttgcaatttcattcggtaaaaacgagttcgcccaaatttgcccgtgtgggtgtggctgtgagcaacccatcatcgcccctttattttcaaaggcttgaacccacaagtaatctttacctagctcttctaattgagcattccaagtatcgaccacaccacgaattttttccacaggcaattcggggagcgttttactgtgatcaggtgaaaaacaaatcaccctagctaaaccacgtaccccttgaattttgaacaacggattgtcagatggcggagcatctggcgtatcttgcatcaaagcggcaaaatcgttggcaaatacataagtgccttgataatcagggtttacatcgcctgaaacacgggtattggtcggacagagaaaacacttttcatcataactcggtagctgttcaaccgccgctttatccacttgaccgctccacggacgtttcgctcgatgtggagaaactaaaatccactcgtctttcaatggattataacggcggtgcggatgatcatttaactcaaatttctggctcatttggagtatcctttcaaaaagttaaaataatgtggagtatagcgtaaataatacaaagaagatatgaactagatcacaaaatgggatcatccactcattcttgaaaagaaaaaagctaaacccatacgggtttagctctactactcaaataaggtctgcttagcaattacatcattccgcccatgccacccataccgcccattccggcacctaggtcagctttttcttctttcggcagatctgtcaccatacattcagtcgtaatcattaaacctgcgatagaggctgcaaattgtaatgcagaacgggttactttagttgggtctaagatacccatttctaacatatcgccgtattgttcagttgcagcgttatagccgtagttaccattgccatcttttacgttacgagcaacaacagacgcttcttcacctgcgtttgtcacgatctggcgaagtggtgcttccattgcacgaagtgctaaacggatacctacgttttgttcttcgttatcgcctttcactacatcagccactttgcttgccgcacgcactaatgccacgccaccgcctgcgatgataccttcttccacagctgcacgggttgcgtgaagcgcatcatctacacggtcttttttctctttcatttcaacttcagttgccgcaccgactttgattactgcaacaccgccagccaatttagccacacgctcttgtagtttctctttgtcgtagtctgaggttgagtcttcgatttgttggcggatctgtgcaacacgagctttgatttgtacttcatcgccaacgccgtcaatgatggtggtattgtcttttgaaatcaccacacgttttgcttggccaagctcttcgatagtcgctttttcaagttccataccgatctcttcagagattaccgtacctgcggttaaaatcgcaatgtcttgtaacatcgctttacggcgatcaccaaagcctggcgctttaaccgcagccactttcacgataccacgcattgtgttcacaactaaggttgctaacgcttcgccttcgatatcttctgcgataatcaataacggtttgcccgcttttgctactgcttctaatacaggcagaatttcacggatatttgaaattttcttatccactaaaagaatgtatgggttttctaattctaccgtgcctgcttctggtttattgatgaagtatggcgataagtagccacggtcgaattgcataccttcaaccacatctaacgcatcttctaaacctgtaccatcttcaacggtaattacgccttctttgccgactttttccattgcttgagcaattaatttacccacagtgctgtctgagttcgcagaaatcgtaccgacttgttcaatctcttttgacatttcacacggtttagagagcgattttaactcttcaacaactgcagctaccgctttgtcgataccacgttttaaatccatcgggttcataccagctgcaaccgcttttaaaccttcatttacgatagcttgagcaagtacagttgcagtagttgtaccgtcacctgctgcatcatttgctttagatgccacttctttaaccatttgcgcacccatattctcgaatttatcttctaattcgatttcacgagcaacagatacaccgtctttagtgatcgttggtgcgccaaaggctttgtctaataccacgttacgacctttcgggcctaaagttacttttactgcgtctgctaatacatttacgccctttaacatttttacacgagcgtcattaccaaattttacgtcttttgctgccattttttattccttgtagggacacactgcgtgtgtccgtgattaatttgtaaaaatattgaatgatttaaccgcttgttgtagttggacacacgcagtgtgtccctacacagttattcaacaattgccaaaatattgtcttcagaaagaattaatacggtttcaccgtcaattttttcttctttcacaccatattcattgaaaatcaccacatcaccgactttcacatttaatggtaacacagtgccattatctaaagtacgaccattgccaacggcaataacagtaccacgagtagatttagttgccgcagaaccagttaaaacgataccgcctgcagatttagtttcgatttcttcacgctttaaaattactttgtcgtgtaacggacgaattttcattgaataactcctcattattgtaattagaaataactatagtaatagaaagtaattattagatctctatctggaaatttcaagggggaagagaaaaattttgttaatatagtctaggagatattgattgacgtactctccgctataaaaggcgagaattcctactagctcctattgttctcaataggctacttcgtattgctcattttaccaagtcaacgcccgattaaacacaaaacgagcagaaccgcagaactgtttaattctgcggatttgatgcctgccgcggtaatgcgcccatttcgattattcgccaatacatcaagcaacaacaaacacctgcttagttaggtttgaaacggctcacaccgtttgtgccttatatctccatccttcaggacggagtttgacggcacagtcccgataaattaataatagctctaagcccttttccacccttcacattgtatacattatccatcgaaatatagtaaccatgcaactctgcaatacgtcttacaatcgacaagcctaaaccgctccctttttcattctgcccagcaggacggtaaaaacgctgccccagtttagcaagatctgcctcatcaacaccaccaccattatcttccacgataatacattgtggctctaatgtaatacgaatggtcgtgccttgagggcaatatttcattgcattatctaccagatttcgtaacatcaaggaaagaagtaacggctgaccttgtttaaccgcaggtacgcctttttgttcaaactcaatttccatctctcgtttctgtgcttggaaataaagctcccccaccaatgatggaattaatttatcccaatgaatatcttctacaccttccaattccgttaaattatctaaacgggataacgtaagcagttgctcgattaattgagttgcacgattaattccttgagtaagattatgcaaggctttctcgcgtaaagcggtatcatctccagctaattgtgcaatttccgtttgaattttcaatgcagctaacggactgcgtaactcgtgagcagcatcagaagtaaagcgacgctctctaagcaacattgttgaagtccgatcaaaaaactgatttaaactgctgactagcggtaaaatctctttcggaacatcagtcgaaagcggactattatcatcaggcgttcgctgttgaacttgctcccccacacgttgcaatgtcaatagttcacgcttaatcacccacacaatcaagcccaataataacggcaaactggcgaaccaaatccacatttggctaaacaccattccttgaaccagatcatctcgataatcttgctcttgaccgaccgccacaaaaaaacgatcaccaatcggtaaccaaaaaattcgccactcatcgtcatcttcgtgattaagtcgggatttggtaaaaccactggctcttttaaatggaaagtttgcaccattatgcccgtcgctcaatatcctttccccttgggcattaaagatagcaaatgccagagcatcatcatcgaaagcgatctttttaaaagattttttatggtgttcgccgttgaaagtccgttgtggcttacgttccatcaataatgtgcgtaaatctgaagaggccaaacgttgagcaaacagcacctgttgagcatcaaacacttcatcaacttcgtgacgaacttgcacccacgccactgcagtggatacaagccaaataagcaacgccgtgcaagaaatcacgatcatcaagcgaaaacgcaaactggtatttttaagcaacttcatcgttttttcctaaggcgtagccgacaccgtgtacggtacgaataaactgttttccgagtttctgacgtaaattgtagatatggacttcaagagcgttgctactgacctcatcgtcccaagtatagagtttctcctcaatgaaagaacgggtgagaacacgatctttattgtgcataaataactcaagcaaattgtactctcgagtggttagcgtgacttcttgctcccgaagaaacactttgcgttgatttggatcgaacttcactaaactatgttcaatcacagggttggtatgcccataacgacgacggatcaacgcttgtaaacgagctacaacctctgcgagagcaaaaggtttacagagataatcatctgcaccacgttgtagccccatgatacgttcatcaagggtatctcttgcagtcaaaataagcacaggcacatcttgattagcccgtcgccaactttgtaacacctcaagtccgtccatttttggcagggtgagatcgagaactacggcatcataaggtgcggaacttaacgcatctaagccagttttaccgtccgtgaaccagtccacactaaagccggatttactcaacccaagttttagcccttctccgatcaacggatcgtcttcaattaataaaatacgcatctcaacctccaaattctaaaagagaaaagtggcatttactaccactttcctattatcgcattaatttaccttttcaacacgatgaacatcaacttctgtaccgactagtgatttatcaatttcaccataaagtctgatttcatcatttggggtaacatttagccctctccaagcatcatcgtcaatatccaccgtgatctcaccgcttgcgtcacggaatgtgaaattgtctttatccaactgcttaaccaacttgccttgtaatacgacatattgatcatcgctcattgaagatacttggctggcttgagtaaccgcttgctgactattagtaaaaccaccattttgataataacctttgtccgcaaatgctgaaaggctaacggttgataaaagtaatgctgaaagtaaagtaagttttttcataaattgctcctagtgtttattagtaaaagcattattgctttgttgagtgtattaaaacagagaaatcttaagaaagtcttaagataaaaaaatttatttttagacaaaatctaataaaaaagcggcaagattcgtaaatcctaccgcttagatcacattatgaaaaaattagaatctatagtttgccccaataatgtactgacgaccagggtttatatgtgaatgcaaacgttggctatgactttgatatcgtttatttccaatattattaatagcaaagtcgagacttaaatcatctttgagtaatctcagattagcataaatatcgtgtactccgtagccagctttacgaattctttcatcgccacttctagtcgtaatcacaaaggttttagcttctgcataacgccctctatatcctatctctagatttggattctcaaatgtataggaaagagttgttttccattggcgacctttaggtacaatatccaaaacaccctccgaaagtttaaagccttcaggggtagctcttgaataacttgctccaacaccaacttttagccctgcaatttcataagatgcttcggcatcatatcctttagttctaagattgccaagatttgttatagtaggagcagtaactccggagtaataattcgttactttttcatcaaaaaggcttgctacaagtctagctcctgaatgtttccattcaaaaccgacttctgctagacgtgattgttcaggttttagattactatcaacatctctccttccacgaacttgtgctaaatttgcacggttatctgttatagtattagttgtggctaatgctggggaacggctggcataattcaattttgtcttcaatgccaagtttgaggtgatattccaaattacattcaagataggattaactttcccctcagaagcatgaattttagtactatttgtttgcctaatgtatttaagctgaaatggtcgtagcgaacgtctgttgttaaagtaactttctgaattgcccaaatagcgacattaaaactcctattaggtaaaaaccaagtaaaacactcagaaataattataaataagaattattatcatttcaaataaaatttaatagaataccgagaaaataatagaaataaaaaacccagctttcgctgggttcttaatataagtaagcaaattatttgatttttgcttctttataaacaacgtgtttacgcacaactggatcaaattttttgatttccattttttctggcatattacgtttgttttttgttgttgtgtagaagtgaccagtttcagcagtagaaactaatttgatcttctcgcgattacctttagctgccatttgttagctccttagattttttcgccacgagcacggatttcagctaatactgcatcgatgccttttttatcaataatacgcatacctttcgctgttaagcgtaaagttacgaaacggttttcgctctcaacccagaaacggtgagtgtgaaggtttggaagaaaacgacgtttagtcgcattcattgcgtgtgagcggttgttaccaactactggacgcttgcctgttacttgacagactctagacattttcaattctccgatattacttaagcttaagctaaatggttcgggcgatcagaaaggctcaactcaatctgacgacctcgtcaggtacatacacccgacccacagactattttaaagactgcgaattatacttgctttagttcatctaaacaagggggaaattcgtaattttcctgttcaaacttttcttcttcgaacgaaaaatagtcacctttgccaacaataatatgatcaacaaagcgaatatcgactaaatcacacgccatttctatttttcgagtcaaaaaccgatctgcctcacttggattgcagttgccagatgggtggttatgtgcaactaaaatggcggcggcattacacttcaaggcttctttaatgatttcacgagggtgaactgaggcttggttgatcgtaccgtaaaacattttttctgttttgatcaacctattttggttatctaaaaagatcaccataaatacttctcgctcccaagattccaattccgattgaaaatacattacggctaaataggggctatctaccatttcatttactttcatttgttgcgataaatagcgtttcgtcatctctttggttgcctgaagttgaatatactgaatttgtcctaatcctttgattttacagaaatcttctaatgttgctgacagcaatccccgtaatgaaccaaaggcagtgagtacgctttccgatagatccatcacgggtatccctttaattcctgtacgtaaaaagattgccaatagctcagcatcacttaaggcttcagcaccaaatttcagcaatttttctcttggcattaattcactagaactttcattcatattttttgttcaattagttaaaaagtgcaaacagcataaaaatcttctcaccttgattcaaaaggctttttctcttttttcgacaaagatcgcaaaaatagggcgttgtgagtgagtacctatttgcgtaaaatagcaagtagaaaacccatcataaagatgattcgttatgttaaaagataaaaaaatccttatcggtattactggtggcattgcggcatacaaaaccattgagctaattcgtttattaaaaacggcaggagcagaagtgcgagtggcaatgacccctgcggcagaagcctttgtcacaccgctgacattacaagccatttcaggtaatgcggtttcaacctctttactcgatcctcaagcggaattagcgatggggcatattgaattggcgaaatgggctgatttagtggtgattgcccctgcgacagcagattttattgctcggttgcgtatcggaatgggcaatgatctgctttcgaccatttgccttgcgaccgcttcgccaattttgcttgcaccagcaatgaaccagcagatgtacaagcggtcaattgtgcaggaaaatttgcaaagtttgactgagcaaggtgtttcgatcattggacctaacgctggctttcaagcctgtggtgatataggcaaaggcagaatgtctgagccgagtgagatttttcaagcgattgaagatcattttacgcaatcacaagatcttgctgatttgagcgtggtgattaccgcagggccaacgcgtgaagcgatcgatcctgtgcgttatattagtaatcacagctcaggtaaaatgggctttgcgatagcggaagcctttgctaaacgtggggcaaaagttaccttgatcgcaggccctgtcaatttggctacaccgcaaaatgttagccgtattgatgtgatttcggcacaacaaatggcagaacaagcggtcaatttagtacagaaaaatgcgatttttatcggctgtgcggcggtggcagattaccgagtggaacaggtagcagaacagaagattaagaaaactggtgataatgatgaacttactttaaaactggtgaaaaatcccgatattattgcaacagtagcccatcttactcaaaatcgccctttcgtggtgggatttgctgcggaaacgcaaaatgtggctgattatgcgaaagataagttacaacgtaaaaatttggatttaatctgtgccaatgatgtatctggcggacaggtgttcgggcaagatcaaaatacacttcatctcttttggcaaaatggcgagaagatcttacagcttgcagagaaagggaaattggcggaaaagctggtggatgagattgtagaacattaccgccatctctaaggaacgaatatgaaactacaggtcactacatcttataccattgaagaaggtatttttcctacttttgtgaaaggcactgaaatcaaagcgcttacaccttgtcggaaatatccgaattggtatgcttgtgaaattgagggctatcacacttatgtgcctgaacattttgtccgagcgaatcatttagtgaccgattacaacccaacggaattggcggtagtgaaaggagatattgttgaattactggagcttcattatcaatgggcattagtgagtaaaggcaaagaaatcggttggttgccttgtgaaatcttggtaacaagcggtcagctttagttggaaatttgtaaaaggaagaataatgaaacaaatcgacttaaaaattttagataaacgtatcggcacagaatttcctttgccaacctatgcaacaacaggttcagcagggttagatttacgtgcattgattgagcaacctttaaccgtagaagctgggcatacagtgttaattccaacggggatttcggtttatatcgctgatccaaacttagccgcggtgattttgcctcgctcagggcttggacataaaaacgggatcgtattgggtaacttgattggcttaatcgacagcgattatcaaggtccattaatggtttccctatggaaccgtagcgataagccgtttactgttgaagtgggtgatcgtatcgcacagctcgtgtttgtcccagtggtgcaagcacaatttaacattgtagaagagtttactgcgacagatcgtggtgagggtggatttggtcattcaggtaagcaataggattgaaaatgacagaacctgttatcaaaatgccgaaaaaatcggtaaaagaacgccagcaacaagtgctagaagtcttaatcgggctacttaactcggaagaaggtatgcaacgtgttacgaccgaaagattatcaaaagcggtcggcgtatctgaaggggcgttatatcgttacttcccaagtaaaacaaagatgtttgaggctttgattgaacggattgagatgacattaacgagctatatcaatgcaagtaaacgccaagaaaataccgaattggcagtaaaagcgattttacaaactatcttagaatttgcacaaaagaacccaggggtgacacgcattctaacaggacatgcattaatgtttgaagatgagttactcaaagctcgtgtcgcaaaattctttgaaggattagaactgcaatttatgaatttattgcaaatgcgtaaattgcgtgagggcagagcttttgctgatgaacgagcattggctggttacttggtgaatttctgtgaagggcaatttttacgccttgttcgctcaaattttggctttaatcaacatcaacattttgaaaaacagtggcaactgattaagccattgttctactaggaaaaagatgattatcccttggcaagaacttgaagaaagcaccctatataatgttttagattcttttattttaagagaaggaacagattatggggagcgagaactcacgctcgcagaaaaacgagagcgtttattagctcagttaaaagccgataaagttgtaattgtttggtcagaattgcacgaaagcattgatattaaagataaaaaatctttcttagggaatttgtaaatttatgctaaaattcttgacgtagtattaagctatatcaactataaatgatttatagaggtttctatgcaagatgtttcaatctcaaccgcacagcttgaagatgtcagcccattaccatccattcacgatccttcggtggaatggtttttaactcactgtcatattcatcgttatccagcaaaatatactttaattcacgcaggtgaagatgctgaatcactgttttatattgtcagcggagctgtgtctgtctttatcaaggatgaagaaggcaaggagatgttattaaccaatttaggacaaggcgaatttgtcggtgaaatcagcctttttgaagaaaaggctcagcctcgcactgcttgggtaagaaccaaaggcaactgtgaaattgctgaaatttcttataaaaaattcaagcaattagttcatctaaatcctgatatcttaatgtatctctcagctcagatggctcgccgtttacgaatgacatcaagacaggttagtaaccttgcattccttgatgtaacaggtcgtattgctcaaacattgatgaatttagctaaaatgcctgatgcgatgactcaccctcagggtatgcaaattaaaattactcgtcaagaaattgggcaaatggtcggttgctcacgagaaactgttggtcgtattttgaaaatgcttgaggatgaagggttaatctctgcacatggtaaaactatcgtggtgtatgggacaagataacatattaaaaatgcaaagtgctacgttagattatcaaatcaattaatctaacttagccttaaaacattaagatttccccccaattattagccccataaaaactttagtctatacaccgaaaaacctctctaaacctcctgattgccttgctacacatcgttccgcttgactaccccccttaaaaaaatacaatatatccattttggcaaacggtttcggaattcatttttctttgacaaattaaggtttaactatgtactcctctattcctttatcactcactaataaaactctttctgcggcttcaggtaaaacttatcatcttgttgataaatcaggagaaccccttaaagtctttttcactaaaattgttgatgaacaacttgttattagaagaaatcagggattgttagatattatagctttagttgggaatatgaaatgacggaaggtacccgtcaatcgattaagactgatgcccatagggcagaacaaatatccttagtagtggtggatgatggtgttactctacaggtgccatcaggagtgatttctattgccgcgacagttgtaaaaggaaatacgaatgttaccgctattggctcaggtagctatgaatataccattgcagttggatacagcaaagaagcagactttattcctgatgttgatcgatatgtgagtattgtttagctggtgtgtattcccctcgctagccccatccccctcgcaagctcggggacttcccccataaatgggggaaggtgcccgaagggcggatgggggactcttggaagtttgtaaaaccatccctaaatagaaattttcctaaccaactgccgaactaaatcgggtccttgataaatcatcgcagaatagagttgcaataaacttgcccccgcgttgattttttcttgccctgattgcaccgaatgaataccgccactgccgataataggcagtttgccgtttaattcttgagaaagttgcgaaataagttgagtacttagagcattcaacggcttaccacttagccccccttgctgatccgcaaaaggcaagcctgcgacgctatctcgtgaaagtgtagtgttgccggcaatcacagcgtcaatttggtgatggacaaggctgtccgcaacagaagcaatttcttcggcagtgagatcgggggcgatcttcaagacaagcggtttataaaccccaaatttttgcgaaagttgggcttgttcggctttaagtgagcgtaacagatcgtcaagtgcttcgccgtattgtaaagaacgtagatttttggtattcggcgacgagatattgaccgtcacataactggcgtgtggatagactttgcgtaagcaaatttgataatcgtccaagctatgttcgataggggtcgtcgcattttttccaatattaatcccaagaataccgttatattttgccttttttacattttcaatcagcacatcaaccccaagattattaaatccgttgcggttgataatgccttcggcttcaagaatgcggaactgtcgtggacggggattgccgtcttgtgcaacaggggtgacagtgccgacctcaataaaaccgaaccccaatttagcaaagccatcaatcgcctcgccatttttatccgcccctgcggctaaaccgatagggtttttgaaacgcagccccattacttcggtcgggttgtcgggaagtgaacaagctaaagaaaacggggttttaccgaataattttaaggattgaattgcaagttgatgggcgttttccgcatcaagattaaatagtgcttttttgataagtgggtacatcatttgtatcaatataaaattacaattcttccctcgcttgagggaaagaaaattcttcccccgcttgtgggggaaggtgcccgaagggcggatgggggagaattaaatatccttttccgccccatccccttcgcttcacgaagggacttcccccatttatgggggaagaattaatttttctttctaaaaatcaatgccatacattagaaatcaaaaacccaatctttcgattgggcttttgattaatggctgaacattgcagaaatagactcttcgttgctgatacgacgaatagcttctgccaacattcctgataacgttaatacacgcactttatttaatgcacggatctcagccgaaagtggaatagtgtctgtcacaatcacttcatcaagcgcatcattcgctaagtttttcgccgcactgccggagaaaacagcgtgtgttgcataagcaaatacacgacgagcgccacgctcttttaatgcttctgcggctttaaccaatgtgccgccagtatcgatcatatcatcaactaagatacaatcacgatccgccacatcaccgataatgtgcattacttgagccacatttgctttcggacgacgtttgtcgataattgccatatctgcatcatttaataatttcgcaatagctctcgcacgcaccacaccgccaatatcaggcgaaaccacgataggattaaccagatcagttttctttaaaatatcttcgatcaatactggtgaaccgaatacgttatccacaggcacatcaaagaaaccttggatctgttctgcgtgtagatcgcaagttaatacccgatccacccccacacttgaaaggaaatcagccactactttagcggtaatcggcacacgcgcagaacgaacacgacgatcttgacgagcataaccaaagtaaggaattacggcggtaatacgacctgccgaagcacgacgaagtgcatcaaccattacgatcaactccatcaaattatcattcgttggtgcacaggttgattgcacaataaaaatgtcccctccacgcacattttcattgatctgtacttggatctcaccatcgctgaaacgacctactgttgcatcaccgagagaaatataaagacgttcagcaattcgttttgctaattcaggagtagcgtttccagcgaagagtttaatatcaggcattttggataaacctctagatgtagatttttaaggatataaattgagcgtttgatgtaaaagggaaacatttctgccttgtgccacaaagccatcaacattttcaggttttaacgcaaacacacggcgagcctcatcttcacaatcaaattcagcaaatacacaagcaccagtgcctgttagccgagacggtgcgtattgtaccaaccaatttagtagatcatcaacctttgaatacagatctctgacaattttttcgcaatcgtttgcgaaaggggcatcaagtagctccgttaaagtacgttttggcgtatcacgagttaaatcggggtgcttaaaaatcgaagctgttgcaatcgcctcgtcgggctttaacaccaaataccacttctctttcggctgacaaggcgttaatttctcacccaccccctcagcaaaagccgcaatgcctcgcacaaaaatcggcacatctgcccccaaggttaatcccatttcagcgagttgctcaagggaaagccccgtttgccaaagtttattcaacgcaactaacaccgtcgccgcatttgacgaaccgcccccaacacctccgcccatcggcaagcgtttggttacgccaatgttcgcccctaacgagcaagcggttttttcttgcaacaattttgcagcacgataaatcagattttgctcaacagccacaccatcaatctgcttggttaagcaaatggttggatcttggcgaagttcaatctcaatatcatcaccaaaatccaaaaactgaaatagcgtttgcaattcgtgatagccatcagaccgcttacctgtaatatacaaaaaaagattaagtttcgcaggacttggaaaagtaaaagtagccatattagtacgcccaatgatcaatacgaattttcaaggtttgagaaccattttccaacacaatcaacttaggcagatttggcgggcgatcttcgtgatattccacaaaacgcgctttccacaaagtaccattgaccgaataatcaaattgagccaactggcgtttttcattgacaatatagtttgactgctgctcaggctgccccttcacccaataggcaaattgatctatcgggaacgaaacgccgataatttcttccattaacatagccacatccgcttcggtacgagaactcccctcgctatcagaaatcgtcattccatagacattacgttgcaatttcaatgatttgcttgataaatttgaggacatcgttagcccaaagttcgtcggggttttatattgccaatcaaaatgggaagaaaaacgttcctcaggagaaatatagccaaattgccctttcgccgaataggcgttgatttgcgttaattgtgcaagatgttgttgccattttgcatcattatgtggaattgtcacacttggttgagtgatttcagtcggagcatccagtacagaatgacaaccagcaagggcaaataacagagtaagggatagcagttttgtgagttttttcatacaatcctcaaatttgaaagttatagtctcaataatatactatgaaactacaatcaaattattttaagaaaatatttgatatttactaaaaatggtgtgagatctacccgcttgtttttagctttcgccctgctcccccgtcggctttctccgtttaccaatattcttggtatctttgtggcggactttcacttttttcttcaagctctcttttttctcttctttctttttcttaatccgcgctttctcttttttcgacaccgtattcacctcaccatcttttggggctttggtgcgtggtgctaagccttcaataatacgcggttttaacggctcttccgtatagcgtttaattttgccaagtagcttgtaatcgtgagcttcgactaacgatactgcggaacctttcttgcctgcacgagctgtacgcccgatacggtgtagataagtatccgcactatatggcaggtcaaagttaatcacaaaatcgacatcatcaatatcaatcccacgagcagccacatccgttgccaccaacacatttaccacgccatcttttaagcgagcaatcgcttgattacgttgtgtctgtgccatttcgccttccagataagtcgaacgaataccacgtttacgcaaggtttcgcttagctctcgcacactttcacggcgacgaacaaacacaatgcttcgctcaatctcaaattcacttatcaaacgggcaagtaatttggttttatgttcaagattatcagcgtgataataccactgctgaattttcttacgctcacggcgacttggctctgcgtcaatctgaacgggatcatttaaaatgcgttcagcaaaatccactaacaattcgccttccaaggtggcagaaaagagccaagtatatttacgccaacgggtttccgctgcgattttttcggcatcttgcccgaaccccatttgcaacatacgatccgcttcatcaaaaattaaaatctcgacagaacggcaatcaaaattttcttcttgaatatactgttgcaaacgcccaggtgtcgccaccacaagatcttgattagtgttaaacacttcgccgtggttttgataagcgacaccgcctgtaatagtggcaattttcaagttggtaaattgtgccaactcttccgcttgctcagcgacttgcatcgctaattcacgggtcggcgttaaaattaaaatgcgtggcggaccaggcttacggcgtgggtgatcgagcaaatgttgtaacgccggcagtaaaaatgcagcggtttttcctgtgcctgttggggcagaacccaacacatctcgcccttccattgcaggcggaatggtttcttgctgaatagccgttgggcgtttatagccttttttttccaacgcttgcaacagctcagggcttaaatctaattcttcaaaggtgattaattcgttcattttgttctcttgttaatttttaagaaaatcagaccgcttgttcatttaaaacttgtctgagtaatgttttgtttattggcacaacgccaagctgtaattcaaaggggcgtaacacctgattgataatatcaatactgtaatttcccttatcattttctaaatcagataacgttttgcgagaaactttgacaatctccgcataacgctcttgtttcattgccagtagatgtaaacgtagatatttcaacgcctgccctaaactcatctcattgagcaatagcttacgagcaatttcgtctcgcacagtcgctcgctgataaatatctaacgtttttttacttttagaggctctcgcctgtttgatctcttccattatgataataattgccaacgttgtaatttttcaggtaaatagtccaaactgattgaagggtacgtcaaaatcgccgttggaacgccccttgcttctaaacgtgctttaagtccgacaagctgttgagccgtttgacgcaaagcatccaataacttgtcggctggacataaatcatcaagctgttctgcaatcagatcaaaacgatattcaccgcctaattctaatgcagggtgacctttactatcccacattgtcgtgcgaggaataccttcaggatctgctttcattggggcaaaatcataaattggagcaagccagatacgattttgattgcgtaagaaagccgtatttcgtccgtgattatcgctatttccaaaggcgatattcaataaatctcgccttacccactcgatcacaaaagcttgtttatcaaaaaacattcctgtttcaaccaaatgagaggtttcaattttagcaatcaactgacgaataaccttttcgtgatccagcaaagagccagcccctttttctaacatagcataaacagattcaacggcataacgagccattttcccctgttcattacgataaaaatcaaaacgaggtaaccacaacgacgggtaacgttcgccttcttccaatcgcatttttgtcgtatcaatggtgtcaaaacccattgaggctaattcgtgataatagtgaaattcagctctcaatatatcgcaatctattacactacgtttcccacgcggaaacttgactaaatagaaatcgtcggcagcgtcaccttgttgtagattatcaatccaaacttgctgagtggctgtttggcgtagcaataatttcggcgcttcgccaccagcccccgttgcaccgccagccattgccccacgctgattagcatattccaaaaaatcagcttggcgattgataacatcatctatttcaaataagcgagggggttcattttcgataaaagaactgaccgcttgcttcactcgtaaatgcccgacaggtgcaatcgtaccttgttttaataacaaatagttttgttgagctgtcggcaaatgagcaatatcaagtttttgcaaccaataacgccgacttgctccagaaggaactatatcatctaaaaatgcaaaccagcccgatacactacggtatgggaaaaactccacaggatagttaaatgaaactgccttatcattatcacttaaaatctctgctaaatcatagagatagctaaaatcattgaggctataatcagcctgaaaggtcaaaatagcaatatcctgccaacgatcagcaatataggcctgaagtgtaagcggttcgatttgcataaaaattctctacggtaaaaaatatcacgcattataaacagaaaaaggattttgtgatagttataagttacacaaaatccatttttgttacttggcgagagatatatctctcattataaatataacgccatcaccacagcattctctcgcccaccgtcttgggttgggtagtaatttttccgcaccgtcacttcattaaagcctagtgagaagtaaagtttttgtgctgtcgtgtttgaagctcgcacttcaagccataatgtcgtgatctgtttttgttgaagctgagcgatcaacgcttgcaacagttgcttaccatagcctttgccttgataagcaggatcaactgcaatattaaacagcgtgacttcatcaagcacaaactgacaaatcgcaaaggcaacaatgcggttttcaacggataatttcaaattcaaatagcgttcgccttggctgtttaacagcgtccctttcgcccaaggcactaaatgggcttgttgttcgatctcaaaaaggcggtcgaagtcgttttctaaaataggttctatcacagaatatccttaaaacattagtgatgtaatgaattatgtgttattgggtatcactttttcacaagcttaccaataacttattgttgatacgatagaaatttgcctctctatctatttctgctgcccatttttcagtgttgtttagcgttgtcttggctgtttctatagagctacaagcggtggcaacggaaatattgcaaataaaagatgaatagcaaattttttcatataaaaaaactatttattgtttaattaaaggataaggattaacagccccagtcggtgtataaataccgtaatgcagatgaggtggagtacctttggcgttaccactatcaccaacagtgccaatcacagctccttgctcaatccattgatgacgttttatatcgccatattcttccaagtgagcatagtaatgtaccgtccatcccgtcattacgctgaccacttttccacccagtttgttttgtccgccacttcgcattccgtgccaagtatctgcaaaccgttgattgggaacaggattgggtaagctttgttctgttggtgttccttgcagtaaagtaggaagccaacatgcataagcgtagaaataaggtggtttgaaaagataaatacaggcaataaagaaactgaataatattcctaaaactgtaatatacttaactaatgttttcattttattctgccatatctttacaaaacagttgcatctgttgccaaagctctcgcttttgtgtagcttgggaaagcatttgccaagactcacactgccaagcggtctgatttgcaaatttttttgtaaattgtaccgcttgttcttcaggttgaatcagccagaaaatcggttgatgatcgaattgcagacgcattgcttgctcaaggctaatccattgatattgctcgtgatttaattgcaaggctcgtaaaacatcttgaaataacccagtctgttggtgatcttcttcgcaaataactaccagctttatattgtccgccaagcgaatttgtgcatcgcctttgagtacttgcggtttaacaagtatccattggggtatattcatttctgttagaagcagatctcggcgattcatcatttttcctcataaaaagttggggaatagtagcaaaaatcggtaaaatgcagaaattattttgcattaaatttggaaatttatgttatcaatcgaaagtgaagtgcttgaacgccatctgagcgtctttgagcaaaaaaatgtattgttatttggcgatgtgcgtgatgatttttcgggactcattcagccgatggcaaagtctgtggcggtgttcagtagctattttgattatgctcgccattataataacgtggaatttggcttggaatgttatcagcaagcagacttagcagtcttttactggacgaagaataagcaagagtgtcaatttcagttgttacaatggctggcgactgcgtcagttggtcaagaattattggtggtaggtgaaaaccgtgtcggcgtgcgttcagtggaaaatttacttgagccgtttggtgagatagccaagattgactcggctcgtcgttatgggttgtaccattttaggctggaaaatgtgcctacttttgatagcaaaaaattctggaaatcttaccatttgggcgatcttgatgtgtttgctttgcctgcagtgtttagctcggcagaactggataatggttctaaattgttgctttccaccttcaataaagccgatggattgaaagggaaggtgttagatcttggctgtggggctggggtgattggagcgtgcttaaaacagcaattcccgaaaatcaagctgacgatgtcagatattcacgcaatggcattggaatcaagtaagcgaacactggcggaaaatcagcttgaaggtgatgtggtagcaagtgatgtcttttcccatattggcggacgttttgatctgattgtgtcaaatccatctttccacgacggtgtagatacggcatatcgtgcggtagaagagttgattgcccaagctaaacaacatcttaaccgtggtggtgagctacgcattgttgccaatgcttttttaccttatcccgatttattggataaggcattttgtagacattaagtgttagcgaagtcgagtaagtttaaggtgtattcagcgagagtctaataaagattagttaaattagttgttaaaattcagcagctattttaaagatctaacgaaattcagttataattccatcaacttttttccattgacctaaaacaatgacccaaacaacctatttcgccaccgcagcgcgtggctttgaagaaatgttaaaaacagaacttgagcagattacgcacgcacaatgcaaagtggctcaaggcggtgtgcatttcaccactgatttaaaaggggcgtatcaagcgttattacatagtcgcttggcttcccgtattttattgcccttaatcaatacgaaatttttcagcgacagcgatttgtatgcgtctgtggttgcttacgactggcaaagcattttcgatccaagagatacctttttcgtggattttaacggcacaaaccgtgaaattcgcaacacacaattcggtgcaatgcgagtgaaagacggcattgtcgattattttgagcgtaaaggttttgctcgtccgactgcggataaaatccgtccagatattcgtttacacgcctatttaaatcgtgaagatttgattatttctttagatttaagcggtgaagctttgcatatgcgtggttatcgtgaagaaacggggaaagcaccgttgcgtgaaaccttagctgcggcgattgtgttgcgttcgggctggcaaaaaggcacgccactggtcgatccgatgtgtggctcggggaccttgttgattgaagcggctcaaatgcaagcgaatattgccccacaaattaaccgtattcattggggatttgatagttggaaagggcatcagatcgaactgtggaaaacagtttggcaggaagcgaaagagggggaaatcctgcccccctccgtcttcggcacctccccctgcgagcagggggagggaagcaaagcgctgttcttcggctttgaccttgatcaccgagtgctacaaaaagctaaacagaatgcgaaaaatgcaggggtggcagatttaattcagtggcaacagggcgatatgtcggcgttgaaaaatccgattacagagcaggtggggacggtgatttgtaatccgccttatggtgagcgattaggtacaaccccagcgttaattgcgttgtattctgtctttgggcaacggttaaaacagcaatttgcaggttggaatgcctctatttttagtggcgaacctgaattactgaactgcttacgtctgcgttcagctcgtcaatttaaggcaaagaatggaccgcttgagtgtgtgcagaagaactatttgatcagcgaaaatgcagacaagcggtcagatcttgatgaaaatctgcaatttagccaaaacgcacaggttgcccctgattttgctaatcgcttaaccaaaaatatcaagaagatcgaaaaatgggcaaaacagcaagggcttgatgcctatcgtttatacgatgccgatctaccagaatataatttggcggtagatagatatggcgatcatatcgtggtgcaagagtatgccgcaccgaaaaatattgatgaaaacaaagctcgcaagcacttgcttgatgcggtatcagcgaccttgtatgtcaccggtgttgaaacaaataaattagtcttaaaagttcgccaacgtcaaaaagggactaatcagtatgagaaactggcgaataaaggcgactatttcttcgtgaatgaatatggggcgaggctatgggtaaacttgacggattaccttgatacaggcttgttccttgaccaccgcttaacacgtaagatggtcggcgaaatggcgaaaggaaaaaccttcctaaatctgtttgcctacacgggttcagcgacagttcacgcagcgttaaatggagcaaaatcgaccacgacagtagatatgtcaaacacctatctcaactgggcggaacaaaatcttgagctgaacaatatttcactacgaaatcaccgcttgcatcaggcagattgcttgcaatggttagcggattgccgtgagcgttttgaactgattttcgttgatccgccgaccttttctaattcaaaacgaatggaaaacagttgggacatacaacgtgatcatattgccttgatgaaacagttgaaacgcattttaacggcaaacggcacgattgtattctcgaacaacaaacgtggctttaaaatggattttgacagcttggctgaattaggattaacggcggaaaacatttcgcacaaaacattaccgttggattttgagcgtaatccgcatattcataactgctggattgtgaaacattcggaataaattatgttagatattgtgttatatgaacctgaaatcccacaaaatagtgggaatattatccgtctttgtgcaaactgcggtttccgtttgcatatgattgagccacttggctttgcgtgggatgataaaaaattacgccgctctgggctggattaccacgagtttgtcgatattcaaaaatataaagactttgatgattttcttgagcgagcaaagcctaaacgcctttttgctttaaccaccaaaggcgagcctaatcatagcgatgtgcagtacgaattggggaattttctgatgttcggccctgaaagccgtgggataccgaaagcgattttagatagtttaccaatgtcacaaaaaatccgtatcccgatgtgtaaagatagccgtagtatgaacttgtctaattccgttgctgttgtggtgtacgaagcgtggcgacagtttggttatcaaaatgcagtgccaaggcaagagatttgaattatcagtgtaatagacaaaatagttgctaaaaagtggctcaaagccttatagcacaaggctttaagccctcttttttgaaatatgaacaaaaaactgcccattttgccaaagtcagaaaataaagaaacatgatatacaaaataatactcaacgttatttttgtaatgaatgttataaaacgtttatcttaaaatctaaattagatccaattaaaatttggactgattacacatccggaaaacaaacctatcaacaacttgccgaaaaatatcattgttcggttagaactattcaaagatatattgataaagcccctaaaacagctttaaaaccaactttaaatcgatacttgaacatcattatggatacgacattcttcggtcgttattttggtgtattagtgttgatggattcaaataacgccatttctcattattttgtgcgaaccgaaaaagatatttactacaaacttgctctgaataggttaagagaaaaggctatataattcaatcgattacctgtgatggtagacgtggtttgatgaaagattttatttatctactatgccattttggcacagtacaaaaagcaaaaaccgcaagctatctctaacctgcggtttttctctttaataaaaccccgacgatgctctactctcacatggggaatccccacactaccatcgacgttacagcttttcacttctgagttcggtatggagtcaggtgggacaactgcactattgtcgtcgggaaaatcttttgatgattctctctatcttcttttttctgttctttaagggcaaatgtaatttgcccctacatctttctgttctttaagggcaaatgtaatttgcccctacatctttctgttctttaagggcaaatgtaatttgcccctacactattctaatttcgaaacaagctgttctgagtctctttgttttattttgtttagttagtttgttgcttttattcagctctctaactctctcacgtctacttcaaaaacgcttgaggttgtatagttaagcctctcgggcaattagtatctgttagctcaacggctcacaccgcttacacaccagacctatctacgtcgtagtcttcaacaacccttactagcttatagctagggagaactcatcttaaggcgagtttcgtgcttagatgctttcagcacttatctcttccgcatttagctacccagcaatgcctctggcgagacaactggtacaccagtgatgcgtccactccggtcctctcgtactaggagcagcccctctcaattctccaacgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgacttgtctgtctcgcagttaagcttgcttataccattgcactaacctcacgatgtccgaccgtgattagcaaaccttcgtgctcctccgttacgctttgggaggagaccgccccagtcaaactacccaccagacactgtccgagaccacgtttcgtaatcttcgttagaacatcaaacgttaaagggtggtatttcaaggtcgactccacaagcactggcgtgcctgcttcttagtctcccacctatcctacacatcaaaattcaatgttcagtgtcaagctatagtaaaggttcacggggtctttccgtctagccgcgggtacaccgcatcttcacggcgatttcaatttcactgagtctcgggtggagacagcctggccatcattatgccattcgtgcaggtcggaacttacccgacaaggaatttcgctaccttaggaccgttatagttacggccgccgtttactggggcttcgatcaggagcttctctttcgataacaccatcaattaaccttccagcaccgggcaggcatcacaccctatacgtccactttcgtgtttgcagagtgctgtgtttttaataaacagttgcagccagctggtatcttcgactggttcagccttcggaggtatactcctacaacctacgccagcgcaccttctcccgaagttacggtgctattttgcctagttccttcacccgagttctctcaagcgcctgagtattctctacctgaccacctgtgtcggttttcagtacggtttagtaaagcctttcgcttagtggcttttcctggaagcgtggtatcagttacttcatttccgtagaaactcgtcatcatctctcagtgttatggaagtccggatttgcctaaactccccacctaccaacttaaacagacatccaacagtctgctaacctaaccttctccgtccccacatcgcagctttaccaagtacgggaatattaacccgtttcccatcgactacgcttttcagcctcgccttaggggccgactcaccctgccccgattaacgttggacaggaacccttggtcttctggcgaacgagtttttcactcgttttatcgttacttatgtcagcattcgcacttgtgatatctccagcatacttctcaatacaccttcatcgacttacacaacgctcccctacccaacaggcgtatcacaaatattcctctgatttctatccgcactttatgccaactcaacgtgttgggtgcttgaccaacatctcattccgtttcacttcattcgatgttgttaatcgaaggcgtatttgtgatacgcctgatgccgcagcttcggtgctatattttagccccgttacatcttccgtgcaggccgactcgactagtgagctattacgctttctttaaatggtggctgcttctaagccaacatcctagctgtctaagccttcccacttcgtttcccacttaatatagactttgggaccttagctggcggtctgggttgtttccctctccacgatggacgttagcacccaccgtgtgtctcctatgcattactcttcggtattcgcagtttgcatcgggttggtaatccgggatggacccctagccgaaacagtgctctacccccgaaggtattcacataaggctctacctaaatagatttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccttgcaactatccgcccagttaagactcggtttcccttcggctcccttattcagttaacctcgctacaaaatataagtcgctgacccattatacaaaaggtacgcagtcaccctttcgggctcccactgcttgtacgtacacggtttcaggttctatttcactcccctcactggggttcttttcgcctttccttcacagtactggttcactatcggtcaatcaggagtatttagccttggaggatggtccccccatcttcaaacaggatttctcgtgtcccgccctacttgttgcaagtttagtaccacaacataaacttaaaatacggggctatcaccctgtgtcgcttggcttcccagccaattcttctgtctttgctgctatcacttgctggctctttcgctttcgctcgccgctactgacaaaatctcggttgatttcttttcctcggggtacttagatgtttcagttctcccggtttgcctcaacagactatgtattcatctattgatagtagattcttcatctactgggtttccccattcggatatcttggattaaacgcttcttatcaactcatccaagcttttcgcagattagcacgtccttcttcgcctctgattgcctaggcatccaccgtgtacgcttagtcacttaactatacaacctcaaacatttttatctaaaagaaaaaacatttaagactgatattaactactaaacacttaactgcttttgttcagttaagattttttactactcagactttcttgtttcagggcaaatatgatttgcccctacagaaaatctctcagttttcagcttgtttccaattttttaaagaacaatcgataatcacctttcggctaatcatcatatttaaataaacaactcactgttcgcttaaatatgatgattggtggagataagcgggatcgaaccgctgacctcctgcgtgcaaggcaggcgctctcccagctgagctatatccccaatgtcatcacatcgctttcttcgtttcactcactattcagtatagatttctcttcaccgtttagagtggtgggtctgagtggacttgaaccaccgacctcacccttatcaggggtgcgctctaaccacctgagctacagacccaaaaggatgtcttcgttctctttcttgtctacaattaccaaacaatctgtgtgaacacttgcaaatctcttcattcaggtaaggaggtgatccaaccgcaggttcccctacggttaccttgttacgacttcaccccagtcatgaatcataccgtggtaaacgcccccctttcagttaagctatctacttctggtacaacccactcccatggtgtgacgggcggtgtgtacaaggcccgggaacgtattcaccgcgacattctgattcgcgattactagcgattccgacttcatggagtcgagttgcagactccaatccggacttagatgcactttctgagattcactccacctcgcggcttcgtcaccctctgtatgcaccattgtagcacgtgtgtagccctactcgtaagggccatgatgacttgacgtcatccccaccttcctccagtttatcactggcagtctcctttgagttcccgaccaaatcgctggcaacaaaggataagggttgcgctcgttgcgggacttaacccaacatttcacaacacgagctgacgacagccatgcagcacctgtctctaagttcccgaaggcacaaactcatctctgagttcttcttaggatgtcaagagtaggtaaggttcttcgcgttgcatcgaattaaaccacatgctccaccgcttgtgcgggcccccgtcaattcatttgagttttaaccttgcggccgtactccccaggcggtcgatttatcacgttagctacgggcaccaaacataaagcccaatccccaaatcgacagcgtttacagcgtggactaccagggtatctaatcctgtttgctccccacgctttcgcacatgagcgtcagtattttcccaaggggctgccttcgccttcggtattcctccacatctctacgcatttcaccgctacacgtggaattctacccctccctaaaatactctagccacccagtatgaaatgcaattcccaagttaagctcggggctttcacatctcacttaagtcaccgcctgcgtgccctttacgcccagtcattccgattaacgctcgcaccctccgtattaccgcggctgctggcacggagttagccggtgcttcttctgtgactaacgtcaatgtaatgctctattaaaacatcacccttcctcatcaccgaaagaactttacaacccgaaggccttcttcattcacgcggcatggctgcatcagggttccccccattgtgcaatattccccactgctgcctcccgtaggagtctggaccgtgtctcagttccagtgtggctggtcatcctctcagaccagctagagatcgtcggcttggtaggcctttaccccaccaactacctaatcccacttgggctcatcttatggcaggtggcccgaaagtcccaccctctagtccttagacattacgcggtattagcgacagtttcccgtcgttatccccctccataagccagatccccaagcattactcacccgtccgccactcgtcagcaaagaaagcaagcttccttcctgctaccgttcgacttgcatgtgttaagcctgccgccagcgttcaatctgagccatgatcaaactcttcaatttaaaaagtttaatcgctcaatatgtactgactataaaaaaatcacttaatatgaatttcaagttaagcacttatcaagacttcaaaattaaaaaaatatttttaaacaaagtcaatcaacaagtgcccacacagattgtctgataagttgttaaagagcaaaaaagaacgacgcactgtcaaatttaactacttcacaacagcgcgtcgttgtgtggtgcacattatagagaaattcaaaaccaacgcaagtacttttttaaagtttttttctaaatgttttgtttttcaccaaaaattaaaaacagcaaaacataacccattgattttaaacaaaattatttttcagcaaaattcagtatatttaagcgtttaaatccccaattctgcattaccttttctctttttaggaagtcttcactgttttgcgtacaaaatgcctgattttctttgttttcgttattcacattcctcttcacatcttgtaataagctcactacacggttcgcaatccgatttccagaatcaacaaaaaagctcacccgtggtaatagttgttgcaactcttctttgactaatgggaaatgtgtacaacctaaaatcaccgtgtctaatgtcgggtgtgattgccattctgcaacaactttttgcaggcgttgcatatccaccgaccccgtttgctgtttttcttcgacaatttccaccaagtctgtggaaccaatgcgttctaccacacaatcttttgcatagcgttcaatcaactcatcgacataaggacgagttaccgtgcctttggttgcaagtaagccaatggttttggtttgggaaatttgggcagcaggtttaatcgcaggcacagtcccgacaatcggcattgcaaaccgttctcgcaaggcaggtagcaccaccgtactggcagtgttacaagcaacaaccaccatatcaagcggatagttttctgcaattttttgcacaatacctaccgctcgttcgatcagcaccgcttctgatttttcagaataagggaaatacgcgttgtcaaaacagtagagataatgggcatctggcagattttcacgaatagcatcgtaaatagtcaaaccacccattcctgagtcgtaaagaagaattgttggtttcattatattttgtaattaaagaacttcgagcgaatgctacgcctttcttgatgtggtttcaaatgaaaattgtggcagaaacagctctcgaatttctaacggataacctttgagtagcaatgttgaacggcgagcatataagcccgtctgcttgtcttggctccattccaaagttaaacgctgtggattttgcggaaatagccacaaaccaataggattatctcctagggttaaaacggcttgtgctacattctcaattgtttcttccactaatagcgtttgagcaaaaatccacgctttatcatcaccacttaacaccacttctcgcacccacatttttgcaaaatattgctcaaatccgaccgcttgccagccctgttgcaccacatcaacggatagcctttggcaaatttgttgcaacttttcagttaaagagtctgtatgtaacagccattctgcaacttggcttggcaaacccgtttccgccgtttgccaagcagatgtggctaataaggttcgatactgctcgaaatcctgcatttaagcccctagctgtttgagcaaaatctgctctaacacatcatagccttgctgagtaaagtgcaatccgtcgtgacacagatttaagtccaatttgccttcttcattagcaaaggcattccacgttttcacataacgaatatcggaagggcaatgtgcttcaaggtattgatttaacgccaaaatcgcaggattgtctgtggtcgcaatgttattcacaggggttgcttctaataaatagtaacgagatgttggggctaacgttttaaaggcggacacaatctcgttaatccagcctaacacttgcttcggcgaataatcaggttcttttacaatgtcattcacccctaaaaagataaacacatcttcgcctaactgtttgattaaattacctttaacaatcaaatcaaggtattgacgagtgctagtaccagataaccctaaatttgccaccgttttacctgcaatattcggcgtgccttgttccatatcagaccacatatcaaatagtgagtgaccaacaagggtaatttgagctgttttatcaaactcagtctgtttgcttaatgccctgtctaaaatgtcttgatctgttttcatatgttatcctttgtctaaagtaatgattaaaaaccatcctacacaacaaatcccactttcttatacacgtcggctaaggttgctttcgcttttgctctcgctttttctgcaccttcacggtaaatactttcaagcaatgcttcgttgttacggaaatggtgataacgttcttgaagttggcttaacattgcggaaacttcgtcggcaacggcagtttttaagtgaccgtacattttgccttcaaattctgtttctaattctggaattgtcttgcctgtgacgcttgccaaaatatcaagtaggtttgatacgccaggtttattttgaacgtcgtaacgtacaacaggtggctcatcaccgtcggtcattgcccgtttgatttttttcgccactgattttggatcttctaataaaccgataacgttattacggttatcatctgattttgacatctttttcgttggttcaagtagcgacataattctcgctcctgttttggcaataaagacttcaggcacagcgaagattggctcaaggacatttccctctgcgtcttttttgccgtataacgcattaaaacggttagcaatatcacgggtgatttctagatgttgtttctgatcgtcgcctacaggcacttgatttgcttggtacagtagaatgtctgccgccattagcactggataagtaaataagcccacgtttacgttatcttcgtggcgagctgatttgtctttgaattgtgtcattcgccccatttcgccgaagtaggtataacagtttaagatccaagcgagttggctatgttcaggaacgtgggattgaataaaaatagtgcttttgactggatcgataccacaagcaaggtaaatggcgagtgtatctaaggttgctttgcgcaacgcttctggatcttgtcgcactgtgatggcgtgtgaatcgacgatacaaaatagacattcatattcatcttgcattttaacccagttacgtaatgccccaaggtagttacctaaacttaattcgcccgatggctgtacgccactaaatactattggttttgacataatctttctctttttagtaaaaaatctagcggtgtgattttggcagaaatttgctaaaaatgccaagcactcaaccgcttatcattttaggaattaatcctcaatccccaaactttcccaaatctcatcaacacgtttgacgacatcgggatttttggtaatcggcgttccccattctcgttgggtttcacctgcccatttattggtggcatcaatgcccatttttgagcctaatcctgcgataggggacgcaaaatcaaggtaatcaatcggtgtgttttcgattaatgtcgcatctcttgctggatcgcaacgagtggtaatcgcccagattacatctttccaatctctcgcattgacatcatcatcacacacaatcacaaatttggtgtacataaactgccgtaaaaacgaccaaacccccatcattattcgtttggcgtgtcctgcgtattgctttttgatcgtgactaccgctaggcgataagaacagccttcgggcggtaagtagaaatcaacgatttcagggaattgcttctgcaaaatcgggataaacacttcattcaaggcttcgcctaagaccgcaggttcatcaggtggtctgcccgtgtaggtggaatgatagatggcatcttttcgcattgtaatatgcgtcacggtaaacacagggaaatactcttgttcattgtaatatcccgtatgatcgccgtaaggtccttccaatgcggtttcgttaagatcgatatagccttcaagcacaatctcagcactagcaggcacttccaaatcattgctgatggatttcaccacttcagttttgtgtccacgcaataaccctgcaaaggcatattccgataaagtatcggggatcggcgtaacggcggctaaaatcgtagcaggatctgcccctaatgcgacagaaacaggaaacggcttatcgggattagcttctttccactcttggaaatccaacgcaccgccacgatgcgatagccaacgcataatcagtttatttttagtgattaactgctggcgataaatccccaaatttaaccgctttttataaggaccttgcgtaatggttaagccccaagtgacaagcggtgcgacatcaccttgccaacagtgcataatcggcagttgatacagatcgacatcatcatccgagatcaccacttgctgacaatctgctttattcaacaccttacttggcatattcagcacttgcttccactgtggcaactgtccgattagatctttaaagccttttggcggttcgggttcttttaagaacgccaacaacttgcctagctctcgcaaggctttggtatcttcttgtcccatacccattgccacccgttccggcgtgccgaatagattgcacagcacaggcattttgtagcctttcgggttttcaaataagagagccggaccacctttactcaaagtacgatccgcaatctcggtcatttccaaataaggatcgatctcttgagtaatacgcttcagttcgcctttttgctcaagcagatcgagaaattctcgcaggtttttgtatttcatttgattctccattgcaagaaaatgcaattttaataaaatttctaatctagagaaataaaagagctgaccccagtatgatactgaaatcagcccattaaaactatctatttaaagatatagccacaatatttggaatataatgcaataaatacaactaaactatttacttaaattatcaaagaagtttttcacccctttgaaaaaaccttcgtgttttggtcgatgttgtcctttgccttccagactttcttctaatttacgtaacaactctttttgttcttcattaagcgatactggcgtttcaataatcactttacagattaaatcccctgcatagccgcctcttgcactggttacgcctttaccacgcacgcgaaacagtttacccgtttgggtttcggctgggattttgagtttcacgcgaccgtctaatgtcggcacttcaatttcgccacctaatgccgccattgtgaagctgatcggtacttcgcagtaaagatttgagccgtcacgcacgaaaatatcgtggtctttaacgtgaattaccacatataaatcccctgctggagcgccgttttcccctgcagccccttcacctgataagcgaagttggttgccagtatccacgccagctggaatggtgaccgaaaggtttttagttttctcaacacgtccgtcaccgtggcaagatttacacggtttctcaattttcttacccgtgccgtgacaacttgggcagacagtttctgtcataaagaaaccttgttggcgacgaactcgtcctgagccgtgacagtgtggacaggtttcgactttgcttcccgcttcagcaccagaaccgtggcaagtatcacattgaacaagagttcgaatgcgaatatcttttttcacaccacgcacagcttcttctagggtgatttccagatcgtagcgtaagtcatcaccacgcacgacacgttggcgacgagcgccaccaccaaaaccaccgccaaacatttcgctgaaaatatcttcaaagccaccgaaaccgccaccaccaaatccgccgaagccaccagctccgccaccgtgttcaaaggcttggtgaccatattggtcgtacatcgcacgtttttcgttatcgcctaatacttcataggcttctttgatctctttaaatttttcttcagcttctttgctgccttggtttttgtcggggtgatgttttgccgctaaacgtttataagcacgtttaatctcttgttcactcgcccctttttgtaagccaaggacttcgtagtaatcttttttactcatagtattttttgtaaatttttaagaaaatttgaccgcttgtaacctaatttcgttatattctgttttctaatgaaaaaatctgcttatttagaatttcatcaattttggctcgatccaaccctgaatttatcaaagtgagttctaacgttttcatttgttgtttaaatgcttcttttgctttatgtacattttcagcaataaaatcagcattgagatcgctttcgatacgataaaatttaatgttggaaacacaaggataaaaccaatcaaatttagcagttaaatcctgaatagcaatagtgccatgtgcttcactaataccttctttccccaaataaacacttccttgtagatgttcaaaaccgtgtttttcaagcgtatttcgaatatcgtagtaagcgttattatgggtatttccatggtaattatcttttagacaatttgtatccatatcaaaagtgattaggtatctactcatattcaatttccaatagttagattttatctaaaatgttttttgatgataattaggacataatcaacgcagttttcaacggtatcatcaccatttaacttttgagcctgtatttcgagttttctttcgtagatatacaccaaaagggcgtgttgccacgccctttgtagggacgcagtgcctgcgtccgtggacacacgcagtgtgaccctacccgtaaattacttgttgtctttcacttcttcaaactcagcatctaccacgccgtcatctttttgactttgttgggcttgttgctgaccttgttgagcctgagcttgacctgcttggattaacggctcagacgctttcactagggcttcgattttcgcttcaatatctgctttatcttcgcctttcgccgctttttctaatgccgctaccgcttcttcgatcttcgctttgtctgcatccgcaaggttgctacctgcttcagcgatctgtttacgggttgagtgagcaatcgcatccgcttggttgcgagtttgaactaactcttcaaacttacggtctgcttctgcattcgcttccgcatcacgcaccatttgttcgatttcagcatcgcttaagcctgaagaggcttggatcttaatttgttgctctttacctgtgttcttatcttttgcagacacattaataataccgtttgcatcaatatcgaatgtgacttcgatttgtggcataccgcgtggtgcagggttaatgccttcaaggttgaactgacctaatgatttgttatcagaggcacgtttacgttcaccttgtaatacgtgaatggttaccgcactttggttatcttccgccgttgagaacacttgcgattttttcgttgggatcgtggtgtttttctcaattaaagttgtcattacgccacccattgtttcgatacctaatgataacggggttacgtctaacaataatacgtctgttacatcacccgctaatacgccaccttgtacagccgcaccgatagccaccgcttcatctgggtttacgtctttgcgtggttctttgccgaagaagtcagccacttttttctgtactaatggcatacgggtttgaccgccaactaagatcacatcgttgatctcagatacgcttaaacctgcatcagctaacgccacttttactggctctaatgagcggtttactaaatcttctactaatgcttctaatttcgcacgggtcacagttaatactaagtgttttggacctgttacatctgcggtgatatacggaagatttacttcggttgattgtgctgatgaaagctcaattttggctttttccgcagcttctttcacacgttgcattgccattgagtcattgcgtaaatcgacgccttgctctttttgaaattcttcaacaaggtagttaattaaacggttgtcgaagtcttcaccacctaagtgagtatcaccgttggttgcacgcacttcaaaggtttgttcgccatctaagttatcaatttcgatgatagacaagtcgaatgtaccaccacccaagtcatacactgcaacaatttggttttcttttttagagtctaaaccgtaagctaatgccgctgctgttggttcgttgatgatacgtttaacttctaaacctgcgatacgacctgcatctttagttgcttgacgttgagcatcgttaaagtaagcaggcacagtaataaccgcttcagtcactggttcacctaagaaatcttctgcagttttcttcatttttttcaatacttccgcagagatttgcggtggagccattttttcgccttttactgatacccacgcatctccattgtccgctttggtaatctcaaacggcataatttcaatgtcacgttgtacttcagaatcagtaaaacgacgaccgattaaacgtttaatggcaaataaagtatttttcgggttagtgatcgcttggcgttttgctggctgaccaactaaggtttctttgtctgtatacgcaatgattgacggagtagtacgcgcaccttctgcattctcaattacacgtggtttgtcgccatccattactgcaacacaagagttggttgtacctaagtcaataccgataatttttcccataatttgattcctctaatataaatttggttacttgtgggactgaaccatcatattcaacgtagggacacactgcgtgtgtccacaggctgttcctactgtgtatagatggataaaatccgccactttgttaaaaaagaaacgggaagttgtgctacgttcccgctcagacggaacaataaatagggataaaaatgtgggcttcaaggggaaaactaaaaaaatttaaaaaatgtgtattaacacacacgcactatttctcactacggcacaatcaccgtaaacacataagccgccatattaaccaaaagcactacgccataaagcatattcgatttgccgtgattaagagaaaccatcacaacgaaagcggacaatgccagtagcaccattgatttccaatctaagcctaacaccatattaatatcaaatagtaagcagacgatcacaacagacggaatagttaaaccgatactggctaacgctgaacctaacgccaaattcacactggtttgtaatcggttacggctggctgcggtcaatgctgccaaaccttcaggcatcaaaacaacagcagcaataatcaccccgactaaagataacggcgcacctgcagcaaccaccattgtttcaatcgcaggggaaagccctttcgccaacattacaacgacacctaaacagatcaccaatagcaataaactgactaatgccactttagtcgaaggtggctctgcgtgatggtttggattatcatcatcggctaagaaataatcacgatgacgcacggtttgcatcataataaaagagaaatataaaacgagtgacgcaatcgcaacaaataccaactgagagctggtataagtcccccctgccgagctggttgtgaaattaggcaaaatcattgttaataccaaaatagacactaaggtcactaaagcggtactcactgattttttatgaaaaaattgaacgtgatgtttaataccaccaattaataagcaaccacctaaaatcccattcaaaatcaacataatcgccgcaaatacggtatctctagccaaataggtagcattgtcaccgcctgcgatcatcagcgacacgattaatgccacttcaataatcgtaatagcgagtgctagaataatagtaccaaacggctctccaactttatgtgctaccacttctgcgtgatgaactgcagaaagcacactaccaatcaataacgcacctcctccaagttgtagccaaatgttctctttcacgccaacaaaatagatagcccaagctgcaagcggtaagatcaccgaccaaattggcaaaggggaatgggaatgtgtcgccataatgtcttctcctttatttttatcatttaacaatcctgctcttttgtactcataatctcaataatttgtctatccatatagaccatactttttgtcgtaatcgcacataggttattgattgatttatcaacactatgttctacgataccttcattgcctgtcactcggctattatctaatgccactaacacagccttataggcagaagatactcccgttgaaactttcatcgcacagctgtttgctgccccgtcacacaatacgccactgatgtcgccgatcatactgcaaatcgccatactaatggcattaaaattgcctttcaacaaatacgccataccagcagcactgcccattgccgccgtagtcacggcacaaagagcggatagttttggtaatttactgtgaatatagatcgcaatagtatgagaaagaaataacgcacggatcagttgctcatcatcagcattcacaaagcgtgccacaatcactgacggcattgttgccgcaataccttgattgctcgatccagaattgctcatcgcaggcaacaacgcaccgcccattcgagcatctgacgctgtcgtggtttcaatcacaatacgtgataataaatcatcagacatcaagccaagttcaatctgttttttcaaagttcgtccgatatgcaaaccatactctttttccaaaccttctttagataacgcagaatttaatttagccgcttcggcaataaaggcaatctgttcaagaggaacttccatcgcaaattgataaatctgttcggcggaaagttgattgaaaaagtgataatcgtctgctatttcaaccgcttgcgtttgttgctggaacaacacttccccatttttctcaatcaacaccacattggtatgggtatcttgaatacagactttgacccaacccgtttcgcctaacaacaaggcttccgagtaaagcgaaaaatccacatttgcaatatctacactcacttggtttgcatctaacatcgctttcgctttggcgacatcgtcagcttgaatatgtttcaacacttccaaacctgccgttgcatcacctgcaatcgccccacagccgccgcaatcggcaaacccaccatacccgttccaggcacagtaacccccataccatttttcattaaattcggggacactttagcctgaatttgaactggctcactgcccaaatgtgatttcgcaattgcagacgctaacgccaacgaaatcggctcggtacaacctaatgccggggcaacatctcgtttcacaatggcgattaattgttctgcaaattcaaatttattcattcttttttctctttagtaaaatttctctctattctaaccgcttattgcataatcaaaaagtaacttttttcacttgtctttagttgaataaaaatgcattattttaacataattattcattatgataatgtttgaatttattttttataattatcacttgaacgcaaacgtttgctctagtaaacttagccgcctattcctgagtaagagattaggcagcttgcaaaatgacagccaaaaatttcaataattaggagtacatataatgtttgaacctgccattttagttcttgccgatggttctgtttttcatggaaaatctattggttatcaaggacataccattggtgaagtggtctttaataccgcaatgacgggctaccaagaaattctcaccgatccttcatacactaatcaaattgttacattgacttatccacatatcggtaatacaggaacaaatagcgaagacgaagaagcagataaagtgtatgctgcaagtttaattattcgtgatcttccccttattcatagtaatttccgtgctaactcttccctttctgattatctggttaaacataaaatcgtcgcaattgccgacattgacacacgccgtttaacccgaattttgcgtgataaaggcactcaagcaggctgtatttatgttggtgatgatgtggctaaagctctcgaacttgccaacagtttcggctcaatggcagggcaagatttagccaaagaagtgacctgtaaagagctatatcaatggaaggaaggcgaatggcaactcggcaaaggttatgtgcaacaaactacccctgaatttcacgttgtcgcttacgattttggcgtaaaacgtaacattttaagaatgcttgctgaacgtggctgtcgtatcaccgttgtgccagcaacaacttctgcagaagcggtattagccttaaatccggacggtattttcctatctaacggtccgggtgacccagagccttgcacctatgcgattaccgctattcaaaaattattggcaaccaaaaaaccgattttcggcatctgcttaggacatcagttactcggattagccgctggtggcaaaacgaagaaaatggcattcggacaccacggtgcaaaccaccctgtgcaagatttagacacacaaaacgtgctgatcaccagccaaaaccacggttttgaagttgatgaagccagtttgccagctaacgttcgtgtcactcaccgctcactctttgacggcacagtacaaggcattgaactcaccgatcaatccgcattctcgttccaaggacacccagaagccagcccaggtccacacgatgtggcatacctgtttgaccgctttattgatgaattgagaaaggcgaaagggtaataagcggtgaggtttgaagggaaatttgcaaaatcttgtgaagatgtgaccgcttgtaactgatttttataagtgagataaataggaaattttcttcgatctcactcccctctttagcaaagagggggatcagatcgaaggtataatcgcattcaacaacagagaaaaaactatgccaaaacgtacagatataaacacgattttaattattggtgcaggtccgatcgtgattgggcaggcgtgtgaatttgactactcaggggcgcaggcgtgtaaggcgttgcgtgaagaagggtataaagtagtgttggtgaactcaaacccagcaaccattatgaccgatccgaatatggcggacgtgacctatattgagccgattgagtggcgaacggtggcgaaaatcatcgaaaaagagcgtcctgatgcgattttgccgacaatgggcggtcaaacggcattaaactgtgctttagatttatctcgcaatggggtgttaaaacagttcaatgttgagctgatcggggcgagtgaagatgcgattgataaggcggaagaccgtgatcgtttcaaacaagcgatggaaaaaatcggtttgtcttgcccgaaatcttttattgctcacacccttgaagaagccttgaaagtacaggaagcggtcggtttcccaacattaattcgtccatcatttacaatgggcggttcaggtggcggtatcgcttataaccgtgatgaatttttagcgatttgcgaacgaggatttgaagcgtcaccaacccacgaattgttgattgaacagtctgtactcggttggaaagagtatgaaatggaagtggtgcgtgataaagaggacaactgcattatcgtttgttcgattgagaactttgacccgatgggcgtgcatacgggcgacagcattacagtcgcacctgcacaaactttgaccgataaagaatatcaaattatgcgtaacgcttctttagccgtgttgcgtgaaatcggcgtggatacaggcggttcaaacgtgcaatttgcgatcaaccctgaaaacggcgagatgatcgtaattgaaatgaacccacgtgtgagccgttcttctgctctcgcttctaaagcgacaggtttcccgattgcaaaagtcgcggcgaaattagcggtgggttataccttaaatgaactacgcaacgatattacgggcggtttaattccagcttcttttgaaccaacccttgactatgtcgtgaccaaaattccacgctttgcctttgaaaaatttgcgaatgcggacgaccgtttaaccacacaaatgaagtcagtgggcgaagtgatggcgatgggaagaactttccaagagagcttacaaaaagcgttgcgtggcttagaaacggggatttgtggtttcaacttgttatcggaagagcctgaaaaaatccgtcgtgaactggcaaacccaggcccgaaccgtattctttatgttgccgatgcctttggtgcaggttttagcttggacgaagtacatcactattcaaaaatcgatccgtggttcttaattcaaattcaagatttagtgcaagaagagcttgcccttgagaaaaaacagttaagcgatttagatcgtgaagaattgcgtcgtttaaaacgcaaaggcttctcggataaacgtatcgctcagctcaccaaagtcagcgaaaaagcggtgcgtgattatcgccataccctcggcattctgccggtttacaaacgtgtcgatacctgtgcggcggagtttgcttctgatacggcttatctctattctacttacgaagaagagtgtgaagcgaacccgtctgatcgtaaaaaagtgatgattttaggcggtggtccaaaccgtatcggacaagggattgagttcgattactgctgtgttcacgcttcccttgccttgcgtgaagccggttatgaaaccattatggtgaactgcaaccctgaaaccgtttcgacggattttgatacttctgaccgcttgtatttcgagccattaacgttggaagatgtgttggaagtggtgcgtgtagaacagccgtggggcgtgattgttcactatggcggtcaaacgccgttaaaactggcaaatgctttacacgaaaacggtgtgaacattatcggtacatcagcagacagcattgatgcggcggaagaccgtgaacgcttccaaaaaatcctacacgatttgaacctaaaacaaccggctaaccgcacagctcgtaatgcacaagaagcggtggcgttggcaaatgaagtgggttatccgttggtggttcgtccatcttatgtacttggcggacgtgcaatgcaaatcgtttataacgatgaagaattgaacaaatatatgcgtgaagcggtgtctgtgtctaacgacagcccgatcttactcgaccacttcttgaacaatgcgattgaagttgatgtggactgtatctgtgacggtgaaaacatggtaatcggcggtattatgcaacacgttgaacaagcaggtatccacagtggcgactcggcgtgttctctacctgcttactcattaagcggtgagatcctcgatgaaattcgcagacagactaaagaaatggcgtttgctcttggggtgaaaggcttaatgaatgtacagtttgcggtgcaaaatgatgtggtatatgttcttgaagtaaaccctcgtgccagccgtaccgtgccgtttgtgagtaaagcgacaggtcagccgttagccaaaatcgccgcacgagtaatggcaggggaaagccttgcggaactcaatgcccttgaagaagtgatcccacaaaaatacttcgtcaaagaagcagtgttcccattcatcaaattcccgggggtagatacgattttaggccctgaaatgcgttcgacaggggaagtaatgggtgtaggagaaacctttgccgaagccttctttaaagcacagctaggcgcaggggaacgtattccaagaacaggaaaagtgttcttatcggtggataacaacgacaaacctcgcttactcgatgtggcaaaacgtttacaagagcaaggctacggcttatgtgcaacgcttggtacagcgaaattcttgcgtgaaaacggtgtggcgacccaaatcgtgaataaagtgcgtgaaggcagaccgcatatcgtagatgcaattaaaaacggcgagattgcgatggtgatcaacaccgtaaacggtgagcctgaagtgattgccgacagccactcaatccgccgtaccgcactgcaacaacgtgtgcctgtctataccacgattgcaggagctgatgcgatttcctatgccgttgaacatatcaacgagttcggggtttattcggtgcaggagttgcatagtaactagattataaaaagaagagcttgaatatactttacaaaactaatgttattcaagctctttactaatctatttagacagattattaatatggatattaggcatagtacacaattttaataaataataccccaatacagctgaaatccccgagccaattaagatacctaaacgagcaagagagataaattggccgtcagcttcgtcgccaccaaaagcaagcccagccaagaacattgacattgtaaagccgataccacaaaggatagaaacagcgaagatttgtttaaaatttatcccttctgataactgtgcgatacccaatttcacggcaaggaagctaaagctaaatacgcctaaggttttacctactaataaacctaacgcaacccccattgtaagcggtgagaataatgtgcttaagctcattcctgctaaagatacgccagcatttgagaaagcaaatagcggtaaaatcacaaacgaacaccacggtgcaaggatatgttcaaaatgagccaatggttcttccccatttttaccttttaatggaacgcagaagccaataattacccccgctaatgtggcgtgaacccctgattttaatactgaagcccataaaattaatccaacgaccatataagcacaaattgccgtaactcgcatacgattcattatgattaaagcagtaattgctatgactgctgaaatcagggctgtggtacttaattcgtgagagaaaaagatggcaattacgacaattgcccccaagtcatcaataatcgctaatgcgagtaggaaaattttcaaagcaaatggcactcgtttgccgagtaatcctaaaactccaagtgcaaatgcaatgtctgttgccatcggaatcgcccaaccttgctgaaattctggcgaatcactattaatcaatgtgaaaacaagagctggtacaatcattccccctaatgcaccaatagcggggaaaattgcacgttggtagctagaaattgctccaaccatcatttcacgcttcacttctagccctataaggacaaaaaacactgccataaagccgtcgtttacccacattaacaacggtttatgaatactgaataagccaatctggatactgacaggcatacttaaaaaatcaaagtagaggtctttcaagggcgtatttgcaaacagcattgctaacattgcaaaagcaagcaataaaataccgcttgcagactctagttgtaaaaattttcggatatgctggatcattctgttaacctcttgttatgtaaaattcgtcaatctttcttaaatcttttttcttttaacaaaatcagcgtgtaagatcaaggcgaagcgggcagatactgcagaaaatttgtaaaatttgtttgatcaacttcacgaaaagtagccatcaaggatttgaatttatgtttgggtaaatttatagattaaccttgatctttttgatatttatcgctaaaattgcgactcttttttatgatcctcattttggcttatagtcaatttttaatttttaggtagatagcaaatgaaacgtacatttcaaccatctgtattaaaacgtgctcgtactcacggtttccgtgctcgtatggcaactaaaaacggtcgtcaagtattagcgcgtcgtcgtgctaaaggtcgtaaaagcttatctgcataatggcagataagtcagccaaaacactcagtgtgaataagctaacttttcctcgggagctacgtctgttagctcccgttcaatttaaagcggtttttgaactgcctctccgtgctagcacacctcaattaacccttttatctcgccaaaacgatattgaacacgctcgaattggtcttaccgttgctaaaaagcatttgaaaaaagctcacgaccgtaatcgtattaaacgcattgtgcgagaaagcttccgcttgaagcaacatcaacttcctgcttatgattttgtctttgtggcaaaaggcggaattggtaaactaagcaaccaagaattatttgaaaccttggataaactatggcaacgccacattcgcctcgctcagaaagtacaacaggaacagcatcaaaactaagtcttttggcttatgtaatgctcgcccttgtgcatttttaccgctatgtcatcagcccattaattggaccacgctgtcgtttttatcccacttgctctacctatgcgttagaagcggttaaaattcacggtgccataaaaggtggctggcttgcgctaaaacgtattttacgttgcaatccattgaacgaagggggggaagatcctgttccgccgaagtgtaattgcggtaaaaaacataaataatattgtaggtcgggcagtaatgctcaacttaatctatcttgcccaataccaacttacccgcaaaacgttgcgttaattgattttgaaacagttctacttgtgtggggttaatcgctaagattaattccaccttatcactaaattgttgctcaagtagctcaatatcccgttccgcaatcaaatgttgaatcgtattaaattgttcatattcacactgcaagcggtaagatttacctaaaactttgcgaattttttcgacttgcaatagcccctgttgtacaccattgccataggctttaacgagtccgcccgtgccgagcaaaatcccgccgtaataacgaaccgccaccgcactgatttcccccaagcctgaacctagcaagtaattaagcattggtttaccagctgtccctgaaggttctccatcatcagaaaagccatattgctgtgaatcattcggctgccctgcaaccgttgcccaacaatgatgtcgagcatgcggatgtaaagctcgtatttcagcccaaaaggctttggcttgttccattccttctgtatggcgaatgtaggtaataaagcgactttttttgatctcttcttcaaagatcacttctgctttggggataaaaaattccatattctcaactgattacttcatagagttccatcatactttaaatgatgagatttgataaatctctttcaaattgttaaaaaaatgtgaaagtcatcatgtttttaagagaaaacgtttgcataacagaaaaaagtcgagtatatcttatatcgttttcctatttgagttataggtcaaacgcaacatcttacttttcccaatcctgaatttttagaggaaatagacatgaaaaacttttttaaattatcgttagttgcaagcttagcgatgggtgcgatgtctgctcatgctgaagataaattcgtgaccattggtactggcggtcaaactggggtttactatgtagtgggtcaatcaatctgccaattagtaaaccgtgacacagcaaaaaccaatgtgaaatgtaatgcgccatctacaggagcatctgttgcaaacttgaatgcaattgctgataaacagatggaaatgggtattgcacaatctgattggcaatatcatgcttacaacggctcaagctcatttaaaggcaagaaaaacgataaattacgtgcagttttctcaattcacccagaaccatttacagtcatggctcgtactgatgccaaaattgctaactttgatgatttaaaaggtaaacgtgtgaatgtgggtgacccaggttcaggtacacgtgcaacgatgaacgttattttagcggcaaaaggttggacagataaagagttcaaagtagcttctgaattaaaaccagcagaaatggcatctgtaatgtgtgataacaacttagatgcaattacttataacgttggtcacccaaacggtgcgctaaaagaagcggcagcatcttgtgatgcacatttagtgccagtaaccggcgaagcgattgataaattagtggcagatcactcttattatgcaaaagcaacgattccgggcggtttatataaaggtaccgataatccggtagaaaccttcggtgtgtatgcaacgcttgtgacttctgcggatgtggatgccgatcgtgtctatactgtggtgaaagcggtatttgataacttcgatcgtttcaaacgtttacaccctgcgtttgaaaacctaaaagaagaagagatgatcaaaaatgcgctctctgcgccattacatgaaggtgcaatccgttattataaagagcgtggttggatgtaattcatccgtttctaatattaaggcaggagtaaatcacttcctgccttttgtcgttttcatcaagcggtcagatttggctgattttttgcaaatttttcgttaaatctaaccgcttgtcttaggttttctcggaggagtttatgtctgctcaatccaaaactatggattacgatgatctgcaagatctcgtcgcctcaaatgattcaggcggtcgtaacccgacaggttttagtaaaaaattaattgttattacagcgattttatggtcgctattccaaatctattacacttcaccatttccattttggctacaagaagtggtgagagattggggctggaatttgaatgtggtggtagatgataccaaagcacgttctatccatcttgcctttgcaatgttccttgctttcttatctttccctgcatttgcaacatcaccaaaacatcgcattcctttccaagattggctgtttgcaactctaggggcattccttgcggcatactatattttcttttatgaagggctagttacccgctttggtgcgccgaatacgcaagatattattgccggctgtttaggcattttattattgttagaggcttgccgtcgtagtttaggattaccattagtgataatcgctgcggtatttttactctataactatttcggacaattcttaccaaccagctggatcatcagccaccgttctggttcattatctcaaatcattaaccaacaatggattacaacggaaggggtatttggtgtcgccctaggtgtttcaaccaaatatgtattcttatttgtgttattcggagctttattggataaagcgggtgcaggtaactattttatcaaaacagcatttgcttatttaggtcactttagcggtggtccaggtaaagcagcggtagtttcttctgcgttaacgggcttggtttcaggttcatctattgccaacgtggttaccacagggacattcaccattccgatgatgaaacgtgtcggtttgacctctgaaaaagcaggggcgattgaagtggcttcatcagtgaacggacaaattatgccgccggtcatgggagcagcggcgttcttgatgattgaatatgtcaatatgccgtatagccaattgattgtgcatgcgttcttacctgcattaatttcttatattgctttggtgtatatcgttcatcttgaagctcaaaaaatgggcttaaaagggttggatcgtgttgaacctgtcagtccgattttaatcactttgcttaaagttgtaagctatattttagtaacacttggcttagctattgcggttcattacggcttaggctggattaaagatgttgcccctgattttgccttcttaattgtgtgtattttattagcggcggtctatatcaaattgattcatcgcgtttcacaattccctgatttagaagctgatgatccaaattcactggtcgtgtcattgcctcgccgtaaaccaacagtaaatgctggcttacatttcttattaccggttgtggtattaatgtggtgtttgatgattgagcaattctcaccagggttatccgctttctggggaaccgttgcgcttgcggtcattttagtcacacaacgcccattattaagtttcttccgtaatgatgcaggtaacaaagttgtgctagttaaacaaggcgttcaagagttagtggacggtttggagtcgggtgcaagaaatatgattggtatcggtattgcaacagcaaccgcaggtatcattgtaggtgcggtatcgctcaccggtttcggagtgcaactttctggtattattgagatgctctcgatgggcaatatcttattaatgctgattttagtcgctatctttagcttaattttagggatgggattaccgactacggcaaactatatcgtggtatcttcattgatggcattggtgattgtcgaagtcggtaaacagaatggattaatcgtaccattgatcgccgttcacttgttcgtattctacttcgggattatggcggacgtaacgccaccggttggcttagcttcttttgcagcagctgccatttcaggcggtagcccgattaaaactggggtgcaagccttctactacagcttaagaacagcgattttaccgttcctatttatcttcaataccgatttactcttaattgatgtgggttgggcaaaaggtattttagtattcctcaccgcaactatcggtattttgctgtttaccgcagggacgatgaattacttcttcactaagaataaactatgggaaacattggtattaatttttactgcctttatgttattccgcccaggcttctttatggaacacatttcaccgacttcacgccatattgagccttctcaaatggttcaggagttagagaaagtacccgctgggcaaaatctcacattgaaagtcgcaggagtaaacccttatggcaaaccgattgaattctactcacagcttacagtgcctgaaggtgcaacgggcgaagagcgtatcaaagcgatgggattaaccttgctagataccggagagaaaattgagatcaacggcgaaatgtcaccgaagatcttaattgataatgttgaaattgattcagcggcagcgaaagcaggcttaaactgggatcaaaccattcttgatgtagcgttaccacaaagctcgcttccaaaagaattaatgtttatcccggctttcctattagcgatttttgtcggctggaatcagcgccgtcgcataaaaaaataaggacaaattatgtataacaaacttctccttgcgatcgacttaaacgatctcaatagtgctaagtatgtggttgatacggcattaaaactcacggcgaacaatcccgatgcggtatatcgtgtagtgactattattgagccgattgacgacagctttatttctgcgtttttaccgaaaaactttgataagtccgtcgtggaggaagcgaacaaagccttacacgctttcactcaagctaacttcccagagggcgcaaaggttcagcacattgtggctcacggcaccatctacgaagagatcaaccgcattgccgaagaaaaatccgttgatctgatcgtgatgttggcaagcagtaaacctaatgcaaaaggactgagttcaaatacggtaaaagtcgctcgaaatagcgacaaaccaattttagttctgcgttaggcaatcaatacaagcggtaggattttgaagtatttttgcaatttgcaaaatatttgcgaaatcccaccgcttttgtcattaagaaaatcttatttttctgtcagctaaacataacgctatatcgaattaaaggaaatagccttattcaaaatttcaaatcaagcacttttccgttatacttttcattaatgagagtgactaaaggagccgattatgaccccatctcaactgattcaagctaaacacactgaaattatggcaatcagccgacaatttgcagtggagaatgtgcgtatatttggttcagtcgccaaaggtaaagacacagaaaatagtgatttagatattttggtagataccacacctaaaacgacaatgtttgatctatgtggtttacaaatggagttggaagatttgctaggtataaaagttgatgtacttaccccacgcagtttacctgaaaaatttcgtgagcaagtattagcagaggcaaaattattatgaggctagattttgtagtagtctatgaaacggctattacatctgtgcctgaattattaactcaaattgaagcattaatattggagacacaaaataagcgctagaattttggaagtatttttgcaatttgcaaaatatttgcgaaatcccaccgcttttgtcattaagaaaatcttattttttcgatctgcgtcgaaaaatgaaaaatatcaacttttcttcttataccagctttctataatgccttttcacttatctcaaaggcagatttatgttacatctagaaagctatcaaaattggttaaaatcacttaaatatcacattcaccactcccagcaacgagctatgcttgcggtaaacagcgaaatggttttactttattggaaaatcggacaagaaattttacagcggcaacaaagcgaagggtggggagcaaaagtcatcgatcaactttcacgagatctcactgcagaatttccagatatgaaaggtttttccagtcgaaacctgaaatatatgcgaaaatttgctcaagaatggactgaatttgaaattgtgcaagaggtgcttgcacaattaccttggtatcatcaaattgctttactagataagctgagtgatgaacaagaacgcctttggtatgctcgcaaagcaattgaaaatggctggtctagaaatatactggtacatcaaattgaaggtcagctattttaccgtcaaggtatagcaatcacgaattttgacaaaaccctgccagatacacagtctgatctcgcaagacaagcctttaaagatccctatattttcgacttcttaaatttaacggaacaacgccacgaacgtgaattagaacaggctttaaccaaacatattacacaatttctattagagcttggtgctggatttagttttgtcggaagccaagttaagttaaatgttgggggtgatgatttctatattgatttactgttttatcgcttaaaattacgttgttatgttgttattgaactgaaaacttgcgatttcaaacccgagcatatcggacaacttaatttctatttgactgtcgtcgataaccaactaaaaacagagatagatacgccgacgattggactattgttgtgtaaaaatcgcaataaagttgttgtgggagaggctccccattacccattggcgttgcagaatatcaacttcagcaactgttggctgaatttgatatggaataatcctacttcagttctgcgttaggcaatcaatacaaacggtgaggttttgaggtatttttgtaatttgcaaaatatttgccgaatctcatcgttttgaattaatcagacagacacatcattttaaacgagtctgtctgattaggtttgctcttctacagataaagtatatcaattttagtttctatatgctttatccattgccataatcacttctcgcacgacctttttttgttcttttggtaagtttaggaacattttaattaccgtttgatcttgatagcttgtggcttcttcccaaagatgcttacttggctctttttctactctatctaatttataagctaattcttccgataccaaatctgtcacaggtacatttagccattccgctaatgttttaagtctggcggatcttggtaatgtttcacctcgtagccaactggcgaaagcatgtaagccaatcggtttgccgtaatgtcgtaaattaaattcacgttctaataccgaagccataggtttataccctctttcaattaagagagcttttagtttttctgcaaaaagttttttctcgtccatgttgctaagttaatttttaacttaatttttaacgaaagattgatcaaaacttacgtagatattatgatacttacgtttttacttacgttaataattaacttgaaaattacgttctattatgacaatccaaatcaaatccaaacaacgtgtttccgatcacggtgaagtatttactcgaaaagaagaagttaatgccatgttggatctcgtcaaagatgaaacgttaagaattgatgcccgatttttagaacccgcttgtggtgatgggaattttttgattgagattttaagacgcaaattggcggtaatagaaaaagattacgccaaatcacagcgagaatatgaattttacctagtgattgccattggggcgatttatggcattgagttacaacaggacaacgtacaggcttgccgtgagcgactttgcaaatttgccgaacaatcttaccgcttgctatttcccgaaacagtaaacgataccgtcatatccgtgattcgctttattttgagtttaaatatcgtgcaaggcaatgccttaaagatgtgctatgtcgatgaaaataatcaggatttagaacatcaaatgatccgtttttccgaatggtcttttttttcttggcggagaaagtggagtttaaaacgccatgattttgaatatcaacatttggtgtttgatcgtgccgagccgtatcagtctattcaagaatatttgccttgttattttttagagatccaaaatgcaaaacctatcgattaactacaatcctgacgtattatcttgtttggcaaatttatctaatgatgaagtgtttacttcgcctgaacttgctaaccgtatgttggatttattaccacaagagttgtttagctcaaaaacatcgacttttttagatccagcgacaaaatctggcgtatttttacgtgagattgccaagcgtttgattaaaggcttagagcatgaaattcctgatttgcaaactcgcattaaccatatttttaccaaacaaatttttggcttagggattacggaactaacttcattattggcacgccgtagtctttattgtagccgttcggcaaatcatcaatatgccctttgtactgaatttgacgatccgcaaggcaatattttctatttacctttgcaacacagttgggaaaatgggcgttgcttacattgtggggcaagccaacaagtttacgatcgtgaagaacatttagaaagccacgcttatgcttttattcatcaacctattcaagagattattccaaattgtcctatgaaatttgacgttattatcggcaatccgccttatcagttgagtgatggtggggcacaagcgagtgcgaaacctatatatgatttatttgtagagcaagctaaaaagttaaatccacgatatttaacgatgattattccttctcgttggttcactggtgggaaggggttagatgcctttcgtgacgcaatgctttcagataatcgtatttcaactattcacgattttccgaattcacaagattgctttacgggagtagaaataaaaggtggagtttgttacttcctttgggatagtcattacaagggagattgtaaggttattacccatgctaaaaatgaaattgtctctgaaatggaacgaccgttaaaagaggaagggctagatttctttattcgttataacaatgcaattactattttaagaaaagttgctgaatttaaagaagaaagttttagccaacttgttagtgcaagaaagccttttttcttccctacaaattttaaaggaaaaacgaccgcttatagaggtattgataatgtaacagtctatcaaaataaaagtattggttacgtgaaaagagaagatgttgttgtaaataaacaatggattgatgctcataaattatttgttcctaaggcaataggctctggcgatagtaaaactgactgggtcaagccgatttatgcaggaatgggaacagtctgtacagaaacttatttgttaataggtacatttgatagtcaaaaaacgtgtgaaaatgtgatgagttatatcaatacgaagttctttcactttatgttgacgataaagaaaaatactcaagatgcaacaaaaaaagtttatgagcttattccaacacaagattttactaaaccttggacagaccaagagctttatcagaaatataacttaacggaagatgaaattaactatattgaagcgatggttcgtccaacgggagagaaagaatgagtgaatttatttctgaattacgtaccccaaaagtttacgcatatagcgacagtcgtttcccccattgcttaaaaatcggctataccacaagagatgttgcacagcgagtggcggaacaatatcctgtgaaattgcccaatcaaagctatcaagtggtatttgacgaacgtgccattcgtgatgatggttcaagttttcgagattacgatctccacgctgttctgcaaaaaagaggggttgaacgtttagagggcgagtggtttaaatgcgatttaaacgatgtgaaatctgcttatttaaaggttaaaacaagacaagcggtcgaaaaacagcggacttttgcatttggtatgcgacctgaacagcaagaagcggtaacgaaaacagctcaatactttcgttcgtttcacaacgatgaaaataatcaagaaaaaacaccgcattttttgtggaatgccaaaatgcgttttggtaaaacctttgctgcttatcagcttgccaaagaaatgggttggaaaaagattttggtgctgacttttaagccagcggtacaaaatgcatggcaagaagatttgcaaaatcaccttgattttcaaggctggcgatttgttacccacggagatgaatggcaaagtgcggtggattttccacaaatttgtttcggttctttccaagattatttgggcaaaaataaagcaggcggtacaaaactcaaaaatgagtgggtacatacaatcaattgggattgtattatttttgatgaataccattacggtgcgtggcgtgaaaaatccaaaggtttatttgaagcggaagagcaggcgttccaaaagcaacttgaagccgaagccgccgaaatggaaatggatatgcccgattattttgatgaagaaaccttgccgattaccagcaatcactttttgtatttatcgggtacacctttccgtgcgttaaattcgggcgaatttattgaagagcaagtttataattggacttactccgatgaacagcgagccaaaaaagcatggcaaggggaagataatccttatttaagtttgccaagaatggtaatgcttacctaccaattacctgaggatattcgggaagtggctttaaaaggcgaatttaacgagttcgacttagggcagttttttgaagcaaaaggaacaggcaaaaacgcaaaatttaaatatgaaaatgaagtacaaaaatggcttgatttgattcgtggtgctttgcgttcaaccacaatcgataatctcaaattaggtgcagaaaagccaccaatgccttttggcgacagccgtttattaggcagtttgttgcacacgctatggttcttgccgtctgtggcttcctgttatgccatgcggaatttattgactcaaaagcaaaatcagttttatcacgaatatcaagtgattgtcgccgcaggtaatgatgcaggcatgggggcagatgcgattattcctgtacgaaaagcaatgggtgaaccgctgaacagtaaaaccattacactctcttgtggcaaattgactacgggtgtttctgtcgcaccttggacagggatttttatgttacgcaatttaaatagccctgaaacctatttccaagcagctttccgtgtgcaaacaccgtgggtattacgtggacacaatccaaacgatcccaataatgaatgtatcgtcaaagaagattgttatgtgttcgattttgcccctgaccgtgccttaaagcagttggcggattattgtgtgcgattaaatacagacgataaaaatcctgagcagaaagtcgcagagtttattcaattcttgcctgtgcttgcttatgatggcagttcaatgcgttctattgatgccgccggtattttggatatggcgatgagtggtacaacagcaacgcttttagcacgccgttgggaaagtgctttattggttaatgtcgataatgaaacattaagtaaattacgccacaatgaagatgccatgaaggcattaatgagtattgaaggttttcgttctttgaaccaagatattgaaaccatcatcaataagtcagaaagcgtgaaaaagacaaaaaatgcagcgaatgatcgtgaattaacgcctgatgagaaaaaaacactcagtgatgacgaaaagaaagagaaaagtttacgaaaacaagtacaagaaaaattaatcaagtttgctacacgcattccgatttttatgtacttaaccgacaaccgcgaatacagcttaaaagatgtcatcacacaacttgaacctgaacttttctataaagtaacaggcttaacgcaaaaggactttagcttattggtcagtttaaatttatttaatagcggacaaatgaatgatgctgtgtataaatttaagcgttatgaagatgccagtttgacctattcaggcttaattaaacatcaagaaagccgaattggtttatatgacaccacaattagtattcaagagtacagaatggattaaggggttcttctttatttcattgatacaatatcggatttttctattaaaaatgctagaaaatagcctgtatactgaaacatacaggctgattacaaaatttaaggcatagcaaaaaatcactgctatgcctaaattttgtaaataatttgctcaatcccaccgcttacccttcaaagggattaaacaacttcacacctgtgcgagcaaaatcagcggaatttcgagtgactagcgttaagttatgttgaattgcactggcggctatccacgcatcattttcgggggcgtgatcagggatatgtaatttggcacagatttgggcagttttttcgtctattttcaggattttgccatcaaaagcaggtttgatctcaaattcaaaccagtggcgtaacatttcaccttgcagtgtatccttatgctcgattgccatcacaccacgttctaattccatcatcacaactgcattagtaaacatcaactcttttgatgttgtcattacccactgtgccaccccttgattacatttacctttaggtaattttctaatttcactgattaaattagtatctaataaatacattttttcccctactcagtaaaatctacaggacgacgttgagctttgctgcgaggttgcaactcaaattcaatatccgctacattaggattacttgggcaaagtgcatctgcaatactcacaaacggcttcgcttgctgtactttttcatattcccgatatgtcattaacacaaatgcaggtgtaccacgattggtaatgatcacaggttctagcatagcggctttttgagcttggctagaatgttgattaaattcacggctggtcataatcggcattttgcatcccctcttaatgtagataagtagatacaatattactgcgattgacgaaatagggcaagcgtaaaaagtggaatatgatttataccttttaattactcttattttgttccagcgttcaaaccatttttacgttacaataatgtcattcaacaaaatgacttttgattatcaacaatgaaaaaactcaacattatttttgcaggcacgcctgattttgccgcaacccatttacaagccttgttaaattcggaacataacgttattgctgtttatacacagccagataagcctgctgggcgtgggaaaaagctacaagctagtccagtcaaacagttggcggaagcgcaccatattcctgtgtatcaaccgaaatcgttacgcaaagaagaggctcaggcagagttacaggcgttaaacgctgatgtgatggttgtggtggcttatggcttaattctgccagaagcggtgttaaaagcaccgaaatatggttgcttaaatgttcacggctcgttgttacctcgttggcgtggggctgcgcctattcagcgttctatttgggctggtgatacggaaacgggcgtgaccattatgcagatggatattggcttagatacgggcgatatgttgcataaggtgacaacgccgattttagcgacggaaacgtcagcaagtctttatgccaaacttgccgagcttgcaccacccgcattgcttgaagtattaaacggtttaacaagcggtcagtttaagcctgaaaaacagcaagacgagcaagcgaactacgctgaaaaattgacaaaagaagaagcaaaattagattggaatatgaccgcttgtcagcttgagcgtaatatccgtgcctttaatcctgccccgatggcatacttaactctgatggtgaatgaagtggaagagcggataaaagtgtatcaagcggaagtgctgccacatcaagagaaaacggtcggcacggtgttggcggtggataaaaacggtatccaaattgctactcaacaaggggtgttaaacattacccaacttcagccagcaggcaaaaaaccgatgtccgtacaagattttttaaacggacggggggattggtttaaggtaggaagcgttctctaatgaaaaaacattccactcgtgccgttacggcacagattattttacaggtgttggatcagggcaaatccctttcaaccttgatccccgaagcacaatcgcaacttgatagtaaagatttagcgtgggtacaggaaacgacctttggtatttgccgtgtgttgcctcgtttagaagcgattatcaaattattggtagaaaaaccgctgaaaaacaaaactcgcttggtacattgtttgcttttggtgggcttgtatcagctactttatatgcgagtaccgccccacgccgcagtagatgaagtggttaatgccacaaaagcgttaaagttggatagctttcgagccttgactaacggggtgcttcgccgttttctgcgtgagcaagaagcaattttggcgaaagtggataaacattggcaaacactacaccctgaatggttggtgaataagctgaaacaagcctatccgaattggcgagagattgttgatgcgaataaccaaaaaccgccgatgtggattagggttaatgctcaacggactaaccgagcggactatgtggcattgttgggtgatcttgcaaaaaatcacaaagaagcgaccgcttgcgtgcctgattgtgccgttttattagataaagcggtgtcggtcagccagcttcctcactttgaacaaggttgggtgacagtgcaagatgcacacgcacaatggtctgccgaattacttgacgcacaaaatggcgagttgattttagatgcctgtgcggcaccggggggcaagacaacccatattttagaaaaagcaccgcaagcaaaagtaattgcattagatattgaagaagcccgtttagttcgggttaaagaaaatttagctcgtttaaaccaaacggcaacggtgatttgcggtgatgccagccagcctgaacagtggcttacaagcggtgagatgttcgataaaattttacttgatgccccttgttctgcaacgggggtaatccgtcgtcacccagatattaaatggctacgcaaagaagaagatattgctgagttggcagaattgcagggaaaaattctcaaagcactttgggcaaggctcaagccaaacggtgtgttgttgtatgctacttgttctgtgttaccagaagaaaacagtcagcaaattcagcactttttagctcaaaccccagaggctaaattagtcgaaatcaatgtgggtggcgagcaatgtttaatgaagcaattctttcctaaacaagatgggggagatggatttttctatgcgaagttagtgaaacaggcgtaaaacggtgagtaggcaatgaaaatcatcattttaggtgcagggcaagttggctcaacactggcagaaaatttagcgaataatgataatgacatcaccattattgatgatgatcagcaacgtttagctcaattgcaagataagcacgatttacaagttattcgtggtaatggggcttcacctcgtattttacgagaggcgggagcaagtgatgcggatttattggttgcggtaacaaataatgatgaaagcaatatgattgcttgtcagattgcatatacgctctttaatgtaccaactaaaattgcccgtattcgtaattcggattatgtccgtgagcgtgataccttatttaataacgccgtattgcctatcgatcatatcattgcacctgaattattagttacacaggatattttacgccttattgattacccaggtaccttgcagattgcccactttgccgatgaattaattagtttggtgagtttaaaggcgtattatggcggtccgttagttggctaccctatttcggcattaggcgatcatttacctcatgttgaagcccgaattgtgtcaatcttccgtcaagaaaaagcctttattcctcaaggttcaacgattatcgaagctggtgatgaaatcttttttgtctgtgctacgcaacatatcaaagcggtaatggcagaattacaaaggctggaaaaaccacataagcgagtaatgattgtggggggcggaagcattggaattgcacttgctaaagcacttgaggatcgttgcagtgttaaactgattgaacgaaaccaagaaagagccgaaaagcttgcttctaagctgtctaagactttggtgttatgtggcgatgcgtccgatcaagagctgttatttgaagaacatattgagaacattgatttattccttgctttgacgagcgatgatgaggcgaacattatgtcgtctttgttagcaaaacggttaggagcaaaaaaagcgatcgttttagtgcaacgaatggcatacctacaccttattcaaggcggaactattgatattgctctttcgccacaacaagcgacaatttccgctttgtcaagccacgtccgcaaaggcgatattgttcatgtagcttcgtttaaacaaggtttaatggaaggcattgaagtgattgctcacggcgataaagaaagctcaaaagtggttggtcgcaaaatcagcgagctaaaactgccacagggagcaattgtgggggcgattatgcgaaatcgtgaagtgctgattgcccataaatctacggtgattgaggaaaacgatcacattattctgtttgtgaatgataagaaacagtctgccgaagtggaaaaactcttccagttgagtgcgtttttcttgtaataagtaaggagtaatagaactagtattaacttacctatattgtatctaatacaaaatctatttcgcctctctttctagctgagatgtaagtcacaaataacgggcaaatcttcaaaataaaatagttctatgctcgcttccattttatatgctatgttcgtgtaaataacaatggataaaaataattttatacgtcatataaactccactacatatgtgtttaacaacacattctacttatcttatcaatctaaaattaaaataagtactgattttgaatgaaagagtaaatcaaatttaattattggatttctcttttaaccaccattacttagtttttatattgctaagtttgaattattagacttgatttatatcctgtcattattactatttaagaaagttaaattatcaaagtccgaatattcaagtagccaaagtttattttcggtaatttctgacgaaataaataaaaagcatcatattcggaaacgctaaaggaaaactacgcaaagcgtaaaatccgtaagataaaatggtcacaaggagagattactggtaggtacaaaatactaattgtgcataaccataatgagtaaagaaaacgataatattattctgtttataaatgataaaaagcaatctacagaaagagagggaacctcctgtcaaagatggttttatggttctacaaacggatatatcaagatatcttttttcaaaaaatgtgattgtgatcacagaattactttataagcctttaatataatatagacgaaacaggatatttaatagtatatctgatacataaatgcaaccgctgaacgatatattattaataactatttcaatcaactatttataatatattcattacatcttaaaggagaaaactatgattcttggctgcccaaaagaagtgaaagtccaagagtatcgtgttggcttaacccctgcaaatgtgcaatcttatgttgaagcagggcatactgtttatattgaacacggtgcaggtgctgaaattggtttccctgatgaagtatatcaagccgcaggtgcaactttgactgacaaagcaacactctttgcaaaaagtgatatgatcatcaaagtgaaagagccgattgaatgtgaatatcactacttccgcgaaaatcaaatcctttatacctacctacacttagccgcagacaaaccgcttaccgaaatgttgcttgaacgcaaaattcaatctgtggcgtatgaaaccatcaaaacccctgcaggtttaccttgcttagcaccgatgagtgccattgcaggacgtttggcgaccttagaagctgcgaaatatatccaaaaaaccttcggtggtgcaggtgtgttactcagcggtacagcgggtacagcaaaagcgaaagtggtgattttaggtggtggtgttgtaggcttaaatgcggctcaaattgcgatgggtatcggggctgatgtcactatcctagatattaacgctgctcgtcttgcttatatcgatcaaatctttgatatgcgtatcaaaacactcaccagctctcgtggcaatattttaagcctattaccagaagctgacgtggtgatcggtgcggtactaattccaggtgctaaagctccgcacttactacgtcgtgaagatctcaaattgatgaaaaaaggtgcagtattagtcgacgtagcaattgaccaaggcggttgctttgaaacttctcacccaaccacacacaatgaacctatctatgaagttgatggcgtaatccactactgtgtggcaaatatgccaggctgtgtggctcgtacttcaaccttaggtttaaccgactcaaccttagaatttggcttgaaactcgcagcactcggtgtgaaagaagcgtgcttgtctgatccagctttattacaaggtttgaatacttacaacggtaaatgtactttcaaaggtgtcagtgatgcctttggtattgcttataccgatccaaaagatgcattaaattaatatcaagctgtgttgtattgatcaagaacattccccctgaataatcagggggatctctcctatccaccatttagggttttccctaaatcaatctcaaattagcggttgtgttagcttgactgagcctactctctgctatttttaaaagaggtatactatgagtgaaaatacaaaacctgaacggcagtcttggtctagtcaattaacctatattttaactgtcgcaggggcgacagtcggtttcggtgcgacttggcgtttcccttatcttgtaggggaaaacggcggtggtgcttatgttttccttttctgtattgcgatgattgtaatcggtattccgatgattttagttgaaaatgtgatcggtcgtcgtatgcaagtcaattccattgatgccttcggtggcagtgcgaatggcaaaaaaatccattctgcgtggaaaattctcggctatatggggctactgggttctgtcggtatcttagcctactatatggtattaggcggttgggtactcacctatatcggtagtttagcaacaggcggcttagatctctcttcgccagtcacaattgaaaccacatctgcctactttaaagataacattcaaaacaatccattaagagttattctttatacgggcgtttttgttgcggtaaactactttatcctaattagaggtattaaaaaggggatcgagcgttctgtaaaactactgatgccactactctttgtcttcttaatcattatgattattcgtaatgtcaccttacctggtgcagccgaaggtatcagtttctaccttatcccagatttctcaaaaattacaccgaagctatttgtcttcgtattagggcaggtattctttgcactcagtcttggttttggggtattaattaccttatcaagctacttgtctaaacaagaaaatctagtcaaaaccgcaacaattacaggggttattaataccttaattgcccttgctgctggctttatgattttcccatcactctttacctttaatgttaccccgaacgcaggaccaacattagtgttccaaagcctaccgatagtgttctcacatatgtgggcaggtacaatctttgcgattatcttctttggtttattaatcactgcggcacttacgacatcaattaccatctatgaagtattgattaccgcattgcaagaaaaaaccaaactgagccgtaaacaagcgatcaccttgacgttatttggtatctttatcgtgggtaatattccatcagtacttggcgataacgtttggagcaatgtcaaaattgcaggtatgagcatttttgatgctttcgactacataagcggtaacattctctttgttttaaccgcactaggcagtgcgattttcgtcggctatgtgttgaaagatgaagcgaagaaagagttaaacaccagtgaaaaattcacaaacatttggtttagctacgtccgttatgttattcctgtactgattattgtgatttttgttaattcgctttaattaggtaatatgaaagcggtgagaaagttgtaaaaaatacaatattctcaccgcttctgtttagtgggtataatagtaaataaaatctaataaaggaggatactactaatctcttaatctatccaaaagctcgggctgagaataaccaacaaggtaaacacttccaaacgcccacaaaccattgcaaacgttaatacccattttgcactgtcgggaatttgagtaaagttactactgaccgtgcctaatgctggcccaaggttattcaaacttgcaatcaccgcatttaatgcatcgaaagtttccataccacaagcaatagtcgccaaccaacagaccacaaatacaaagaaataggctgaaaagaatgcccataccccttccacaatccgctctgataaaacgtgtttaccaagtttaatcggctgaataacatttgggtgaataaagcggtggatttctcgttttccttgcaaataaagcaacaacacacggaacattttcagaccgccgcccgttgaacctgcacaaccgccgataaaagaagcaagcactaataacaacggcaaaaaagagggccactggctaaaatcgttggtggtaaaacctgccgtagtcgaaatagatactgactggaacaaggcttgaataaaagtgacggagtgatcgtcaaaatagttataaatcaacaacaccccaaaacagataacaaataacgctaactgaaccgtaataaaaaagcgaaattcgtaatctttccaatacaaaccaagaaaattcgacttattattgcctttgtagcgatcattaaactgatcaaacaccgcaaaatgcagagcgaagttacaggaagagatcaataagaacagtaccgtaatcaagtcaatcatcgggctgttaaagtagccgatactcgcatcgtgggttgaaaatccgccaattgccaccgtggcaaaactatgggaaattgcatcaaaaccgttcatacctgccaaccagtaagcaactgcacacagcactgtcaaagagagataaatcagccacaatgcttttgccgtttctgcaatccgtggacgcattttctgctctttcaacgggccaggcatttccgcacggtataactgcattcccccaatgcctaataacggaataatggctaccgcaagcacgatgatccccattccgccgagccattgtaggaactgacgataaaataaaatcgcttttggcagctgatctagccctgtaattaccgttgcccctgttgttgttaaacctgaaaaagactcaaaaatagactcagagaaattcaaatcagggttttccaacagaataaatggcaccgcccccagcgaccctagcaccacccaaaacagcaccacgattagaaaaccttcacgggaacgtagctcttgcttatattttcgacaaaaccaccacaaagccgtaccgacactgaaattcagcacaaaggcctccaaaaacgcacgaccaccgccgtcatcataaatcaacgccacaaacgctggcacaagcatcgtgaaagaaaaacacatcaccaaaatgccaacaatacgcataattgaaaaaaattgcacagggaaatcctttaaataataagataatgaaatggtactctgctttttgcacgagtcaaatcatttgaaaaccaagatcttggtttataagcggtgagataaattttgcattttacgaagaataaattttactctgtctttgttctaatttttcaatgaccaaattggtttcaccatattcaatttaggcatactcatttgtttacatcactaattttttcgccatatcttctttaaaccattgattaatttctctcatctctcgaattttatcgtgaatttccattgccgttctaaacaatgctggtttatctgcactgactaagccaaataatacggacgagatagttactgtacttaatagcgtaacaatagaaacactatttgccgccaactttccaaacgtttcaaagcgaactgcatatgcttataacgaaaatgtaaatgatgctctaattttacaaaataagatttgttcaattccacgctcttgaattacatattttatctagctgaaataattgtctaagatattgagctactgcctcatctttattttcaccaatttgctcattatttggtaaagcctgttttaaacgaggatctgcattacccattagacagccttttcctgcttgggatagcatttcaatatcattcattccatcgccaaaagcaatacaatctttcaaggtatagcctcgtaacttgactaagtctgcaagtgtatttgctttacaaacgcctttattcatcatttcaaggcattgaggggtagaataagtaatttgtagtaaatcaccataatgatgtcgcacaaattgctcgacaggtaacaagtcttcaggcgtttttccaataaagaacactttttcagtttttttaccgtgatgttgctgaaaatctaccacttgatacataaagccagagtcttggtgatattttcgtaattgttcgatttcaatattaatgaaccatccatcgccttgatagctattaatgaagactcgcttaggatcaaagggtgtttcgctcattatcttaaaagcaatctcttcaggaatatgattttgataaagcaattcgccagaaaggttatttcctcttgctccattagatgtaactagcattgcatcactcacgccaactttactaataatatgtttaacatcagggtaatttctgcctgtagctagaaaaatatcgacaccacgttgtgaaagtttgcgtaatgtttcgatagtaaaatcgccaatgcggtgatttgcattaagtaatgtgccatcaagatcagaaataattgcacgaaaaggtaaggccatagaaattcctttatcattttgaaatggtagttaagcctaacaaatttattttatcatcgcaaaagaaagcatacattttttgtttgtgattaagctacggttaaaaaatagcaaaataatataaaaaatactaaacatcattttttgctgaaaaaaaatgatatttatgcgttatacattacaggggtttatattaatcactagttagtctaaattttttagcatatttaactattttaattacctaaaaatacacagaaaacgtttgcgccaagtataaaatgctattgacattactccatttgaagttaatatatgttcaatttctgaataacaatgcaaacataaacacacaactatggtaaaacttttaactcttaacctgctgggattcacgcattctgtgcgaggataaggctcggttagagaaaagttcactatccacacttagcccgcacgtcaaaatgcgggctttttttatcgaatacattttaagaggtactttatatgagcaacaacattattatttttgataccactttgcgtgatggcgaacaatcattaaaagcaagtttaacggtaaaagaaaaactgcaaatcgcacttgctcttgaacgtttaggagtagatgtaatggaagttggtttccctgtgtcatctgctggcgattttgaatcggttcaaaccattgctcgccatattaaaaatagtcgagtatgtgctttatctcgtgcggttgataaagatattgatgtcgcagcagaagccttaaaggttgctgaagcatttcgtattcatacatttatagcaacttccgctttgcacgttgagtctaaacttcgtaaaacctttgacgatgtattagatatggcagttcacgctgtaaaacgagcaagaagctataccgatgatgtagaattttcttgcgaggatgcaggacgcacaggggtagataatatctgccgtattgttgaagctgcgatcaaagcaggggcaaccacagtcaatattcctgataccgtaggttactgcttaccaatggaatacggaaacatcattgctaatgtgatgaaccgtgtaccaaatgtggataaagcggtgatttctgtccattgccataacgatttaggaatggcaactgcaaactcattaaccgcaattcaaaacggtgcaagacagattgagtgtactatcaacggtatcggtgaacgtgcaggtaacacagcacttgaagaagtggtaatggcaattaaaacccgccaagccttatttaacggcttagatactcgtatcaatactcaagaaattcaccgtgtcagccaaatggtcagccaactttgtaatatgccaattcaaccgaataaagcgattgtggggtcaaatgcatttgctcactcatcgggtatccaccaagacggtatggttaaaaataaaaatacctatgagattatgtcgcctgaaactatcggattgaaaaaagagaagctcaatctgaccgctcgttctggtcgtgccgccgtgaaaaaccatatggaagagatgggctatcaagaaagcgattacgatttagacaaactttatgagaccttcttaaaactggcagataaaaaaggtcaagtttttgattatgatttggaagcacttgcatttattgatatgcaacaaggcgatgaagatcgtttagcccttgatgtatttaccacacaaattattagtggtttgccagcttcagcctttgtgcaagttgagttagatggtaaacgtgtaagccaagtttcacaaggcggtaatggtcctgttgatgcggtttataatgctattttagcgattacaggtatggaaattaaaatgctcaactataacttaaccgctaaaggcgaaggtgctgaagcattaggacaggttgatattgtcgtagaatatcaaggtcgccgtttccatggggttggtttagcgacagatattgtggaatcttcagcaagagctttaatccacgcaatcaatgcgatttatcgttcacagaaagtggcggatttgaaggggaaaataaatagtcattttcttaaaaattagcttaagtttatctgtggttgagttaaaatttcgtgatataaaaattttaatatattactgtcattgtataagggaggtcatttttgtttctacttaagaaaaaactttttgaacgcctattgcgttacgttcaaatccacaccacatcagatccgaaaagccaaactgtccctagctcaccgcaacagtgggatttacttcatctactcaaaaccgaaatggaaacgatgggattaaccgagatttccgttgatcccaacggctatgtgtttgcaacattgcctgccaatagcgacaaagccattcccgtactcggtttactggctcacgttgatacctcccctgatttcaacggcgagaatgtgaagccacaggttattgagcggtatcaaggcggtgatattttgctaaaaggcagtgggcatacgctatcgccacaggatttcccgaacctaaacggcttagtcggacatacgctcgtgaccaccgacggcacaactttgcttggtgcagatgataaatctgggattgcgattattctgtcagcggtagaatacttgttagcacaccctgaaatcaaacacggtaagatccgtatcggttttactaccgacgaagaaatcgggcgtggagcggatcattttgatgtcaaagcctttggggcagatgttgcctataccttagacggcggaccgcttggggaattacagtacgaaaactttaatgccgatgcggcaactgttacgttctacggacgcagtgttcacccaggcacagccaaaggcaagatgatcaatgccttagagcgagcttgtgagttccaaaacagcctaccgccacatttaacccctgcaaccagcgaagggcgtgaaggctttattatgttgcacgacattgaaggcgatttaagcgaatgtaaaatccactatattttacgcagttttgagcgtgaagaattagcaaaattcggcacttatctcaccgctacaatggcacaaatgcaacaaaaatatggcgaacagtgcggtaaagtagagattgtcgagcaatatcgcaatatgtacgaagtagtcaaagattatcgctatctggtggatattgctgaaaatgtgatgaaaacacagggtattacgccaaacctagagccaattcgtggcggtactgacggctcacgcctatcatatatgggcttaccaacgccaaatatttttacaggcggcgaaaacttccacggacgtttcgagtttatttctgttgatgtaatggaacaggcgacaaatgtggtggtggggattgcaaaagcctttgggggatatccgtttaaatcattatagatattcttataattaaaattatttgtagtaaggatagttacgaataagttatatcttgatcatcatagacctaaaattgaataggcgctaacattgcgcctttcctaaagtaattttttctttatctactaaatatcaaattaggcatagtagacaaaagtgttggtaaaaagtgggctaaagccttatagtacaaggctttaactcactttttgaaatatgaacaaaaaactgtcctttttgccttaagaacaatatccaaaagtatggaaagaaaaataatagagatacttttgttcgtcctgtcataaaactttttctttcacaaagaaattaaatccaatagatatttggactgattacacaataggaaaacaaacctataaaaagtcgtttatcaccgtgtcatcaaaacagaaaagacttctattacaaactcgcattgaacatacttcaagaaaaggctataggattcaatccattacaaatgatgggcgtagagggctgttaaaggatttatttaataccccaatccaaatgtgccacttccatatggtcgccattgtgatgagaaaattaagaaaaaaacatcaatcacaagcgggtaaagaattaaagattattgtaaaaacgctaaaagaaagccacaaaaatgaattttatttgagattacatcaatggtatttaaaacataaagcgtttttagatgaacggtctgaatatcccaatgagaaaggatattttccttataaacaccgtaatgtaagaggggcttatgctagtttaaaatactatatgaaatatttattcacctttgaagaatattctcacttaaatatagaaaaaacaacaaatcggttggaagggttatttaaagaactgaagcagaaattatcggttcataatggattaacgaaaaagcataagattatgtttataaaggattttttaaataaaaagagttggtaataattaggaaaaataattaaaccaagagcctctcccacaatttgtgtaaatacctgtttctgagataatacattcagacacaggtattttattatgaacgaaaaacaacttcacgccttggcagcggaatttgccaaaaacctaaaaacatcagcctagaaaaggtaaaaatgcacgtaacggttacacatctaagaccgtcatttgtaatgaatgtgagatagaaattgagacgcctcgtgaccgtgattggattgctgaaaatgaaggtgtgaagttctgggcgaatgtgctgacagagcttcaaaatcgaggcttaaaagacatttttattgcctgtgtagacggtttaaaaggcttcccagaagccatcaatgcagtctatcctaaaacgaagattcagctttgcattgtgcatttagtgcgtaacagcttgaaattcgtttcgtggaaagattacaaagccgtcactgcagatttaaagcaggtttatcaggccccgacggaagcacaggctcgcgaaaatctgaccgcactttcgcaaaaatggcaggcaaaatacccgcttgtggcgaaaggctgggaagataactgggcaaatattgccacattttttgattatccggctgatattcgtaaagcgattaaaaaacgaaatgtattcccgacggatgattcagttttcaaagtgatttggcttgcgattaaagatgcatcaaaaaaatggacaatgccgattcagaactggaaactggcaatgaatcgatttatgattgattttggtgatcgcctagacgatcaccgttaagttgaaatgggtgtttacacagaatttgggatagggtctccacttggtatagtttttgacgaatcagcaactattttgtctactatgccaattttatttgtactgtttgcaaccttgactatttatttcgctgttttcaggtcttgataatatttctcataaagttcaatcgcatcgcctacatcaacttgccaagggcttttctcaatcacttcagaacgaataaaaacagcaggatcgtcaaccaaatcttttggtaactgtgctaatgccactttatttgctgttggataaccgatagcttttgtcaattttgcagcgacgggagctgaaagcatatagttaatcagcttgtaagctccttccggattttgcgaagttgcaggaattgccaagttatcaatccaaagcggtgtgccttctttaggataaaccatattgattttagcaccttcatttttggcaattcgtacagaaccattccaaagagtaccgatttctacttcaccagaaataaatgagcttgagggattgtcagaattaaacgccaaaatatttggacgtaatttcaaaaattcttcatacgctgcttttaaaatcgcagggtcttgggtattcggatcctgccccatttttaataacgctatattaaatgcctcacgaggatcatctaacaactgtaatttatctttaaactctggtttccgtattgtatgcaatccccgttgccccaaaaagttgtggtaccgagtatttattgcctttatcaaaaggacgatcaagcatttgtgggtcaagctcacttaatacaggcaatttgctatgatctaactctttcaacattccttcacgtgccattttagaaacaaaatagctggtgggggcaattacatcataactttgatggtacatattcagaccatgtatagagataaaccgtattcccttccttcgccatgatgtgatgactaccaaaggtaagagttgccgcagataaaaccactgcccattttttcatattttttgttctccaaatagagagaaatcgtccttttatattgactaaagccatataaaaacttacctaaagatggctatgattttaggttaattgaagctgattgcaacatcttcagtaagatgctgctattctggacttcttatacctactttgcatataatccctcatcatgtaagtataagaaaaaggacgctcgaaagcgtccttatttatctattctttaaaattaaagagcagattttgctttagcaactaatgctgcgaaagccactttgtcaaatactgcgatatcagcaaggatcttacgatcgatttcaacagacgcttttttcaagccgttgatgaatttgctgtatgataaaccgttttgacgagctgccgcattgatacgagcaatccataattgacggaattgacgtttacgttgacgacggtcacggtaagcatattgtgcagctttaactactgcttggaaagcaacgcgatacacgcgtgaacgtgcaccataataacctttagcagccttaagaactttcttatggcgtgctcttgcaataacaccacgttttacacgagccattattaaatctcctactatttaagcgtaaattaacgctttgacattattaaactaaaaattaactaatcgtacgttgtacttaatttacgcttatgcatatggtaagcacgctactactaaaacttggtctgctttcgctaccattgatttgtgacgtaagtgacgtttacgtttagttgttttcttagtcaaaatgtgacgtaagtgagattgtttacgtttgaaaccgccagaagccgtttttttgaaacgcttcgcagcaccacgtactgttttaattttaggcattgttaaaataactccgcattgtttatgaataaccagtaattaggcgaatattgttgccaatattacttggaagcactaattacatctcaaggtaatggactatttctttttaggcgctagtaccattacaacttggcgaccttcgagtttgcctggggcagactctactacggcaatttccgctaaatcgtttttaacacgttctagcacgtccataccaatttcttggtgagccatttcacgtccacggaagcgaaccgtgattttggctttgtcgccatcttccaaaaagcgaatcaggctgcgtagttttacctgatagtcgccttcgtctgtacctggacggaatttaatttccttcacttgtacaactttctgttttttcttctgctcttttgcagctttctctttctcgtagatgaacttaccgtagttcataatacggcaaactggtggttcagcatttgggctaatttcaactaagtctaactcagcttcgtcagctttcgctaatgcttcttgaattgatacgataccaagttggtcgccgttttgatcggttaagcgaacttctttcacgcggatttcttcgttaagacgatgtgcgcgatttgtctgaacacgttttacaggtttaatagtactattcctctagtaagtttaagctacgatcataccgcttgcagaagatatgatttctttttataggctcttctaaagagagcaaaacgggcgagattctacagaaattcatttgattatgcaatagtcaaaatcatttcattacattctcagcaaaattgttgatattccattataataagcactatcttaattacttaaattaataacaataatgaaaattctcggtattgaaacttcttgcgatgaaaccggtgtggcaatttatgatgaagacaagggattagtcgcaaaccaactttatagccaaattgaaatgcacgctgactacggtggcgttgtgccagagctggcctctcgtgatcatatccgtaaaacattgccactcattcaagaagcattaaaagaagctaatctcaccgcttctgacattgatggcgttgcttatacggcaggccctgggcttgttggggcgttattggttggctcaaccattgcacgatctttagcttatgcgtggaatgtgccagctttaggcgttcaccatatggaagggcatttgctcgcaccaatgttagaagaaaacgcccctgagtttccttttgtcgccttacttgtttcggggggacacactcagctagtcgatgtaaaaaatgtgggtgaatatgaattgttgggggaatctattgatgatgctgcgggggaagcctttgataaaactgcaaaattgctcggtttagattacccagggggggcagcgttagctaaacttgctgaaagtggcacgccaaatcgttttacctttccacgtccaatgacggaccgcccaggcttagatttcagcttttcgggcttgaaaacctttgcggcaaatacgattaatgcgaatttgaatgagaaaggtgaattagagcaacagacccgttgcgatattgcctatgcgttccaacaagcagtgattgaaacattgattatcaaatgccgtagagcgttgcaacaaacgggctataaacgtttagtgatcgcaggcggtgtgagtgcaaataaacaacttcgtcacgatttatccgaattaatgaagcagatcggcggtgaagtcttttaccctcgcccacaattttgtaccgataatggtgcaatgattgcctatgcaggtttcttgcgtttaaaaaatggcgaacagacggatttatccgtgagtgtcaaaccacgttggccgatggttgaactttgtcccatcgatgtatagtagacaaagtattataaagggtagattaagatattgtaatataaggctttgagccacttttttgaattatcaggactattcaaagtatctcgaaagcccctaaaatagcattaaatccactactatcacgttatttaaatattattgtggatacgaccttctttgatcgtgaacttggtattttagtcctgatggatttactttctaaaaaatggtttgccattgagttatcaaaacataaaaagatgtttattacaggatagcgttcaattttgtctattatgcctttattgattcgctctagaaaaagccgccgcttccgcgattaatgcatcacttggacgaatccccgtataaagcacaaattgctcaaccgcttgtaaagtcatcacttctgcaccagaaatcacctgtttgccttgagctttcgcatactgaatcaaaggcgtttctgctggcattgctactacgtcaaaagccgtttgagcctgttgaatcatcatttcagggaaagctaagtcaaattcttcttttccgcccgtcataccaatgggggtgacattgactaaaatatccgctggttgattttcaaggctattgatatattgatagccgtaaagtccagcaagatattttcctgtttcttgattacgggcatagatttttacattcgtaaaacctgaatgtttaaatgcggcaacaacggcttttgccataccgccgctgccttggacaatcacacaagcggttggatcgagctgatattttgcaattaatttctcaatcgcaatatagtcggtgttataggctttcaaatagccattggtattgacaatcgtattgaccgattcaatcgcttttgcagatgcatcaatttcgtctaaaaatggcatacaggcttctttaaacggcatagacaccgcacagccccgaatacctaaggctctcacgcccttaacagcgtgttcaatatctttggtggtaaatgctttataaacaaagtttaaaccgagtttttgataaagataattatggaaataagtgccggtgttgcctggtctgcccgatagggacatacaaagttgagtatctttattgatcataaatttgccttattgaatagaataataagtgccattatgctgttttagatgtaaaacaacaaggaagtcgtgaaaaaacaaaagccctgggtttccccaaggctttctttttgcattaacgcataagcgaaaattattcgccaagacgctctttgatacgtgcagatttacctgaacgctcacgtaagtagtaaagtttcgctttacgtaccgcacctttacgtttaacagcaatgctgtcaattacaggtgagtgagtttggaatacacgctcaacgcctacgccgtttgaaactttgcgtaaggtgaatgctgagtgcaagccacggttacgaattgcaataaccacgccttcgaacgcttgcaaacgttttttactaccttctactacccataccttaacttctaatgtgtcacctggacggaagctaggtacgttttgttttaactgttcttgttcgatttgtttgatgatgttactcattttaataaaccttctatgtcctagaattaactgatttgtgtcgtttctttatgttattcaacaacacgcgttgttcgtcagtcagagctaggctatccaatagctcagggcgtcttaaccacgttcgttctagcgactgttctaatcgccatttgcgaatttgctcgtggtgacccgacatcagcacttgcggtacaggtaaaccatctaatacttcagggcgagtataatgcggacaatccaataaaccttctacgaaagagtcttccaatgctgaagcctgtttgcctaataccccagggataaatcgtgcaacagcgtcaattaacgtcattgcaggaagttccccccctgtgagaacgtaatcaccgattgaccattcttcatctatttcagtttggattaatcgctcgtcaatgccttcataacgcccacaaaccaaaatcaatttttgatttatcgccagagtttgtacaccagcttgatcgagtttacgcccttgcggagagagataaatcactttagcttctacaccgtcttccttacaagcggttgcttttgcttcacgaattgcatcacgaagcggttgcaccatcatcaacatacctggcccaccaccataagggcggtcgtctaccgttttatgtttgtcgtgtgtgaaatctcggggattccaacactgcacttgtaagagattttgttttactgctctacctgttaccccaaaatcagtaattgctttaaacatttcggggaaaagggaaataataccaatccacatattttgacctacgaaatgcgactgctaaagctcactgcatacctgaggttagaaaccagcgtcccaatccactgtaattgttttagtggcgagatctactcttttaactacttgttcatataagaacgggattaaacgttcttgcttaccgaaagcatctttactgccagcttttaccaccaacacatcatttgaacctgtttccatcatttcggtcacagttcccattgcataaccttcaaggtttagcacttggcaaccgatcaaatcgtgccaataataatccccttcttccaattctggaaacacggctaaatccacaccgatctcggcgttggttaatagctgtgcggtttcgcggtcttctgtgccttttaatttcacaatcaaatcattgttgtgataacgccaactttcgagttcaacttgttgccattgccctttaatttttaagaaccacggctgataatcgaaaatgctttcaggatattctgtcgatgaataaaggcgtagccagccacggataccataggttgaacctaattttccgacaacttcaattttttgctcgctcatactcacctacttatttaatttgtggaattaagctgctttacgcgcttctttcactaatactgcaacacgatcagaaagtgatgcgcctttagcaacccaagcatcaactttagcaacgtctaaacgtaaacgttctgcgttaccagttgcgatagggttgaagaaaccgatacgctcgatgaaacgaccgtcgcgtgggctacggctgtcagcgacaacgatttgatagaatgggcgttttttagctccgccacgagataaacgaatggttaccataaccgtcctctaaaagtttaatgatagtaaaaaagaaaaccctcgttcgaggtgagggtgcgaaacttgttcaaaaaagagagaacaagcggtcggattatacggattttttgcaaaaaggcaagtgaaaacccttgttttatgtttacaactctagaagaaaatgcaaaacaaaaacctattctcacgacaattattttcattctgtgataggaatgatggatatgaacttatcactttcaacctataataaagaattagatattttgaatcagtgtcgtaaataatcctatcttgttatcttaaacgttatttaaaaagtagcttagttataaaactaagctactttctcaaatactcaaccctcacatttaaactcgctaataaaatcgcaataagcggaattacataattcattacggcgtaaggggcatattcaaatgcactaacttgtagcatagagaatgcataaataccgcaagtattccacggcactaatacggaagtcactgtaccgccatcttcaattgcacgagatagattttttgaacttaagcctttttcacggtaagcatttgcgtacatccgtccaggaagcagaatagaaatatattgttcagcggcagtgcaattagtcaaaatagaggaaagaacagtagcaataataagatgggttgttttgtgggcaatacgaagaatagtttcaacaatggacttcagcattcccgttctctccgcaataccgccaaatgccattgcaataatggtcagtgagatggtgaaccccattgcttcaatgccccctcgattgaataatgagtcaatcattgcattgccactttctattttatagccataatgtagcgtgttcaccgcgacttttatctcgccaccttgtaccacaatatgacaaagccagccaaacaaaatcccgatagttaaagcggggagtgtaggcactttttttgcaactaaaacagcaacaacgagtggcacagttaatagccacggtgaaataacaaagtgcgttttaatggctcgcataatttcggcaattttttcgagttcgacactttgagcattgaactgtaaaccgagataagcataaacaagaagagcaataaggaacgcagggagggttgtgatgtacatatggcgaatatgttcaaaaagcggcgtgtgcgtaatgcctgcggcgagattggtagtatctgaaagcggggacatcttatcgccaaaatacgcccccgaaatgaccgcacctgcaaccatcggagcggggatattgagacttagcccaatacccattgccgcaacaccgatagttcctattgtggaccacgaactgccaatcgcaagggtcactaccgcacaaataaggcaaattgtcgctaaaaatagagagggcgagatgagttgcaatccatagtagatcatcgtggcaacaatccctccaccaatccacgcacctatcgttaaaccaatcataatgatgataacgatagctggcagagaaatacgaatcccttgatatattccttgttctatcgtatgccagcgatacccaaaacagcgagcaacgatagccgcgataattgtgctaatcagtaaaggaatatggggagatgattcaaattgaatgacagcaattcccattgataccatcatcacaatgataggtaaacaggcatagccaaatggaatgtgaatttgtggttcggttgtgtgtgacataacttcctcaaacaagcggtaagaaatacagagtaatttgcttttcggtagctttcactaataggaaattttcatcgaagcgatgagagattaatttacaaggggaaattcgacagagaggggagttgtggatttattcgggagctattctaacatatttgattaatatttcattatataaaataaaaatacctgtatctcgttttagatacaggtattttttacatctcaacttaacgcttatttacgttgagttaccacttgaatgaacggagtttgtccttttttcatctgttcattcgcttgtttaaccatctcttctacattggtatgtaaatgagcggtaactttggtgtttgcttttttctctggaaccaagcgtgctttcactgtcttaccgtttacaacaaggttattttgttttgcattcacattaactggtgtgtttgtcgtttcacgtttaatgtctgcgtttaacttctagacgatattgaagtggttagcgaaagtttttacacgttactgccaaaatatcaaaatgacccgaaagcgctgtttgtgttagacccaccatatctttgcactcatcaggcaagttacaaacaggcaacttattttgatttagtggatttcttgcggttaattcatctaaccagaccgccttttgtgttcttcagttcaaccaaaagcgagtttgtgcgttatgtggacgctatgattgaagataaatgggataactggcaggcgttccaagactacgagcgtattgttgtaaatacttcgacgagctattcaggcaagtatgaagataatatggtgtataagttctaaaaataacgccctttaaaatgagtttaaagggcgtttaaatttaatctaattcagataataaacaataaaacggaggtgctgatggggcaagggttgaggtaaattgtacaacgctatctttgcgaccatcttcagtaaaacgaatatctaagaatgcaaggttatacacaaaggtttgtccccgtccatttggtaaggtatattgcgatccgtcaatggtaaaacgttgttcttctcttaccgcaactaaggctaactctaacatcatttcttgctcagttctcattttgaaggttgtcattttaggctctcctgttttgcttaagtgacgacaggattactctgttagccctgcatagcaagtttagtttgagtaaaaacaactgagtgcggtgtatttagactggggaggtgtggacggctggggtgggcaatgttctaaagatatttgcactttattttgcatagcaatatgatttttatgctatgcaaaatgttttgtgaagttatgcagaaaattttgcgagtttataatgcaaagctgaatcttcgttttagataaccaagatggtcggtcagttcaccatttaacgcagcctcgacggtgattttcttgagcatccgtgaaaattgattgaggtcttctggtgtttttaggtttttggcaaattccgctgccaaggcgtgaagttgtttttcgttcataataaaatacctgtgtctgaatgtattatctcagaaacaggtatttacacaaattgtgggagaggctctcggctgagtttttatttctctatgtgtaatgccttttcattttttatttcacattattccgtttaattcaattttttccctaatttatcttacttatttaatgatggttatgttggattggtttaacttgcagaaacgctcacacttgtttcgctgactttattcacaagtcctttgctgattaagtcgcctgtcacagtaccagaaacagtgtccgcatttaatgcactacctgttaagagtgcattaccacctacattgaggttcgcagtttcactattaactacggtacttgtgtgggtttgattgcgaataacattcacatcaagggaagcactgccgccatttggtgtccatttttgttctgctacaccaccatttaatgagagtgttgcacctacgcctgttttcttcacattatcctgtaaagcggttaaagcaaggttgccattgccactgtttagggtcacatttttcgcatctgcttgtacgccagtaagggtaatgtcatttctgctttgaatattcagattttgagcggtaacttgacttgcagtatggctattagaaacttcatgatgtactttcaagttcgcatttaagcctaaacttgatgcacctttacctaaggatattgccgtacccactgcaacatcagtgagttgtttatcgcttttcgctgccacaacattgacggtctcaccgcttaagttgatgttgtccgccgccaaacttgtgccttgtactagcgtatttttaccgctttgaatggtgattgattgcccttcaactttagcggtaaccgcatcttgtgtgcgaccatttacggcatttactgaaacacttgcatcaacgcttggaatagcagcacttgcggcaggaacgactaatgcccctacgccaagatctgctttaaagcctacgccattttgttgctctttattcgttgcttgagcaaaggttgcactctctttcgccaccacgttaatgttgccatctgctttcatatccgcttggctgtaaagcgtgtttgtatttaccgcaatgttattcgcagttaaagaggctttttgagcttgctcagaagcggtctgattttgttggtaatttgcacctacattcactttcagattaacggttttgaggtcgctcgtgttgccactaacgccgatatttacccctgccttcattgtatctttactgctgctatttacggctgcttgtaagttatgttgttgagagttaagggttaaatcgccaccagcttgatattgtgttgcagtatcttgcaaggtttgaccgttgatcacaatgctattgccggcattgagagtcgttgcttgtgctgtggtgctttggctgttttcacgaccacctgaagcagataaggtgacagaactgctgatcgctttatctttgttgatcgatgaagcgaccgacaatcctacgtccacatttttggtgcgatcattttgtgagttcgttgccacagaatgttcgatatgttctgcaccttgtgcaatgttattgcctgcagaaagttgtgaaccttgatgttgaatacgctctgcctctaaagtgaggttttgtttcgcacttaattggctcgcttgtgcagtttgtgtttggctattctgttgtttgtggttataaatgcctaaggtaatgctgccttgtgcttcaaattgagtattgcctttaacaacattaagtgcgtttactgattcgcctttgatcagtgatgtgataacaccacgtagtgccgcttcggtattaaaggtcacttttggcttatcgccttttgcggaaataccaaatccagcttcttctttcattgataaactttggtttttcgccccaatcacttcaacggttggtgcataaacccctaaagtattcaccgcttgcactttactaccaatcacgttaatgccttttgttgaaatcagttgtaagtgtttttggtcgcttggctgacaaattcagctttacctttattttgcacaaagagttgaccgtcaatttgacctttcaccgcactcaaatgtacatcgctgccacctacgctaaggtttttaaattgtaattcacttgccactaacgcttgggtattggctgtttgtgaactagaacctgtacgcaagcgggcagtttcattttttaaatttgcttgtcgcttcagcttgtgttgtttgtgtaacaccttttaatgcaacgcctttatcaccataaacaaaagcatcttgccctgctaatttaaccgcattccccgttacttgaccttttgttgctaccacattgagtttatctgcagtcacagtggtacggtgaacagtttgagctttagttttatcggtttcttcacggaaccaaagacctttagattgatgtttacgtgcgttactttcgttcgttgtgatttgtgtaccaaaatgggtttgaccaccgatgatactcgcttgtttcgcttgaatatctgccccagaaacatttaaacggttatccacatcgacaacaagattatccgcttggattttggttgcttgatatttttcatttttgccggaacggtactcttctactttaacgtttttgtctgcagtgtagtggttatgttgacagtgggtgctagcggtcactttcccctgaacatttgcattgccagcttgaactaaaacatcttttgcctcttccacctgaacggttaatttgccgtctttgttctttttcccacatctgtgttttttctcgttgcattttgcctttaacccattgaatatccgacttccacgtagttttagctaactgaagtccagcaccatagccgaaagcacgttggctatgagcgttatcactgctatttttctgtacccccagatcaaacaaggcgtaaggctctatttgtaaagatcgatagttatttaaccaacttaacgtattttgcataacaaggcttttttctgccgagagcgataaatcttggaagcctcttactgcatatcgtcctaataaatccgcttgttctgtggctggcaaataatttgaactatactgaccaaacaagcggtgagattggcggaatttttgcgaacctaacaaatgaaagtaactcaactgtacatcgccactccatttttggaattgcccttcaggctgatctcgtccttgatttttaatcgcattccaccaagccaatccccgacgataatcaaggttaaagatcaacgaaccttgcgacagtagctgtaagtggttaaaagagaattgtgcaacgctcaatttagggctttgtaactcgatcacactgtcctcaaaacgacttttactattcagatgttctacttgtgcagaaattgtggaaatatggtttgcccctcgatgagcaacataatcaacttccaccccagcctgccacgttcgacctttttgctcgacattatgataaaccaacggaatttgtcggcgaaattgcgaaacagaaccaaagctgttaaagctccaacgcccataaggtacggaataatataaaattgcagagcgattaaattccggtgtcgattttaacgtgtggcttccgcccaaataaaggctatctgacagtccaaatgggctatctacatttaacccgaaacggctttgccaacgatgatattggcgtgaagcaaaattatctacaccaatataaccggaaacagcaggcgagggattattgacaaaagagagttcgatctcgccattttggcaggtaatacatcgacagaaacttgattgctactcaaacgattcgcttgatctagcccctgatctaattctttgatatttaatggttgacctacaatgttaggaaacagcatggctaagtttacttgcgaacttccccccgtcaatttagccactttgccttcggttactcgtaaaatcagcgttttcgaaccatcatcttcaaattgaaatggattgtgaatatagcccttatccaaataggcttgcgttaaatctcggctaagttgattaaggcggttttcatttaaacattcgtagggcaatggctgaaatgaaaggggatcgattaaagttacacccgttatctgtaacctattgtaacgtaagcaataatgttcggttgccgtactgttatcctgtgctttagtctggctttggaattgatgttgggaaacccaacgagattgttgatgttgttggatttgttgtaattggtgttggttttcttgttgggaacgaacaatttcatcattcgcccaacaatttaaactcaataaactgactaaaatagcaatggaagatactttcataaagcctgcttcgataaaataaataagtgcattttaatcatagaatatcaaaaatgcctagtcttccgcgatgttattgagagatgggtcacaaaatttggttgtttttattcatgtaaaatagttgcgccaatgattattaatcctaatacttttttaaagtagtgaatgaggagaactcctactctctaatcagggcaagatcgcatctttctcaaatttatgatctaatacaccttaattatccatatcaaatcaggttgtaaaatgagcgtttttcgtttttttgaaaatttatccgacccacgagcctataatcaaaaacaccactttttagacatcgtttttctcgtcgtcagtgccgtgatttcgggggcaaacagctggactgaaatcaaactttttggcgaattacatttggattggttgcgaaaatatcgtccttttgagtgtggcattcctgtcgatgatactatcgcccgtgtaataaaacgcattgagccacaagcatttaatgaggtttttcttaattttatcaatgagatacgcacacaacaaggacgtgaagtgattgcgattgatggcaagacacttcgtcatagtttcaatccggaaacccaaagtgctttgcacagtgtgacggtgtggagccagtctcgtggtttgattttatcgcagaaaaaatcctcgggtaagcaaaatgagcagcaggcggtgatggaaattatcgatagtttttgcttaaaaaatgccgttataacggtggatgcgatgaatacacagaagaaaattgcggagaaaatcatcgaaaagaaaggggattatgtgatgccgttgaagaaaaatcaccgtcaatttcagtcggaagtggaggcgtattttcacaaaatccgccgagattgccccgaaatgcttgagacgtatgaggaggtaaatgcggaacgtagtcgaattgatgagcgttactaccgtaagctgaaagtgagtgattggctgagcaaagcggaggaatggaaggggataaaatcggtgttggaggtgtgtcgcaagcggtcagataatggcaaagaatcacaagaaaaagtcttttatatcagtagtttggatgttgatgttcaaatattggcgaagtgcgtgcgagggcattgggaagtggaaaacaaagcccattgggtgctagatgtggtctataaagaagacgaatgtgctgtgaccgatgaatggggtgcggaaaatctggcaattttgcgtcgattagcgttgaacttggctcgattgcacccgaaaaagcagagtatgaaagggaaattgaccgctgctggttggtcagatgaatttcgagatgagctgttgctcggtgtgtaggttgaaaaatggacaacatatgcggttgccctgactctctaatgcattctaataaaattcagttgatcttattacgctaattgcgatataatccgcaacctatttgcatagggtaaataggttcgtcccgaaagggtgttttttattttaacggagcactaatatgatccaagaacagactatgctggatgttgctgataactcaggggctcgtagcgtaatgtgtatcaaggttctaggtggatcgcaccgtcgttacgctgctatcggcgatatcatcaaagttactgtgaaagaagcaattccacgcggtaaagttaaaaaaggtgatgtgttaaaagcagttgttgtgcgcaccaagaagggtgttcgtcgcccagatggcgcagttattcgtttcgatggcaatgcttgtgtaattttaaacaataacactgagcaaccaatcggtactcgtatttttggacctgtgacgcgtgaacttcgttctgagaagtttatgaagatcatttctttagctccagaagtactataaggggagaatgtaatggctgcaaaaatccgtcaaaacgatgaagtaattgttcttgctggtaaagacaagggcaaacgtggtaaggtaactaaagtgttaccaaacggtaaagtggttgttgagggtatcaacattatcactaaacacgaaaaaccagttcctgctttaggtaaagctggcggtttagtgaagaaagaagctgcgattgatgcgtcaaacgttgcgattttcaacccagaaacaaacaaagctgaccgtgtaggatttagattcgaagatggcaaaaaagtccgtttcttcaaatctaacgagaaaacaatttaattaactggagtaatgcgatggcgaaactgcatgattactacagagatacagtagttaatgaattaaaagcaaaattcaactactcatctgtcatgcaagtcccacgaatcgaaaagataaccctgaatatgggtgtgggtgaagcattgaccgacaaaaaactgttagacaacgcagtagcagatttaacagcaatcagcggtcagaaacctttaattactaaagcacgcaaatctgttgcaggctttaaaatccgtcagggatatccaatcggatgcaaagtaaccctacgtggtgaacgtatgtgggaattctttgaaagattgattactatcgctgttccacgtatccgtgacttccgcggtttaaacgcgaaatcattcgacggtcgtggtaattacagtatgggtgttcgtgaacaaatcattttccctgaaatcgactacgataaagtagatcgtgttcgtggtttagatattactattaccactacagcgaaaactgatgaagaaggtcaagctttattagcggctttcaatttcccattccgtaaataaggtaggttatcgtggcaaaacaatcaatgattgcacgtgacgtaaaacgtgcgaaattagctgataaattctacgctaaacgtgaagaattaaagaaaattatttctgatgtaaattcttcagacgaagatcgttgggcagcagtgttaaaattacaaacacttccacgcgattctagtccaatccgtcagcgtaaccgttgccgccaaactggtcgtccacacggtgtacttcgtaagtttggtttaagccgtattaaggtgcgtgaagctgcaatgcgcggtgaaattccaggccttaagaaagcaagctggtaataacctcttttaatttggaatcatgggagtaaatacatgagcatgcaagatccaatcgcagatatgctgacccgtattcgtaacggtcaagctgcgaataaagttgcaatcagtatgccttcatctaagttaaaagttgctattgcaagcgttttagctgaagaaggttatgttgagagcttcaaagttgttgaaggttcaaaacctgaattggaaatcactttaaaatatttccaaaacaaaccagttgtagaaagtatccaacgcgtaagccgtccaggtcttcgtatttataaacgtaaagacgagttaccaaaagtaatgggtggtttaggtatcgcagtggtttctacatctaaaggtgtaatgaccgaccgtgctgcgcgtcaagcgggcctcggcggtgaaattatctgttacgtagcataatagtgaggtaggaaaaatgtctcgtgttgcaaaagcacctgtcgctgttcctgccggcgttcaagttactttgaatggtcagctattaacagtaaaaggtaaaaatggcgagttatctcgcgaaattcacaatgcagttgaagtaaaatacgaagctgatactttaacattcgctccaagagcgggtatcgttaatgcagatgcgcaagcaggtacagctcgtgccctcgttaatgcaatggttatcggtgttactgaaggctttactaagaaattgcaattagtgggtgttggttacagagctcaaatgaaaggcaacactgttgcattaagtttaggtttctcacacccggttgaacatgagttgccagcaggtgtaactggtgaatgtccatcacaaactgagattattcttaagtctgcggacaaacagttaatcggtcaagtggcagctgatattcgtgcataccgcaaaccagagccttataaaggtaaaggtgtacgttacgctgatgaagttgtacgtattaaagaagcgaagaaaaagtaaagtaaggtaacactatggataagaaagtagctcgtatccgtcgtgcaagccgtgcacgtcatttaatgagagagcaaggtgcaacacgtttagttgtgcatcgcacacctcgccatatctatgcgcaggtgattgcaccgaatggctcagaagttttagcagcagcttcaactgttgagaaagtaattaaagagcaagttaaatatactggtaataaagaagcggcagcagtcgttggtaaaatcgttgctgaacgtgctttagaaaaaggtattaaagcagttgcatttgaccgttctggtttcaaataccacggtcgtgtgcaatcattagcagatgctgctcgtgaagctggtcttcagttctaatagaggaatttgagatgtcaaacatcgaaaaacaagctggtgaactgcaggaaaagctaatcgcggttaaccgtgtatctaaaaccgtaaaaggtggtcgtattatgagtttcactgctttaacagtggtgggcgatggtaacggtcgtgtaggttttggttacggtaaagctcgtgaagttccagcagcaatccaaaaagcgatggaaaaagctcgtcgcaatatggttaatgtagcgttaaacgaaggtacattacaacaccctgttaaaggttctcacactggttcacgcgtgtttatgcaaccagctagcgaaggtacaggtatcatcgcaggtggtgcaatgcgtgcagtattagaagttgcaggtgttcacaacgtactttctaaagcgtacggttcaactaacccaataaacgttgttcgtgcaacaattgatgcactagcaaatatgaaatcaccagaaatggttgctgcaaaacgtggcaaaaccgttgaagaaattttggggtaattgaatatggctaaaactattaaagtaactcaaactcgtagctctatcgctcgtttaccgaagcataaagcaacgttgaaaggcttaggtcttcgtcatattcgtcataccgtagagttagaagatactccagcagtacgtggtatgatcaatcaagtttcatatatggttaaagtggaggaataatagaatgcgtttaaattctctttctccagctgaaggtgctaaacacagtgcaaaacgtttaggtcgcggtattggttctggtttaggtaaaactggtggtcgtggtcataaaggtcaaaaatctcgtacaggcggcggtgttcgtcgtggtttcgagggtggtcaaatgcctttataccgtcgtttaccaaaatttggttttacttctcttaaagcattacacgtagctgaaatccgtttaagtgacttagcaaaagtagatggtaatgttgttactttagatgcgttaaaagcagcaaacgtaatcacaaaagatattttatctgcaaaagtaattctttcaggtaaagttgaaaaagcagtagtgattaaaggcttaggcgtgactaaaggtgcaaaagctgctatcgaagctgctggtggttctatcgaggaataataaatggctaaacaaccaggatatcaaggtaatacccaaaaagggactggtgaattaaaatcacgattattgtttgttttaggtgctttaatcgttttccgtatcggttcttttattcctgttcctggtattgatgcttctgtattatccgagctagtacgacaacagcaaggcaccatcattgatatgttcaatatgttctctggtggtgctttaagtagagcttctatatttgcgttagggattatgccctatatttcagcgtcaatcattattcaattattgacagcggtacacccagcacttgccgagttgaaaaaagaaggcgaagcagggcgtcgtaaaattagcaaatatacacgttatgctacgttgttattagcatttattcagtctattggtatttcattagccctgccgaatatgctagctggattagttcctaatccaaatatgctgttctatgtaacttctgtaattagtttagtaacaggtactatgttcctgatgtggttaggtgagcaaatcactgagcgtggcattggtaatggtatttcgttaattatttttgcagggattgttgctgatcttccatcagtaatcgggcaaactattgaacaatctcgccaaggcgagatttcattattagtgttattactaatagctgtagttgcatttgctgtaacatattttgttgtcttcgtggaacgtggacaaagaagaattgttgtaaactatgcaagtcgccagcagggaagaatgatggcacctgcaagacaatctcatttgccgttgaaagtaaatatggctggtgtaatcccagcaatcttcgcttcaagtattattttattcccagcaaccattgcacaatggttcggaacaagcgaaggttttgaatggttatttgatttatcacagttattacaaccaggtcagccactctatattgtattatttacaatggctgtaatcttctttgcattcttttatacaggaatgcaatataatcctcgtgatacagcggataatttgaaaaaatcaggtgcatttgtaccaggttatcgaccaggcgagcaaacatctcgttatatcgataaagtaatgacacgtttaaccttaattggtgcgttatatattacctttgtttgtttggttccttatatcataacatcattatggaaagtatctttccaattaggcggtacttcattattgatcgttgtggttgttattatggatttcatcgcacaggttcaaagtcatctaatgtctttacagtatgattctgtgttgaagaaagccaatttgaaaggcttagggcaataagcccttagatcaaaaggataagcaatgaaagttcgtgcttcagttaaaagaatgtgtcgtaactgcaaagttgttaaacgtgaaggtgttgtacgcgtaatttgtagcgaccctaaacataaacaacgtcaaggttaattgacattatttcttgcaaagaacctgctgagcggttatactgctcagctcatttcgtcctgatatgctgtttgagtatcctgaaacgggcttttcaagatcagcatatcaataactttagttaaataggagtgcatagtggcccgtattgcaggcattaacattcctgatcaaaaacacaccgtaatcgcactgactgctatttatggcatcggtaaaactcgtgcaaaagcgatctgcgctgcaacgggtattgctgaagatgtgaagatcagagaattgtctgaagagcagattgaaaaactgcgtgaagaagttggtaaatttactgtcgaaggtgatttacgtcgtgaagtaactttaagcatcaaacgtcttttagacctaggttgctaccgtggtttacgtcatcgtcgtagtttaccagtacgtggtcaacgtactaagactaatgcgcgtactcgtaagggtccacgcaaaccgatcaaaaaataatcggagtagataaataatggctaaaacaccagttcgtgcacgtaaacgtgtaaaaaaacagatcgtagatggcgtagctcatatccacgcatctttcaataatacaatcgtaaccattactgaccgtcaaggtaatgctctagcttgggcaactgcgggtggttcaggtttccgtggttctcgtaaatcaactccattcgctgctcaagttgctgcagagcgttgtgcagaaatggttaaagagtttggtttaaagaatttagaagttatggttaaaggtccgggtccaggtcgtgaatcaacaatccgtgcattaaacgcagcgggtttccgtatcacgaacattacagatgtgactccgattccacataacggttgtcgtccaccgaaaaaacgtcgtgtgtaattgacgttaggataattggagaaagaaaatggcaagatatttgggtccaaaactcaagctaagccgtcgtgaaggtaccgatttattccttaaatcaggtgttcgcgcgatcgagtcaaaatgtaaaattgatacagcaccaggtcaacacggtgctcgtaagcctcgtttatctgactatggtagtcagttacgcgagaaacaaaaagttcgccgtatctatggtattttagaacgtcagttccgtaactactataaagaagctaaccgcttaaaaggcaataccggtgagaacttattagtattgttagaaggtcgtttagacaacgttgtttaccgtatgggttttgcagctactcgtgctgaagcacgtcagttagtaagccacaaatctatcgtggtaaatggtcgtgttgtaaacattccttcataccaagtttctgttgatgatgtgattgctgttcgtgaaaaatctaaaaaacaagcacgtatcaaagcatcattagagttagctactcaacgtgaaaaaccaacttggttagaagttgatgcaactaaaatggaaggcgtatttaaacgtactcctgagcgttctgatctatcagcagatattaatgaacatctgatcgttgagctttactctaaataatagttaagcttaaaagcaaagagaggataaaatgcagggttctgtaacagaatttttaaagccacacttagtgaatattgaacaaattagttcaactcacgcaaaagtgaccttagagccgttagaacgtggtttcggccacactttaggtaacgcacttcgtcgcattttactttcatctatgcctggttgtgcagttacagaagtagaaattgatggtgtattacacgaatacagcagcaaagaaggcgtacaagaagatattcttgaggtattgttaaaccttaaaggtctagcggtaaaagtgcaaaataaagatgatattattttgacactcactaaatctgggattggccctgtaactgcagcagacattactcacgatggtgatgttgaaattgtgaatccagatcacgttatttgtaacttaacggataaaaacgcatcaattagtatgcgtatccgtgtacaacgtggtcgtggttatgtaccagcatctgctcgtgtacatacacaagacgacgatcgtccaatcggtcgcttattagtcgatgcacgttttagcccggtagatcgcattgcttacaatgttgaagctgctcgtgttgaacaacgcacagacttagataagctcgttatcgagatggaaactaacggaacattagatccagaagaagccatccgccgtgctgcaacgattttagcagagcaactcgctgcattcgttgatttgcgtgatgttcgtcagccagaagtgaaagaagagaaaccggaatttgatccaattcttcttcgtccagtagatgacttagagctgacagttcgttctgctaactgtttgaaagcagagacaattcactatatcggtgatttagtacaacgtacagaagttgagttattaaaaacacctaatcttggtaagaaatcacttactgaaattaaagatgttctcgcttctcgtggcttatcactcggtatgcgccttgagaattggcctccagcaagtattgctgaagactaattttaggtttagattttcttagaaggaataaggttatgcgccatcgtaagagtggacgtcaactaaaccgtaacagcagccatcgtcaggcgttgttccgtaatttagcaagtgcattagttagtcacgaaatcatcaagacaacattgccaaaagcaaaagaattacgtcgtgtagttgaaccattaattactttagcaaaagtagatagcgttgctaatcgtcgtttagcttttgctcgtactcgcaacatcgaaaccgttgctaaattattcaatgaattaggtccacgttttgcaaaccgtgcgggtggttatactcgtatcttaaaatgtggtttccgtgcaggtgacaacgcaccaatggcttacattgagttagttgatcgtcctgaagttgcagctgaacaagcagcagaataattctacattgacttaaaaagcccgatagatttatcgggcttttgttttttcaaaattcttcttatatcttaccgcttattaccattttttaatcaaaattttcaataatgctagcattatttaattcattacttgcgtaatgaactaaaatcatctctgccaaaacatttagcattactatgaaggtatatttatgattaaagaacagatgaaaaacggtatgtttgcttataaaggattaagtggaacctactaccaatatgatttaagcaatcctgttgataagcaactttacgaaacagatattgccgctcaaacaagggataaactttctctcaatctctatcgtcagttagaaaatggtgggggtgtttatgaaaatttataaatacctcaaaacgccagcttattttctatcaatgttttttgccatgttgattaccactacgctcgtttctacaacagcttatgcagaaaccaaaatggtggaagtttatactaagttttctgatcaacaattgattgatattgtgaagaaaaaatatccaaaagttgagctgattgaaaaaggaaggattagaattaccagcgactctgggataaagctggtaatttataatcaacgtgacgatggctctttaacttttaggatgtattttgatggcgataatacttcattgaaaagtgtcaataaatggaatgcaacaaaaagatttttaactgcttatattgataaagatggtgatcttgctttgaaagatgatctggatgttgaggagggtattagtgaggcttacttattagatactttaaccagaatctttgtaggtgcttatctgtttgcgtctgaaatgaaaaaagagtagtaaacgctttttatatacaagctcaagtaaatacttgagcttgtgttttataagcggtcagaacaatttaagagcctctcccacaatttgtgtaaatacctgtttctgagataatacattcagacacaggtattttattatgaacgaaaaacaacttcacgccttggcagcggaatttgccaaaaacctaaaaacaccagaagacctcaatcaattttcacggatgctcaagaaaatcaccgtcgaggctgcgttaaatggtgaactgaccgaccatcttggttatgaaaaacatcagcctagaaaaggtaaaaatgcacgtaacggttacacatctaagaccgtcatttgtgatgaaggtgagatagaaattgagacgcctcgtgaccgtgattggattgctgaaaatgaaggtgcgaagttctgggcaaatgtgctgacagagcttcaaaatcgaggcttaaaagacatttttattgcctgtgtagacggtttaaaaggcttcccagaagccatcaatgcagtctatcctaaaacgaagattcagctttgcattgtgcatttagtgcgtaacagctttgaaattcgtttcgtggaaagattacaaagccgtcaccgcagatttaaagcaggtttatcaggcctcgacggaagcacaggctcgcgaaaatctgaccgcactttcgcaaaaatggcaggcaaaatacccgcttgtggcgaaaggctgggaagataactgggcaaatattgccacattttttgattatccggctgacattcgtaaagcgatttataccacgaatgccgtggaatcgcttaatagcgtgattcgtcgcgtgattaaaaaacgaaatgtattcccgacggatgattcagttttcaaagtgatttggcttgcgattaaagatgcatcaaaaaaatggacaatgccgattcagaactggaaactggcgatgaatcgatttatgattgattttggtgatcgcctagacgatcaccattaagttgaaatgggtgtttacacagaatttgggatagggtcttgttttctttttcttcagcttctaatttatctagtttagcatctgcagatggaccaaaatcttttaaccgaccattaaaaatctcttcatacaagtttaaagcactatcctgatctttaatttcatatagctcaaatcctgatttaatcattccgcgaaataactcaagatatgttttcttgttgatggggtctggagtttttaacaagatcgtttttgttcggtcgttatcaaaataaactgtgatattaaagggtattccatacaaattttcaaaacctctttctgcacaaagtttgttctcacccatactaaattgacattctccaaagttccaaaattttttttggaagtctagtttgtgcatatcataagagtattctttaaagattttaacttcggtagcatttgcattaaaggtcaaaagcccaagaaggaatagtagtttcttcatttttaaactccttaaagattgtttttactgaaaaatctaccacaaaaaagccccgaatgatcagggctatgcaaaaaattttgtaaatttacaaccaaaagagccacagcgtggctcaattatgcgtaaccccgtacgcttgcgtgcgggggataaaaagatcgctggttaggtagcttgagattatttagttttttgttttaaaattttataaagtgaattaaccgaagctaatgcttctgctggcgtgggagcaacaacaacagtagatgcgtagtttgttgcaacagtcatgcagtcaatgtcatcaggagcttgcctttttaatgttcctatagcctcaataacctcaaggggagttacaaaaaaatcgtcttttgccaaagatgtctgaacagcaacagaaagttttgcaacctccgtgatagagtcctcaccacaaataccttttacattatctaaagatctcattattcttattttggtaatagtattagcataattaccttcaccaaaactcgctacagcaatcttctctgctaactgctcctgttgattaagggaaatttctgccttggcagttaaagaaagaagaataagtagagttacaaatagattttttcgcatataaacctcttacaattaccctaaataaattaaatgacactttcaatctaccacaaaaaagccccgaatgatcggggctatacaaaaaattttgtaaatatcaggttcttcgcccatttcgatgggcattcaccgctaacatctgcacaattttaaaaatctggtctgtcgtgcaccattgcaaacgctcaataccaaacgaccgcttgcagatagcgtgaacataatgccaagacttaccactactagcgataaaggcttcaatctttctaatataactttgacgcacctcatctgcattactggctgtcgggcgtttaccatattgtttcgatttcaccttaaaccctttggcacgcataccttgcaacacaatcatcaactcagaatccgtcatcattgagcaactaggcttatccaccaactccattaaaaaaagcttataggcttcatcactcatcttcagctcattcttcccaatatggattttctgtatcatctgtttacgagtttgtgcgtacattctctttctcctgttgccactgtttccaatcagcaaagccgtgtaaattcacacattcatcttcacctctcaaccgaaccaagcgatcaatgtactggatattcgctgtccgattgtcgctttttaccctttcctgtgcttcttcacccgaaagcacctgattattttcttccgttctaaccaccgcaaactgtggcttcacgctttcatacacttttttcaggtaattatgattgctcaacggctcaaatttgccattctcacgacgattacgtcgcacctgctcaaccgtatctgccaacgcttttgccaagacattagagcaagggtaaagctccaacaaactttgcaaaatccgcaacgcacgcccattgcttaaactactttttgcaggtttaaacagccccaaatatgccaccgcaggacgaccacaaccagcagtcatttcggtaatcgttttaagtaactctcgcccagcatcatcttcaaccaacgcttccagcgttaaatctgagtgacaaatcgggcaacgacacaatttcattttgcacctccctaagaaaacagagataaacgctgtcgtttatctctattctctcaaccaccgccccaagtgcatttcacaatttcattaggctctgccgataaaaatagtgtggggcggtgtgagtggtttttttagtgattacatagtttcctccttgtttttgaattagctcaatctaattgaaacaccatttcctataacaacacgttttttgtcttgctctgcatatttctgcaataaggaataagtctttggcattagatcctttgtaatttcttgattataagttgcttccaattctgcccaatttttgataatttccgcccaaacaggacagatagacgttaacttactcaaatgatttcgcattgttggtgcgacagttagtaattgcatacaacgccttaaatctgcaggatcttgtggataacatgctcgttttggtaccacatcaaagccaactacaaacgccattgttttactacttaaccctgtttcaccatcagccagccattcaattatttgttgttgcattttgttcattttatttccccaccacttaaacaaaactctctaacttcgtttcccctgtaaactctagcgctgtagcacttgcaattttgagtaaggcattaagctgaccttcaaggtattccgttaaaatagcgtgcttatgtgcttctcttgtaccgtttaactgacgagcaatatcggcatattcggtaaaacgcatcgagcggatttttaaatgttcatccaacttaaaatttacaataaacgcctcttcgctttcataacgcatcgccatagattgcacacgaaaaccattttgtaacgcccctaacgctttttccttgccgtctaacgtatccaaatggcgacaagtcaaaaactcttcattgtcgtttgccaacttacgcaaagtcgcttcgtgttggaaatgtagatatttaaaaagcggttcacctttttccaaaaatttagtcaatttagtgtttaaacccaacttttcttccgacacaacaatgcttttaaaacctgcaagttcaaataatttaatcaagtggttcaacgctaaacggctatgcttagagcggttatttgtaaaaagtagctctttttctggactgtaaaacacattgactaattcactcgaaaatggcacaacttgcagtaaatgagcttcggcagtttgtcgccactctttatcagtattcggcacaatcttcggcattctttcatctcgaagtgattctgattttttcagctcataaattttggctgaaagtaactctttagtcacttttttaaaggttgtccgcaaagtaaagaacaacccattatccagttctaacactttcgtatttgtcatcggatttttgactaactcaatggtggtataactgtccgcaggctcaaaagtagcctcttctaacacttctttcacattgtccacagggaacttaatgctatgaatgttgcattgtgtcatttgaataaaatcactgtttttcatcttagttttcctcttggttagttgataatttaagcttcacccgctgaatctgcccagccacgtccatcaaaaccacgccagccagtgccaaatcgcccatttcgactaattccgtcgccccttgtagcttttcaatcaggtcatacaagcggtcttttatttgccatttttcgctatcggtcatcatttaccccttatggttaaaacacattattaacgcccctttcaccgttccccctctttgacaaagagggggttagggggagatttaaagagcgtttaaatgggttttaagccccctgctcaaacggcttaatcacaaaatcttccacaccttgcttaatcgtcacgccagcaatccctttggcaacttcaggctcaagtagtagagcttctttgttgatctcgtttttggtacgaataaagcggtcaaagcccatacgctgcataaactcaagcaccgcatctgccccacgaattgccacagaaggcggtcgttggcgccattgcacttcgcctgtcacaaagttagcggttttactcttgccgttttccgtcaactcatcacggtgagcttcacagtattcctgcaccgcttgctgtaacggctcaatctctgcctgtaaacgttttaactcaggggcgtaacgctcactggtttcgccgataatatcgttcatctccgttgtcaaacgggtatgttcacggcttaaatccccgatctctttaattgcactttgcacttgctcttccgtggtaaaacgcagttttgctggttgttttactcgggttttcgttggttgttttgccattttcttaactcctaaactttcgcttcccaccacactctaatcccttcgatcatcgtgtagtaacctttccatctacctaaatcttcgctatgcccttgggcataccagtttgcttttcttgactcaattaacgctcttgccaccccctcattacctgaaatatccactttgattcgtggtttaatcttcgtaaaatcaatcatcaacaccgtaaaccctaacgcattgatatgcccaatcgccttttgtgtttggcgtaaatacttcaccgccatctgatttgctctattaattgtgcgccccatctcacaccaccttttcttttcccaacttcacaacgaccacccgttgccctctattcctgcggtgatagctcggcgttgaccatttccgcaccgtttttgctgtcacccctaacttgattgctaactcttcggctgtaccgtcagccacattctcttcgccacgatacgccgcatagatctgacggtatctcatttgccacctaaccaatcaacatcttggtatactctttaatcaaccgttcatcaatttgacattcattgatatgacttaaacgcaccacaccacgaatcaacttgttcaaacgtctcgcattaccttgactatgtttaaaaaataactcgttatattcccctgtgttcaatgctctttctgtcaataaatgcaaatccttttcaggtaacgcattaccgagagaactcgttcgccaaatgcggttatacacctgagctaaatcgttatgcctgccttttaagttaattaacaaacgctcagtcccaaccaatgcaacacccactttagttgcatcgtggatacggcgaataaactccaacgagcgagtaggtaaattctccgcctcatcaatgataatgacccgttcactaccctttaaccttgccacaatcccatcaaacagctgatcaagcgtacctcggttgtttaaattcagtttttcactgattttctgcaacagcacttttgcggtgtagctcatattggtctcaattaaaattacccctgtattctctttcgcatactgcaacaccgcttgcgttttacccaaacctgacgcaccatacaccgcacacatatcaccctcaatgtgtgcctcttgaatagttgccataatctgacgagcagtaaaagtcggcacaaactccgcactcaccttatactcaagcaccttatctttttggcgagccaaaaactgctccaccttaatattcaactcttcaacattgccgtcatactcacccctcaaatacaaactcaccgtagcaatcgacacccctaatttatttgcaacctctttttgcccaattttggtgcgttccatataatcttttaatagttggtttttcatcgcttatttcctataatcaaagtctcttttttcatcaacaggcttcgttatgcttaaaactccacctgaccttaataaactcactaaatcagagctacattcactcctcgttttgctaactgggatacaaggtattcagtctgagcttgttcactctctatttcgccaattagcaaccctatcaccagagattgcagagcaagccctaagtgatttttcaaatgttgttgatatgcaactggatctacttgaggcggaaggtgtggattcgcaaacgcttgatacactttctcaagtagcggacgatctgtatttgcctttaatggagcaagtttgcgaacttcaagaaaaagctcaaaagccactccattaaactcaactaaacaggtcgccctattatttaaaggtgcatttaactccgcacgtcttgcctcacgcacctttttacgctcaacgtttaactgttcttcacgttgaaactgttttaataattcactttttttcatcatttccccttagcctacggcttcaattaatgcttgttttttctcccactcctccctctctaccacactggtaaaaataggacgaacagacactttttctcgttttggttgataacttgtggttattaactcgctttgctggtgttcaatcgtaataacaggattacgctctgccataatttctgccacttgttgctctttccgtttaagtctgccttttgctcgctcctcacgtttctgctcaacaaaggactgcggaaacgcatcttgtttatgtccttcaaactcggcattgcagataaaccgtccgtctttggttcgcacctgtacccacatcggatcgtgaatatccaccccgataacaacttcttccccttggtaatccaacaaattcaagctgaaatacttatgattgttccactcaatcaagcctctatttgttgtgcggataaattcaggacgttgaatatcccttaattccacatcgctcaaccacaccactttttcagtgtcggtcactcgtttgtacttcaccgctggcgtacaatgaatttcactgtgaacgtgctcattgttgtaccaatcaatcacttcttgaataactgccttcaactcttcccagcttggcaactctctgcgagctttcttctgcaaagcggtcagttccttgccattttttgcattcgcatacgccaactgtctagccaacatcttacgagtggcttcaggatcggcatttttgccgtagtaagtttcaaatcgctcggcaattcgtaaacccaccgtcttatttaaccgctcaataatcccacgcccttgcggattacctgcaatccctgttgcgtggtggatagagaaacgtggtaaaatccctgtgacttctgcatcaagtattttatttttctcaccgccaccgttatcggagtaataaatcgctggcacaccgtgtgtcgcaataccgtgtcgtaacgcatctagcactgcaaaagcgttttcactcaacgacagcgaccagcccacaatttttcgacttgccccatcaacaatcattgtcaactcaggggtaaacggtctgccgtgtacagggtgggcaacttttaatttcagcgagtgaccatcaccaatccaaatatcatttgccacaaatggcgaccaatcacgcatcacataaggcaataactgcttatatttcgagccacttaagcgacctttctctaagatatggatcggcaacttcgccattgctcgccttactttgctgatattaggcattgcctctaacatcatcggattgtcggcataccgttcaacccactccgcttcaaagtagcggtaactttcttgcacgcttaacgcattcttctgacggtaaatccccaacaaccaagaaagccaccaaatttcttctgccttaacttcctgccttacgagtggggcaaaaagttttaaccgttgctcaacgcttgtcgccttgcagtaatccaccacccagccatttaaagtacgaacgcttactgtccgttttttcgattttttagcgttagccgtttcaaccaacaccgcaagatgcggaggcaatctgccactttttgcaagttcgcaaacataagtgaccgctttaattcggctcattgattgttctaaatccaacacatactggatcatccctatgcgagcatcagcaatctcacgctgtttggttgtcaagttcgccaaatccacatcggctttcaccgcaggtaattttttcggcttactttctaccaccgccaccgcaaaacgtgagcggatttcggtttggacggcttcgggcattgaactaagctcgtattcattcccgccaccttgaccaactcttttacgagtttcccaaagttgttttttagcttgataaataattccttgcaccgaattcggtaaacaggttaaacttaaaagtaataattctttggctgagtagtgcgtttttaagttgttttcactcataaaagctccttagagcgttctctcagcgaattttttaaggctacgctgagcaaatcgccccgcccaaatttcctcaggcggtacaccgattgcatctgcaatgatttgttcgccttttcgccacggtctatcaagggcattctttaatgtgctggcttggctataaccgtgttgtaatgaaagctggcgtaacgaccaaccagccttatgtaacgcagcaataatgtcggctctatgccagtcttgtgctgttttttttggctctgtcaatgtactcattagataactccatttgtttaacacgagagataataaacctcaaaagaaactaaatcaagtttaaaaagttctttttaaagttaattgattgcattttaatcgtttcttttgaggcttttaatctaaattattgttttaattgttctttttagaactttaaaaacattaaaaaagaaattgggattttttaaagttatgactgaaaagtttaaaaacaaatcaatgattggaaaccgaattagagagcagagagaaaagctcggtttaagtcgaaatgaaatggcagataggcttgatgtatcactatctgcgctacaaaactgggaaatgaatgaacgagagcctcaggcttcaatgatcattaagatagcagaatttttaggggtagcacctaactacctactaacaggtgaacaaagccaaccacaagaagcaaaaagcattgtggcacgagcgtttgaagcattagaaaaagaacgtgcagaacaggacgaagttgaaatgctatcaagctttgaaagcattgaagtttcagcaggctttggaagctttaacgtgggcgtaaccgaaccagacgggcaagtaccttacgacagcaaccttctacgcaatctaggcgttaaaccgaagcactgtggcgtattttgggcgaatggctcatcaatgctacccaccattcataacggcgaccagttgttagttgatttcagcaagaaagaagttaaaaataacaaagtatatttagttcaaaatggcgacagcgtatgggttaaacgtgtaaaaatagaatgggacggtgtagagctaattagcgacaacaaagaagaatatcgaccaattagaatatcagcagacgaagcccagaacctgcaaatcatcgggcaagtggttcatatcggacacaacctaatttaaaaatttaaaatgggttttaaaatttcttaaacccattttaaaaaccgatcaaacctgctcaaacctatgcaaaaaatattgcaaaaactgcccattttcaaccatttttgcccattttactttttgcataactctccccaacaaaaaatgcggtaagccccaccacacaaagccccaccgcattttttcagcccaaatttttttctttctttctatgcaaaaatagtcagcaccccacagcattgtgcatttagtgcgtaacagcttgaaattcgtttcgtggaaagattacaaagccgtcaccgcagatttaaagcaggtttatcaggccccgacggaagcacaggctcgcgaaaatctgaccgcactttcgcaaaaatggcaggcaaaatacccgcttgtggcgaagggctgggaagataactgggcaaatattgccacattttttgattatctggctgatattcgtaaagcgatttataccatgaatgccgtggaatcgctcaatagcgtgattcgtcgcgtgattaaaaaacgaaatgtattcccgacggatgattcagttttcaaagtgatttggcttgcgattaaagatgcatcaaaaaaatggacaatgccgattcagaactggaaactggcgatgaatcgatttatgattgattttggtgatcgcctagacgatcaccgttaagttgaaatgggtgtttacacagaatttgggatagggtcttatcagcagatgcgtaggtgtctacaccagcatttgcagtacctttcaatagaattgcatcattgccatcgcccatatgcacttctacattacgcatttgaccaccataccaagcgtcattattcatcttgtcgatacgaacgaaatcgttgccaatattggtgtttctgccaacaatatcaaaggtacctgatgctttatgttgaatcacatggtagtgttcgttatcttgacctacgagtaatacgtcattacctgtgcccatatccactttaattttacgtagtggttgaccaccagaataattaacgtaagccgttcccatatcgttaccacctttgaagctgagcttcatttggtcaatattaccagagtctccattcatgtagccgagagacgaacggatagcagcaacatcaaccccatcactaaatacccattctctaccacgctcatcgccagcaatcgcatttttataaagtggtttagagttaccatcttttccttggcgccataactgtgccgcccaagagtcgctagtatcctctcccattttattttttctccagccattatcccaagcatttgtgctggagaagacattccaacgtctttcaccaccccaagcacctatgtcatctcgaatttgatttagcttatcaagagcatcttggtaattgatcttatctgcaatggttactgtctcatttccatgagttttaatgccctcattgttataagagtcaattgtcactgtactatttcctttcactgctgatggggcgatggtgactttacctgtatttgactcaacacgaactccatttggtgcttgcggattgttgctattactattaacagaaaccaattgccaattcgggctgtctttggtgcctttattttggtactccaagagctgtttctgaccttgctcattcgtgtaagttaacacaaatttcagagtgttaccttttggttgaacccaagcaccgcctgcattttgtttgtcaatttgcgcatccggcgtagtcggttgcggttctttgactgcatctgccgtagcattatcacgagctcgtccttgactatctaatgctgtaatagtgactttagtaccatcttttaggacttttggtgcaaaggttacttcgccgttagcttggttaagacggatatcaccagttccatttgttgatacttgaaccccattatgctcattagctttagaaaaatctaactcccattgacttgaacatttttcttgaaccaaatcactctattcatccctgttgcagcatctttgtaatctactcggaatgctttggtttcatccccgtcagttccagcaggtttcactttcacaccacccggattttgtgaatcttgctgtgctgttggcttgccgatagtttcatatttcggctgctgcggtgccgttggagtggttgtgctggttgaaccaccactacttgtgccgctgcttccgccagttgagcctgcatcgcctgagccacctgtactcggaaccgttgttgatgcaccacctgatacggtttgagctgatgaagttatgttcacattggaaagtgtaattttattaccaccactccaaggatcattttctacccagtaatactcatccattctattgttgtcctgagtattttttcttacgccatagacaaagtcatcaataatgttatttgcctgaccgtcttttgaaccattagcatctgtattaattccaaatgtgcccccttgcttttcttcaatatagaacacatttggttctgattcactaggagcaacgaagaatttggtaaaatcgtatccatgctcaccaggaagagcagtccattttcctgcattacttactatgtagaacgttggatatgcttccgaagtatttaagtcaaaagtcattgccgatacttttgttggatcagcggttactttcaagcggtatcttccagttccttccacgatttctggctggattactggtgaaactaattcttccccgctacttaatacatccatacgttctggtactgcaaccgtttgagattgtttcacagcaaagctatgtaatttatgcccagctcccgatacatcaaagttatctgcaatcgtggtgtcttctactggtttcaagtagtcatcaccctctttgccgacaagaatattggtgatatgtgagctggtaataccatccacggtaaatgtaccatttaactgctgtaccagtgttacaggtgcatactcaacagtttcattgccatcaacaatatcattgttgtttgcatcgcccagtttcatcacgtatttttcccagccgccgttgtcatccttgataaaggcaatattctgtttgccttgtgccgtttctacagtaaagctgatgaaatctacgttttgtcccgctttgatttcgaccgaaccaattcctttattgataaaggtggttggtgaatccttagtatctgttggagatactggtggcggtggttgtagctctggctctgctggttttggtggctccggcggaggtggttctaccgtaataatctcaggacctttcggttgatccgcttctgcaactgtacctgggtttgcggcggctgttgctggatctgttttagctggtacattcttattgttgtacgcagtcacattaacctgagtattatccatcacctcaaaggcttttaacgtgatttcacctgtttcaggattaatctctgccacagtagatgggacatcatactgctcagtcactttaactttctgaccgtcagcaccatcttgttccacttctctcgttaatttttcaaaagaccatttgccagtttgggtatttttcgtcgtaactaatttaccatccgctgtttgagttgaagcatctgttgttggcttatcttcaccattttcagctttctctttcacatagcttacttcaagacggacattatctgtgtctgctggtgtagtggtttgccctggcttaatgattaagccgccaacattttcatctgtgccttgtgtaatggttggtttatctgttgcatccggtgttgtatccgtttttggcgttttcactggttcaccagaacccgatattgcaccattgccatccttggtttcaacatagatgccgttattctctcctacctgttccgcaggaactgtaactttacccgtgttaggatctaccgccattccatttggtaagccttgatctgtccattgaccatcttcacccttcacaaccttaccaatagattgtgcttcaccttcaccctcaagcggttttttgaagattccatactccttagtatcaccaccaggaatgatcgtgccatcaggcgttactgttgcaggatctgccgtaggcgttggatctgccttaacttgctgttctgcaggcggttcactacggttagattttgcatcaatacctacggcggtaacgttgctattctcttttaagcctgatttatcaagggttaattcgcctgtttctgggttcagtttaactttcacgccattgataagcatggtatttggatcaccatcattatcttcagtaagattttgttggttctcactgaatttccagactttaaccttagccgtttgcgtggcttgaccatcttctgcggtaaaggaaatatctttttctgcctgctcaatggtaactgtcgttttctcgttgttagcgctgtctttcttctcaaaagacacttccaacttagtattatcaccatgaggacgagcgaccatatcaccattactgagctgttcaagagaaggtttatctgcaacaacgtcttgatcttgacggagatcgctgcctacggtaattgatgtattagaggtgagtcgatctggttgaccatttgccccttgtgttttttcaaccgcatctttaccttctgctggcaatcctaacgcattgtagcctttggcagtcacaggggagtcatgcttaaccgcatttgcgttaagggtaatcttgcctgtgttcggatcaatagttgcaataccagcatctttagcagaaacaagtccaacaccctgtggattgctagggttttcgccgttgtctgccggtgctgtttgtgcttgttgtaacttctcataatctgctttggttgcagcaaagagtccccaaacaccattaactttctgagccactaacaccatatctatatcttcattgactgatgcaccatcctgagatttcactgttgggataggctgattattggtgttggttgaatatcccggcatcgctggcggagtcatggtgtagcctttgaaggacacaacaactttctcattatccccttgcggttcaataattgcagtaccttgttgataggtattatccttacctttcaccaaatgaggcgcatcagcttctttcggtgtagtatcatctaccaacgccttaatcttggcttcctgtacggttgtcaatctagtgccgttttctgttgtatcactagtttcataaggtttgtttgatgctactgattcatttccaacagtcttataaccaatcgcttctgcttccgaaccatccttcactttcggacctttaacaattacagtaccgtcttctttgatgatatagtcgtccttagcaggttttttatctgcatcagtcggatgtgtttcatccaacacccacttaccttgctcaagatctttcttcacagcaatttctttatcctgaccgctattatccttatacttcacaaccattctgtcgttatcaccacccggtttcgctacgatgtcgccggagtttggttggtcgttttgaacgccgttaactgcctctgttctgcccgcagtgattgtcggtacgtctgtgcgaactttgctgtattcaggctcattggctgttgcgtctgtaggtcctttgttcagttctttagtttctgcagcgttttgtttgtactgtggcaacaaatttatccccaacggctaatggagttgctgtagattcgctaatatcaaacttgaacttaccgcttgttaccgttgtttctgcaattggttgtccgttagtttgaccttctttgtagaggtaaactttggttccatctgcttctgtgcttgttccttcaatgatgactcgctcaggatctttgtctgccgttgctgatgtatcaatcgccttgattgaggtaatcactggcttatctgatttcacatcaaacggagcatctttcttgctggtttcactttctgcagatgtgcgtcctgctacatcggtcgtggttgcactgacagatgttttatctgctactttgtcttcaggaatcgttacactgactttgccactttgatcagtggttggggtgagtttaagtgaatctttttcatcttgaacccagtttccgccagtataggtgtaagtcaatgtcgtcggtgtacccgctgttccattttcaagctctggggtgtagttgatggtgactttatccctttcaacaattggcttttcccctgttgtcgctgggaattcgatcttctcataatcctcattatatgaaggtggtgcagaatgcattgttttataagggatattggtagagatgtggtgttttatttattgtattttcttttgctataatacggtttcccatgtttttttgaagtggtttaattcatgttaaattttgaaaatttaccttctcttcttacaggaaagagcagacagcatttggttgccttaccaaataaattatctgatcagcatgcactacaatctgaagtagtaaaagcatttttgcatttacaagatgccgcactgaaagcaggttttaatttacaacctgcaagtacttatcgggattttgaacgacaaaaatggatttggaatacaaaattcaatggtgaaaataaagttcatgatgatcatggtaaagctatcatattaactggcttagatgattgggacaaatgtcaagctatcctgcgttggtccgcagtgccaggggctagccgtcaccattggggaacagaaattgatatttttgatcctactttacttcctgaaggaaaaaagctcatgttggaaccgtgggaatatcagacaggaggctattttcaacatttaacgaattggttattagtcaatgccgaacgttttggtttttatttcccttttatggaagctaataataagtttattggtctagaaccatggcatatgagctatttccctatttcggaacaatatgagcgattactgtccccagagatgttgcaaatggcttggcaaggcgagaatatcgctggtgtaaatagtttgaatgagcatatttctgagttatttgaatattacattctgtaaatgtccctttctgcttttttattaattaaagataattttcaagatcaatcaccttatcacaacttcgttcaatcaaaaacggatcgtggctgacgataattaatccgcaatttctcgctcggcattgctcaatcagcaatttgatcgtttcttgttgagtgatcggatctaagcgagaagtcacttcatcggcaaatagtagcactggttcaagtagcaaggctcgtaaaattgcaacccgttgcaactcgccacccgatacgttatcggcgttgcgttgcagaatgtcaggcgacaatgcaagctgtgctaatagagctggaatttgtgaacggtcgagatgatgatgctcgatcacatcgtccaatagttgttgcaagctcacattcggtgcaaaggcttcgggcggatcttgatacaatttcagcacttgatgttttttatggctgtggctatgccaaatcacttcgcccgattgcggtttgagtagcccgcaaagcacatctgcaagggtgcttttgcctatgccactgtgtccgacaatgcctaaaatttcgccttggtgtaaatcaaaagaaagctgtttgaatagcgttcttgttccccgtgcaaccattaaatttttgaccgatacaagcggtgtttttgacttagaatgttgcaaatcggctaaaggttgccaatgttgcggatctgcaccgattaaggcttgagtataaggatcttgcggttggctcagcagttgttccgcttcgccttgttcgatcaatttgccttttttcattacgaaaatatagccaccgagagcggtcgccacttcaatatcgtgagtgatcgtcagcaagctaccgcctgtttcataggcttgtttcagcaagttaatcacttccgctttgctattcggatcaagtcctttggtgggttcatcggcaagtagaattttcccccctgatgcggtcgctatcgcaaaggaagctctctgtgccataccacctgaaagttggtgtggatagcgttgttgagcttgagataaacccagttgagttaaagaaatctcgctcgccttttctgcatttttctggcttaaacctgccacaaagcgaaagctctcccacagttgtcggctaattcgcatcagtggatttaatgaacggcgtggctcttggggcaacatcactaaggttttgccccaaagagattgcaagcggtcggattgcccgtctattttgcaattttccaccacaatctcaccgcttgcggttaagccttgcggtaacgcccccataattgcttgaattaacaggctttttcctgaaccagtttcgcctaaaatggagatgtttttgccacgttcaagacaaaaactgatcggctcgaccagctcaatgccatcgagtgtttgaacagtgacgttggttattttgagtaatgacacggtgttttctctactatatttcaatggattttacattaaccttcgtactatgctacgtttgattcttcccccacttgtgggggaaggtgcccgaagggcggatgggggctatttacatttagctttattccccttttcccctcgctgtcgcttggggacttcccccataaatgggggaagtattttgataaggaaggaaatatgcacgatagttaatgttcaaatttacttcaccttccccgccaacaactgcaagctaaataccaataggaacacagcaattacaggttgtaggaaaatcaatggggcttgatagtaataggggaacagctctgtcatcatcagccctaattcagccgtaggcggtcgcaatcctacgttgacaaaccccagtgttgcaagggctaaaatcgcattaccgattgaaaatgcggttaatgtggcaaccatcggcagtaaacgggggaacagatgacgtttaatgcaataaaaccaaggcattcccatcaaacgagaagattgcagttctgagctggacgcaagggtactggtgatcgccctgatgacacggaaaaattcaacccaaatcactaaggcaatacctaaatagagtgtccaaaatgaaccaggggaaagcgaagcaaacagcaaaatcagcaataaacctggtaatgccatcactaaatcacagataaagctaaacaagcgatctaaccaaccgccaaataatcctgccagaatgccgaataacaagcctgccaccaatgcacaagcaacactaaatagcgataaaccgaatgaaaggcgaatggcggaggcaagacgggcaaacatatctcgccctaaatgatcggtgccaaaccagctttctgcatcaggacttgccaacatattgctgagatcttgaaaaccaatatccatcgggtagaaataaggctgtaaaaatgcagtggtgagtagcagtagtaataacaaagctccgcaacgttgtccaacggttaatttcatactgttcccccttcacgaatacgcggatcaatccacgcattaagcagatcggcaagcatattgagtaccacaaataatccccccatcactaatgccgtgccttgtatcatcggcacatctcgtgcaatgatggcgtgaactaaagcgtgtccgcttcccggccaagcaaaaaggctttcgacaatcaccaccccttcaatcaggtaaaccagttgcacgctatgataagcaatcactggcacggcaatattcgggatcccatgtcgcacaaaggtctgccaacggctcaagccttttagctgtgcaaattgatagtagtcggattgcatcacctgcaccattgcttgacgtgtcacacgcaccgaaacggcacttaaacctatcgctaaggtgagtgctggcaagacaaaatgcaatgccgtgccgtatccgcctgctggtaaccatttcaactgaacggaaaaaagcgtaatcaacccaatcgcaatgataaaagcaggcacggcacgaaataaactgcttaagactaaggtcaagcggtcaaatacgccgttcggtttacgagctgataatacgcctaagatgggaccaatgagcaaggctaacagtaacgctaccaccgctagactaaaggtatgcccgaattgatgttcaatttcgtgccaaacgctgtcgcctgtgactaaggatttacctaagttaaactgcactaaatccgctaaccaactgccgtaagtttgccaccaaggttgatccaacccgagttctgctcgcaccatttctgcggcggcggcatcggtttgatcgtaaccgtagcgacttgccgcaatacgatatgccatatcgcccgacagttgccgagttaaaataaaagttaaagttccgactgaccaaatcaccaaaaggatctgggatagtcgtctgaataaaatagaaagcacggggatcctgttttataaaaatttgtaggaaattcccccctttgaaaaaggggggctaggggggatttttaatcaatcagtgtgagaatttgcattttaaaatcccccttaatccccctttttcaaagggggaaattaattaggtttattttgttagtaactccaaaaagaaccgtctttcaaaaggatctaaagtcacatttttcacgtctttatgtgccaccacattttgctgatagtacaccacaggaataatcggcagttcatcgtggataatttggctcactgtctgttttaacgccttcgctttttgtggatcacgttctgtttcaagctgagttaaagcgttgtctaacgtcgcattttgccaattcattaccccccaatcacttcctgttttcgcataatcctgcacgatcacaccaaaaggatctaaggttttgccatagttcaaagcataaagtgccatctctaaactgccgtcttggtgtccagcagggatttcactgaagttaccgacagacacattcacatcaacgccaatctgcttccattgagcttgcaaaattgtcgcaatcattggtaattcagggcgatcggagaatgtgcgtagggtaaaactaaacggcttaccgtctttagttagcttgccttcgctattaaattcataaccacgagcggttagatctgctttgatttttgcaagatcaggttttgctgttgtcgtatcaattcgccattccgcaaaggctttcggcagaatttgatccgcttcgccaccttcgatttttaacacatattccgcaattgctttgcgatcaatcgcttcacttaaggctttacgcaccgctaaatcattgaagaatggttttgccacgtccattttgagctgaatagtacgagcaatagacacactggttaagttcaaatttggatcggttttcaaacgttcaacgctggcggtatcaaggttaaacaccaacgcagatttatcgctttgtgccatcagcattcgagtttcgctacggctacttgcaaggtagttcgcttgagctagtttcggcttattgccccaatactgttcaaaacgcaccgtttccaatttttgtggtgcttcaattttagtcgctttaaacgcccccgtgccgatcacttgggtcacttcccctttgtcgttatagctttcaggggcaagaataattgcggtgtagtgtgttaaaaaagatggaaacggcacaaaagatttggttaaggcaatttgaatttctgtcaggctgaccgcttgaatatctttaataaaggctttttgcaacattcccggtttcgccaatgcaatatttaggctgtttgccaccgcttgtgcagtcaaaggttgcccattgtggaaaatcacattcggacggagtttaaaagtccaaagggtcgcatcttcattgctgttccactcggtagccaatcctgcaacaagttccccctgtaaattcgcttctactaaggtttccgctaaattcatacgttgaaaaatcacccctgtctggttcggatcaaggctattgatttcccaaggggcaaccaccgttgccagagcaagttcatcattttgctttgtttgagttgtcggttcagtcggctttgccgtttctgttgctgtggctttatcaccttgaaaatagtgaaccaccaacgctgcaacaccaccgactaaaaatagggcaagaaattttttcattgttatatcccttaaaataataatggttttcaaaaaggcgtgtattatgccataaattccataaaaaaatagtgggatgttaaaaaatttatcaccgaagagtgtgcccgtagagggattagatagtaactaagactatctgttcaggatcgatatgtatccatacctgttgattttcttggagcggttgggcttttttgaccgttgcgtaacattccgttccatttgcgtttaatgcaatttctttatattcccctttgtcgtaaattgcttcgactttggctgctaggctgtttgggcgttgtgggtgttcggggtgaatttcaatccacggggctttgaccattaacattacttctttcccttgtgtcagtttgagccgtgctgcactttgagctgtaatggaagcggtgagatcttgcggaaattctgcaatgtgaatatcaacgtagcagtgaacatcttcttctctcaattgggtgacagtgccaaaaaattggtttctggcactgctttgtagggagaatttagctgttgcagtgagtaagctatctagggggatgctttcatcttgaaggatcgcaaaggcttttgcttgggtctgttcaagtaaatcgtagagctgaagtaaccgctcggcatagggggttaggtcagtaccgccgccgtgtttgcctcctgtgttgcgttcaagaagtggtttagggctgatgttgttcatcgcctcaagatgatcccaagcacttttgtagctgacgttggcgttttttgccgcttggtttattgagccacattcttgaatggctttgagtagggtaatccgtttgggatcgacaaaaagctgttgttttagtttgatggttaataggatttcgttgtttaacataggctgcctttttgcaaaatagaacgctgaaattatctactttcttgtattaaaaggaaatgtaatttttacctttgtatttattttataattcgttatataatagtttatatattgttatatccactctcataaggattatttatgaaaaaaacgtttgtaaaattagctttagcgtcagcattggctttgggggctacttctgcgtttgctcaaaatattacggtatttgcggcagcgtctatgacaaatgtgttgcaacagattggtgatgagtataaaaaaacttatccagaggatagtttgaccttttcttttgcggggtcttcaactttagcaaaacagattgagcaagatgctcctgcagatttgtttgtgtctgcggatcaaaaatggatggattatgtggctgagaagctgcctgccaaaacaaaaaatgtgacaacgttggttgaaaatgagttggtgctgatttcgcctgcagacagtaaaattaaagtggcatctattaaggatattaactttaaaaaggtgatcggagatagctatttggcggtgggcgatgataatgtgcctgttggtcgctatgcgaagaaagcgttggaacatttaggcgtttgggctgatgttgagcctcgtttgtctaaggcaaaagatgtgcgtgcggtgctttcttatattgagcgtggtgagttaccgttggggattgtgtattcaaccgatgcgaaagtaagtgataaggtgaaagttgtcgcggttttccctcaagagagttatggcaaggtggtttatcctgcagcaaccttaagcgataagcctgaagcaaaacgtttcttagactttttagcgacaccaaaagcgaaagaggcttttgcgaaagctgggtttaaggcagttagataaccttcggatttgacctgctattagtgaggtgagtttatattccctcctactatagcgtttatctttgatattccacccatcctttttctttatcttcccccgcttagggggaagataaagaaatcgtcaaacataatgatattgagtgaaaatagattcactatttccttttctgggcttcattttccatttgttctacacataagtgaagaatttgatccgcaccttcttggatatatttatcgtgacggactttattggcttgaatatctaacattgcatcatagataccctgtgtaatgcttggtgtttgaaccattgtccagcaggttgggcttagacgattaaaattattttgtagatcggcagcataaagtacgccgctataataagcatacacgttatgatctaacattcgatttaacaggcttgcccgaatttgttctatcgggtgcttgactttcttgttaaaccaatcatcaaccccacggataaaagatgtaatatcataactttcattcacgcgatctgcataagtttgctctactgcaccataagcaatcgcataggatttttgatcgatttgggactcgggtaaacgcttccaaccgcttgtattagtgctacaagctgttaccaatatcaacgtaaaaatgacagcaactcgtttgtataaagatttcatcatttactccttatctctctgtactaaaaaagtgttacaattctaacaaattattttgcggattactctaaacattttaaggttgaattatgaaacaatatcttgatctctgccaacgtattgtcgaacaagggaagtgggttgaaaatgaacgtacgggtaagcgttgtttaaccgtgattaacgccgatttaacctatgatgtggcaaagggtgcatttccccttgtgactacacgcaaaagtttctggaaagcggcaattgcggaattactcggttatatccgtggttatgataatgctgcagatttccgtcagcttggcacaaaatcgtgggacgcaaatgccaatgaaaatgcagcttggctggcaaacccacatcgcaaaggcgaagatgatatggggctggtttatggtgcggtcgggcgaaacttcccgaaagttggcggtggtagcgtcgatttattacgtcaaattgtcgatgatctgaagcgtggtgtcgataatcgtggtgagatttatacgttctatcacccaggggctttccatatgggctgcctacgcccgtgtttacacagtcatcatttttcattgctggatggcacgctttatttgaacagtacccaacgatctgccgatgttccgctcggtttaaactggaatatgatccaatgttacacttttcttgcgttaatggcacaaattacaggactccaagcaggacaagcgttccataaaattgtgagtgctcatatttatgaagatcagctggaattaatgcgagatgtgcaactgaaacgcacgccatttaaagctccaacactcaaaatcaaccccgatattaaatccctagaagatttagaaacttgggtaaccttggcggattttgaagtcgagagctacgaatatcatccgagtattcagtatccgttttctgtgtagttggaaaaatttttgctatcttcagactttattatttctctttatataaatgattggaaggtaggatatttgaaaaagtgtgcaataatttcctaaaaaatcatcgaacaatagaaaatcgctgatttgtgtttgacaagcatataaaaatctctaaaatacgccgcaacgaatatgttgtgttaagcaatgctgcgggaatagctcagttggtagagcacgaccttgccaaggtcggggtcgcgagttcgagcctcgtttcccgctccatttttttgttatgcccgagtggcggaatcggtagacgcaagggatttaaaatccctcgcctttcgaggcgtgccagttcaagtctggcctcgggcaccatttttattcatcatgtttgcgggaatagctcagttggtagagcacgaccttgccaaggtcgggtcgcgagttcgagcctcgtttcccgctccatgataagacctacatctatcacccatcttcttttctagataaaaagttttttctattccattatttactctttttcctttctatttagaaaatctttgcaatatctttaagataatattaaattcaacttgattatagtttggcgtgatttctataaatgcgatattagctttgcgacaagcctccctttttattgcatctctttccgctgcattatgttgataatgagcgtgcccttgatattcgatgactgcaataggattgctttgtttatctgtgataagaaaatcaacccttttgtgattaatttttgcataggcttcatcctgttccgctttgataaactcccccatggcgacttgagaaaatagaagaaaatgtgaatcaaggttgtgtgattttagataatttaataaaagatagaataaacgatgttcacttttgttcattaatgggactttatggtaactcgacttagcaactattgctaagttggaactatgtgtaaagccttttgggaatatcggagtatcaatagtagctctcctagataatgtcgttcttttccggctattagatatggttattccaaaagcaaagatgagtatggcactagcaataatgagtaatagctgactgtgttcaaataaataggtaagagacattgcgtactccatttgtaaatataaagttgtcataaagtaaaaaaattttgtgattgctgcaattggattcttttaatttttcgacagagatcgaaaaatttattttttctcatagcaaacgtttgcgtaagtcgatataattattctattctttgtttagatattggaactttgttatgcaaatcagcctaaaaaaaatctattctggtaaagttcgtgatctctacgaaattgatgataaacgcatgttaatggtcgcaaccgaccgcttgtctgcttttgatgtcatcttagatgatccaatccctcgtaaaggggaaatcctgacgcaaatttctaatttttggttcaataaattagcccatattatgccgaaccattttacgggagattctgtttttgacgtgctaccacgagcagaagcagaagctattcaacatcgtgccgttgtttgtaagcggttagtcccagtaaaaattgaatctattgtgcgtggctatttgacgggtagtggtttaaaagattatcaaaaaacagggactatttgtggtttggcattgcccgaaggtttggttgaagcaagcaagttacctgagccaatttttaccccttcaagtaaagcggaagttggcgaccacgatattaatatcagctacgctgaatgtgagcgtcagattggggtagagctagcggcaaaagtacgagatgcagccatagcactttataaaaaagcggcagattatgctttaactaaagggatcattatttgtgatactaaatttgaatttggtttagatgaaaatggcgtattaacattgatggacgaagttttgacccctgactctagccgtttttggtcagttgaaacctatcaagaaggaagtaatcccccgtcttttgataaacagtttattcgtgattggttagagcagagtggttggaacaaacaggctccagcccctagtgtgcctgctgatgtgattgaaaaaactgtggcgaagtatcaagaggctttggaactcttgactcaataggctgtgtaagcggtgaaatcattgcaaaaatttcaatattatgtagcaattgcataaacatttaattttttgtaggggcggggaaaaccttacccctacataaattttcttaatatagatcatcgtaaatttacttgatcttttctttttaaagcgtatcatacgtcctcttttttcacttgggttccctcaccccaaacaaccaaacttatataaaaaggaacaatatgaacgtatttgattacttttctgacgagcagaagcgtcgctcgttgctattactttctctttttcacatatttatcatcacaatcagtaactatttagtacagattgcgtttgaaattccaatcccttttactcaaacgacgatcccaacaacttgggggacttttacctttccgtttatctttttagcaacggatttaacggttcgtgtatttggtgcgtcacttgctagaaaaattattttagcggtaatgttgccagcattgatcgttagctatgtgatctcggtgattttctttgaggggcaatttcagggagtagctacattggcggagttcaatctatttgttttccgtattgcattagcaagttttgcaggttatgtggtgggtcaattaatggatatttttgtctttaaccgcttgcgtcaaggcaaaacgtggtggcttgcccctgcaagctcaacgattttcggtagtttaattgatacatttgtgttctttgcagtggcattttataaaagtagtgatgaatatatggcggaacactggtttactattggagcagttgattatgcattcaaattgtttgtcagtctgttgctctttttaccgctctatggcctagtacttaattttttaattaaaaaattaaatttaaaacgctttaattaagtaggcttcttcccatccttttggatgggaagaaaatacctccttacttgtttggcgcttgccccaatattctcgtcaataattcccaataaatttcaacagcaggaatatgcactttttcatctggagaatgggcattacggattgttgggccaatagaaaccacatcaatgtttggatagactttcttaatcaagccacactctaggcctgcgtgaatcactttaatttgagattcatagcccagtatttcatcataaatcgctttggtaagtggcgtaatggcggatgttgggtctggttcccaacctggataaccaccagagaaagtggctattgcaccgaccagttctgccaatgaagttaaacgagaacgtacgtctgctttgccgttttcaattaatgaacgcactaaaatattcgcttttaccccttgttcatcgctagtcaaaatgccaatgctcaatgaagtttccaccacattttcgaccacatcgctattgcgaattacgccgtttggtagcacgttgaggaactgaatgactttctcactgctctctttggcaaaaatctgtgacggcttggcaaccttttccacaataaaatgtaaattaggttcagcaaaagctaactcacgttgcaatgcttgttcaaactgacgcaaataagcggtcagattgtcttgatcttttgcattaaagcaaatggaaacgaccgcttctctaggaattgcattacgcacggagccaccacgaattgcaccgatttgaaaatcaaaatgcgattttaactcagccaacgtacgagctattagtttaatggcattagctcttgttgtatgaatgtcacagcctgaatgtccgccatttaagccttttagacttatctgtaaggttgtatcaaaaggattttgttcatagttcacaggcaagattaaggtcgcatcttcgccacctgcacaaccaatgtaaatttcaccgttatcttcggtatccgtattaatcaaaatatccgctttcagccaatttggacgtaagcctaaaaccccttccataccagcctcttctgtcattgtgagcaaggcttcgatttcagggtgaacaagatcatcagcgtctaacaccgccaaacaagaggctaaaccgatcccgttatccgccccaagtgtcgtgccttttgccttgacccattcgccgtcaatataaggttgaataggatcttttttgaaatcgtgcaatgttccttcatttgcttgtggcaccatatctaaatgggcttgcaatgccaccgttttacgatcttccattccttttgttgcaggtttgcgaattaaaacattgccagcttcatcacgttctacaaaaagctgtttttgctttgcccagttcacaataaactgagcgatttcttcttcgtggtaagacgggtgtggaatggcacagatttgatcaaaccatttccataataagtgaggtttaagtgtttgaatttctgacatatcgatttcctataaacaataatagcggtgagtttcctgtaaaattttgcaaaattcattcggataaataagtttattgtaaaatttgccttgaaatgatagcacgaaagttgttttcgggttatcatttcgcaatttttttattcggtggcatcgccaccgctttttttaggtgaacttatgagtgagaaatacacaaatgaaaaatatgttgtgacgtgggatatgtttcatatgcacgcacgcaaattagctgaacgtcttttacctgcatcacaatggaaaggcattattgccgtcagtcgtggtggtttattccctgctgcagtattggctcgtgaattaagtattcgccacgtcgaaacggtgtgtatcgcaagttatgaccacgatcatcaaggtgaattaaaagtgttacacgctgcacaagtggcaaatggtggtgaaggttttatcgttgttgatgatttagtggatacagggaataccgctcgtgctattcgtgaaatgtacccgaatgcaaaatttgtcaccgtgtttgctaaaccaatgggggcagagttagtagatgattatgtggttgatattccacaagaaacgtggattgagcaaccttgggatttaggtattacctttgttccaccactcgcaaaaaaataaaattcagtgttagggacgcttttgcgtccttaattttttactctatcatttacatcaatgaataacggacacacacaacgtgttcgctaaacgaatgaataatcgtagggacacactgcgtgtgtccgctgaatgaataatggatacatgcaacgtgttcgttaaaagaatgaacaacggacacacgcagtgtgtcccttgtatattaaaattatagtaaactagcaacataaaccataacgttatccacagcttgggtgtccctagagctaaaactcgttctgtagcgtaggcgtggataacttcatcagcaaaaccgaacagttgaaatataaacccgaatacaaggcaggttaccgatgaacgctccgatttattgtggtattgatgttgctaaacgcaatttcgtgattggtttttcccatcagaaaaagaccaaaaccgaaaccaataacgccaaaggtattcaacataccttggactatttaagccagtttaatgtggctctgataacgcttgaagcaacgggtggattagaaattcccgtggcaaaagcccttgctcgagcaggttatcgtgtatttattgctaatccactgaaagccagtgagtttgcaaaatctcaaacgagagccaaaaccgatgcaaaagatgcggttaatctcgctttctatgggctcacttgtgagcttaaaggcgaagtagagcatcagttgtatgttccgctttctgagcaagaagaacagctggaagcccttgtggttcgccgtcgtcagcttgtggatatgcgagtagcagagctaaatcgtttgcaacaaagccacgaaacccagttggacaatatccaacaacacattgaaatgcttgataaattaatcgccgaacttgataaagatatcgacgaccaaagtaagcattttagtgataaagctgaccttatctcagacatcaaaggcgttggcaaaaattgcgtcgccgtgatgatgtcaagcctgccggaattaggcaagctaagcagcaaaagaattgcctcactcgttggcgttattccgcatccacaggaaagcggtcaatggaaaggaaaatccttttgctatggtggtcgagcgattgttcgtaatgccttatatatggcagcactatcggcaattcgctttgaacctgtttttaaagccttttacacccgattggttgcaaaaggcaaagcgaagaaagtcgctattatggcgtgtatgcgtaaactgctaaccattatgaatgcgttggttagacgcaatgaaaaatgggacgctacacgctacttatccacagaatctgtgggtcaaaattgaataacttttttgtgtgtaaacacagttgctacattcaagaccattgtgagaacaactctaaataaattatgagcttaggaaatttatatatcatctcagccccaagcggtgcagggaaatcatcattaatcaatgcgttacttgctgatcttccccgttcacaagtacaactttccatttcccacaccacacgcaatccacgtccaggtgaagaacacggcgtacattattacttcacgcaacacgaggaatttaaacgcctgattgaacaaggacatttcttagaatgggcggaagtttttggtaactattacggcacatcattgccgatgattgaacgtagccttgaacaaggcattgatgtattcctcgatattgattggcaaggtgcaaggcaaattcgtgcaaaagtgccaaatgtcaaaaccattttcattctgccaccgtcaaaagtagaattagaaaaacgtttaattggtcgtgggcaagattcggcagaaaccattgcaaaacgaatgagtgaagcggtttctgaaatgagccactacaatgaatttgattatgtgattgtaaatgatgatttccaagtagcattatcagaactcaaaagtattttaatcgcagagcgtttaaaacaagcggtgcaggcagaacgctatcagttcttgatagcatcactattgtctgaagcatagaatgggagaacatataggagtttaattatagctcctatcattttcctaatgcttatagatcattcacaatatccaacgcatcacttaatttcttcacggtaaagacttccattcccttaatcgcttttttcggggcgttgccgtgaggaatgatcgcacgcttaaagccgtgttttgccgcttcactaattcgctcttgtccgcttggcacagggcgaatttcccctgctaaaccaacttcgccaaagaccaccaaatcttgcggtaacggacgattgcggaagctagaaatgagtgccagtaatagagctaagtcggcactggtttcagtgacttttacaccgccgaccacattcacaaacacatcttggtcagacatttgcaagccaccgtgtcgatgtaacactgcaagcaacagtgataagcggttctgttctagccccaccgcaacacggcgagggttggcaagcattgagtgatcgaccaatgcctgaatttctaccaacaacggacgagtgccttcccacaataccatcaccgagctgcctgaagtctgttcttcactacggcttaaaaagatcgccgaagggttcttcacttcttttaagccctgctctgtcattgcaaatacacccagttcgttcactgcaccaaaacggtttttctggctgcgtaaggtacgataacgagagtccgcctccccttccaataacaacgaagcgtcaatggcgtgttctaacactttagggcctgctaaagttccatcttttgttacgtgaccaaccataataatcgccacttggcgtgttttggcataacgtgtcaaaaatgccgcacattcacgcacctgagccacactacccggggaagattgaatatccgcaaggtgcatcacttgaatagagtcaatcaccatcagctttggtttttcctgatcggcaaggttacaaatatgttcgaccgaagtttcagataacattttcagattatcggtcggcaagcccaaccggttagctcgcattgccacctgttgtagcgactcttcccctgtcacataaagggtcggcacactttgcgacaaaccgcacatcacttgcaagagcaaggtgcttttccctgcccctgggtgtccgccgatcaaaatcgcactgccgggtacaataccgccccccagcacacggtctagttcataaaaaccactgctaaaacgtggtacttcctgcaaatcaatgtcagacaatcgctgaattttgcctgtcgtttcccctgcatagccactcaagcggtcacttttgctctcttttgccgaaattagtcgaacttcgctaatggtgttccacgctaaacacgccttacattgccccatccaacgagcatattccgcgccacaatcactacatacataagcggtttttggtgcttttgccattttatctttcactctcaaatcaaaaatttgccctattttagcaaaaatactgtgtaaatgaacaggaagaaaaaacgattttttcgatctacgtcgaaaaaataaatgttgctcatcgcattttttataaaaagtggcagagtaaataaggcgtaaattctacgcattcattttagaaggacaatttatgaaaaaaatcaggttaattcgaccgcttgcaaaagcctttaccttaattgagttgatgatcgtgatcgccatcattgctattttagccacgattgcaatcccgtcttacaccagttacacccaaaaggctgcactctctgagttattaagtgcttccgcatcttataaatccgatgtggaaatttgtatttataacacaggggctttaactaactgtacagggggttctaacggcgttcaagccaataaaaccgatgttgccgatgctaaatatcttaaatctatttccgtcgctgcaggtgtaatcacagtggctggtaaaggcaacattgatggctacggctacacaatgaccccgacattagccaataacaacatcacttggacaacaagctgtcgaggttctgacaccagtttattccctgcgaatttctgtgggacaaaagccacacaataaataaatggggtaggacttttctacccctatatagataaggattaactatgtcccaatacaccgtctgcgaacaacaaaccgaacgcatttttgatatatcgcctagccgttggcaacaaaattgcgaagaaaaagagctgttattgcgttatcttgccgttcctgtgcaagaaactgagcataaattatggcttgccgttgatgatgaaaacaatctcaccgcttgcgaaatctttgcttttatgacccataagcagattgaacctgtggtaattgcttctgatgagcttaaatacttgcttaacgcactctcgcctgagcaacaacccctttatgaagagagcgaactggctttcgttgaacaagagcaagaacagctcaacttaagcgatccgattattcaactgctcgataatctttttaaattctgtttagcccaaaatgcgtccgacattcatattgaaccacgcaaacaaaaattgattattcgtctacgcattgacggtgttttgcacctgtataaaagcctgtctattcaactggcaagccgacttatttcacggataaaactgctggcgaagctagatattagtgaattacgccagccacaagatgggcaatttagctttactaccgccttggcggacacccttgattttcgggtatctagcctgccgacgatctacggcgaaaaactggtattgcgcctacaaaaaaacaaaccaaccagttttgattttctgcaacttggctttaatccacaacagcagaccacactactcaacgccttgaaacaaccgcaagggctgattttagtgacaggaccaacgggcagtggcaaaagtatcaccttgtatagtgccttaaactacctcaaccaaatggataaacatattctcaccgccgaagatcctgtggaaattgagattgacggcttaattcaaacccaagtcaatcaaagtattaaccttgattttagccagctattacgcacctttctacgccaagatcccgacatcattatgctaggtgaaattcgagatgaagagagtgcaaaaatggcattaagagcaagccagacggggcatttagtcctttcaaccctgcataccaatgacgcactattagcggtcgaacgtttgttacaactgggtattcaagagtatgaaatccaaaattcactactgttagtcattgcacaacgccttgtgcgtaagctctgcaaaaagtgtcgtggcataggctgtgatgagtgctatcaaggctataaagggcggatcgggatttaccaatgtttaagtagaactgcaaaaaaattcgataaacagaccgcttacttggacttttccagcttacgagagagtgctaaacaaaaaattgaacaacaactaaccaacgaaatcgaagtggatagggtattaggcgatgaataacatttatgaatttcaatggaaaggacgcaaccgctttggacaaaagcaaacagggcgacagcttgccgaaagccgagaagtgctagaaaaacacttgcaacaaaaaggctatagccagttacgcattagccgacattttgccttgccgacggcaccgaaaaaggaggaaattaatcaatttatgcaacagtttgcattattaattcaagccaaaatccccctaaaacagagtttggtaatgttgctggaaacttgccaaaatcgcaccttttaccgttggcaacaagagacaatccgcttgattgaagctggctttgccctatccgttgcctttgaaaaacaggggaaatatatcaatccacaagagatccaattaattaaaatggcagaaacaagcggtaatttagggctgattttaaccaatattgcacaacgccgtgaaaaatcggaaaaattagccaagaaaattaaaaaaattctcttttatcccgtctttattttagctatttcaatcacactctctattttattattactttttattgtgccacaatttgcagaactttatggatcaaaaggaaaatcattacccctaattaccgaaatactctttagcctatctcattttctacaacactctattttaacgctaattatcttatgtgcgttatgttttcttttaattcatattttaaataaaaaacagatcttattaaacgcctaaagtttattatattaagccatattcctattttaaaaggcattatccagtattcacgcattatctttttttgtcaaaatagcagtttaatgctggcttcacatattcgtttagatactgtacttcattcctttttagccaataaaagtgatgatattttattacaacgttctctagcaactacactaacttatttaaaacaaggttatcgtttagccgacagtttagatccaaaactctttcctacggatatgttacagatgattgccattggcgagcagagcggaaaattatcgccaatgttgcaacaaatcagcaacggttatcaacagcggttagattatcaaattgatatactttcccaattattagagccgatgttaatggtgttaatgggaattattgtaggaactattttagtcggtttgtatttgccgatttttgatatgggagcaatgatagaatgatgttatttttattgtcgattttacttgcttattggtttcaaaaagaaatgcaacattttccaatgcgaattaatcagcaaacttatcaggattaccatttattagtccaatcgcctttaagtttggcggattttattcataaatccactttacagcctaaatttacatttttatcctacggcttttatattttatttcctgttatagtttggatattttacgatataaacttaccgcttatttttattcttatctgtctaatttatttatctttattggactatttatattatttaacggatattcgctatgtttcaattatttttgtcttagcattatggcaactgcttttttaccattccattgagctaaattcccatattttttcgctttttatcaccattctcttttttagcttattctcactacttagccagttaatctacaaaaaagagagtttaggcttaggggatattcttctctttattgcattatcccctttgtttacctttgatgagatgattttattactgctttatgcgtctttatttggtttaacgttttacgccatctattttttattcaccaagcaaaaacttactcgattgccttttattccctttattagcctttcgactttgtgggggattattgctaaaatttgaatcctcttaattttcttcataaagaaaaataggcatatacctgttgtaaggtttcaataatttagcaaatacagtgaaataaaatgcaaaatcaaattatctctcttagtcgatctcttatccaacgtaaatctatcagcccgaacgatgaaggttgccaacaactgattgctgaacgactacaagcggtcggatttaaactggaatggttgccttttggcgacaccttaaatttatgggcaacccacggcgaaggtgatccttgtttagcctttgcaggacatactgacattgttcctgaaggcgatgaaagtcaatggagttatccgccattttccgccgagattgttgatgatgtactttacgggcgtggtgcggcggatatgaaaggttctttagcggcaatggtgatcgcttgtgaaacctttgtgaaaaacaacccgaaccatcagggcaaaattgccttgcttattacgtctgacgaagaagctgctgccaaagacggcacagtgaaagtggtggaaaccttaatgcaacgccaagagccgatccactattgtgtagtgggtgagccgtccagcaccaaacagctaggcgatgtggtgaaaaacggtcgccgtggctcaattaccgccaatctttatattgaaggcattcaaggacacgttgcctatccccatttagctgaaaaccccgttcatacagctctgccgtttttaagtgaactgaccgcttaccaatgggataacggcaacgaatttttcccaccgacaagcctgcaaattgccaatatcaaagctggcacgggcagtaataacgtgatcccaggcgagctttatgtgcagttcaatttacgttattgcaccgaagtaaatgatgaaatcatcaaaaccaaagttgccgaaatgttgcgaaaatacggtttaaagcatcgaattgaatggaatttgtcgggaaaaccgtttttagcagacaacggaaaactggttcaagccacgatacaagcggtcgaaaacgtaacacaaattacacctaaattagacactggcggtggcacatcagacgggcgttttatcgccttaatgggtgcagaagtggttgagtttggccccataaaccaaaccattcataaagtgaatgaatgtgtgaatgtgaatgacttaggtaaatgtggagaagtttattaccaaattttgtgttcggttataccaaattagttaacttgattcagtaatggaaaagtttctagtaaaaatccccgcccttaggacggggagaatatcaattaagttactccaccttcggcttttcacctttctcaacacagtttttactcactgtcactttacttgctttcaatgatggtaaatcatacatcgtgtcgagtaacaagttttccacgatagaacgtagcccccttgcccctgttttgcgagaaatcgctttttgagcaatcgccactaaagcatctttggtgaattttaactccacaccttccattttgaacaaagcttgatactgcttgataatcgcatttttcggttctgtcaaaatgttaataagtgctttctcatcaagttcttcaagcggtgtgataacaggcaaacgcccgattagctctggaattaaaccaaattttaccaaatcttcaggttcaacttgtttgaataattcagtgagtgcttgacgagctttatcttttttcaattctgctttaaagccaattccaccttgtgtattcgttcgagcttcgacaattttatctagccctgcaaatgcaccgccacagataaagagaattttagaggtatcaactgggattgtttcttgtttcgggtgtttgcgtccgccttgtggattgatattcgcgatagtaccttcaatcaatttaagtaatgcctgctgaaccccttcacctgatacatcacgggtcaatgatggattttctgatttacgggtaattttgtcgatttcatcaataaaaataatgccacgttcagcctgatctttatcaaaatcacacttcatcagcaatttttggatcacattttcaacatcttcacccacatagcctgcttgcgtcagcgttgttgcatcagccacagcaaaaggcacatttaaacggcgtgccaaggtttctgctaacagtgttttaccacttcctgtcgggccgataagcaaaatgttacttttacccaactcaacgccttcactctctttattgtcagaaagtgcattgcgtaagcgtttgtagtggttataaaccgcaaccgacaacacctttttagcgtgttcttgcccgatcacataatcatctaaatgtgcgtgaatttcatgtggagtaggcacattacctaacacatcttggctctcagcctcatttgcatcaatcaatagctcatcagttccattaattaacgcataagactcttcaatacattcgttacaaatatgtccttctgtaccttcaattaacgcatcgacttcattacgacgctttccacaaaaactacaatgtggttctttctcaaaatttgccattattcactatctctttgttacaacgtcatcaattaaaccgtaggctttcgcttcttctgcagacataaaattatcacgttccgtatcttgagccaccttctcaaaaggctgtgaacaatgttctgccattttgcgtgtcagcatctctttcagttttaaaatttcttgtgcgtgaatttgaatatccgtcgcttgcccacgataaccgcctaaaggttggtggatcatcacacgagagttaggtaatgcaaaacgcttaccttttgcccctgaggataataaaaatgctcccattgaacaggcttgccccatacacaacgtagatacatcgggtttaataaagttcatcgtatcgtaaatcgctaaaccagcggtaacgacaccacctggcgaattaatataaagataaatatctttttcaggatcttctgcttctaaaaagagcatttgagcaataattaatttcgccatttcatcttcaacaccgccatttaagaaaataatacgttctttcaacagacgggaataaatatcataggcacgttcgccttttgagctttgctcaacgaccatagggattacagccattttgtgttcctcattacaaattggtaaaaatcgagggattttaacaaaaaatcgcagtatgatatagctcttttattaccgatacttggatagggattttatgacatttgatgaaatcaatgcccagtttgccctttgcaaatcttgggaagaaagataccgcttgttaattcaactaagccgtcaattacccaaaccaaccgaacaacagcttgaacagtggcaagaaattcacggttgtgaaagccgtttatggtttaattttcagcttgagccacgtcaagtacaaggttatagcgacgctcgtttaatgcaaggattgttagtggtgttgattgcttttgttacggaaaaatcagctgaagcattgcaatcctttgaaattcaaccgctttttgatgatttgcagataactcgccatttgacaagtacaaggttaaatgggctgcagcaattacaaaacattattctagatactgtgaaaaattagtcatcagaaataaaatatgcagtcactaagttatcattcctattttagcgactgcctttttagtttttttctattgattagtaaagcaactcaataataaaccagccccatataatgctcaaagcagggcctaataaaccaataactattccccctaatctaaattcggattgttgaattagccctgtactaaatgcaatagcattaggtggagagccaatgatagttcccattccaccaatggaagcagcggctggaatgcctaatagtaatgctctagatagattagcttttttgtctagggtcgcaaaaataggactaatcgtcgcaatcatcatcgctgttgtagctgtattgctcataaacattgacattagtgcagtaatcaacattaatccccaaagtacataacgagggtctgtaccaaatttaggtaataaatgtttcaacaataacgtatctaacgctgtttttttcattgcttccgcaaggaaaaaaccacctagaaagagccaaataacactatccgaccaggtttgtagatatttcattgcattttgtgcatcgtgccttcccataattaacacgagaaaaccgatgattaaaatacctactgaaaacggcggaatagcttcagttacccataaacaaatcgcaaaaaagagtaaaaacatcacatttctttgagttggggtaaataatggatctgaaagaagatgtgccataaaaaaagtaaaaacaagcgagaatagaaagaaaagcaccctacgttttctggctaatgctagaggatatttagtcagttttttttaacgaagcataacgcgagtcagccataattgcctcctatatgaaataacgttcagattttataagagtcactcaaaataaactgtgatcacattcaaattgttaaaaattcattaccgctaaaatatattttacaaaaacacggaagcgcaaaatgcactccagattattgacaaagtagcttgtagggtgggtcttgacccaccatataaacgtaacatattgattttattggtgggttaaaacccaccctacaatattaaatctatttaatatatagtttgttagcaatctgactcccacatttttgcattgtaatcatcagaaatttgataaaatcttaccgcttattctctaaaaaagcgtataatctcgccagttttgacaacctaaaggaagagtatgagccaatttttctatattcaccccgaaaatccacaacaacgcttaattaatcaagcagtggaaatcatcaaaaatggtggtgtgattgtttatccgacagattctggttacgccttaggttgtgcgattggcgataagcacgcaatgaacagaattgtggcaatccgtcgtttgcctgaaaatcacaactttacgcttgtatgtagcgatttatcagagctttcgacttatgcactagtgacaaatcaatcttaccgcttgattaaaaataatgtgccaaatccttatacctttattctgcctgcaactaaagatgtaccccgtcgtttaatgactaaacgtaagacgattggtattcgtgtgccgaataatgtaattgctttggctctgatttctgccttgggtgagccgattctttcgtgttcattaatattaccaaatgaagcaattacccaatcggatcctgatgaaattcgagagcatttagaacatcacgttgatttaattattcacggtggttacttagggcaatcaccgacaacagtgatcgatttaactcaagatagccctgaaattattcgagtgggttcgggcgatccgacaccttttgaagcataatatccctctcccgcttgcgggatagggtggagaaaatccgaaggattttcggagggagagggattatacgctcccccccttctgcccttcgggcatcttccccctcaagcgggggaagtatagtaaataacaccccgacgcttgtgaaagcgacaaataaggaacttaaatgacgacatttcgtaaaccaactgcaaccaagcggtcagattctgcaaaaacgttgcaaaaaccgactcagcgtaatacacgccaagaaacccaaaatcgtaaaccacttgtaaaaaaatcgccgaaaccaaccgcttccattgaaacggaaaataaagcaaacgacaaaatcgtcagtgaaaaactacaaaaaattctagctcgtgcaggacaaggctctcgccgtgaaattgaagaagtgattgcggcagggcgagtaagtgtagacggtaaaattgcgatgctaggtgatcgtgtacaggttagctcaagcaccaaaatccgtattgatggcaatttagtcagcctaattccaacgcaaaaagagatctgccgagtgttgatgtactacaaacctgaaggcgaactctgtactcgttctgatcctgaaggaagagctacggtattcgaccgcttaccacgtttaacaggctctcgctggattgcggtggggcgtttagatattaacacatcaggtttgttactgtttaccaccgatggcgaactggctaaccgtttaatgcacccaagtcgagaggtcgaacgggaatattctgtgcgtgtatttggcgaagtaaatgacgcaatgatacaacgtttacgcaaaggtgttcagttggaagacggtcctgctaatttcaaacagattaaagcagttggcggtacagggattaaccaatggtttgatgtcaccttaaccgaagggcgtaaccgtgaagttcgtcgtttatgggagtcacaggggattcaagttagccgtttgattcgtattcgttacggcaatatcaaacttgaaaaaagtttaccgcgtggtggttgggaagagatgggattagagcaagtgaactacttgcgtgaattggttggcttaaaacctgaaacggaaactaaggttgatgtgacaaaagcccgtcgtcgtaccagtactcgacaaattcgtaaagccgtgaaacagcatacgaaataccgtaaaatttaaatgttcccccctttgatctgcaccccaaaagttggactaaacaaccaactaattaaggtgcaaatttttatggctaaatacacccaatcttttaaacaacaagtgatcgaattttatcttcaaaataatagaattcggtcattaactcgtcagcattttcaggttaaggaaaccatattaagatattggattaatcagtataatcacacctcgtgaaggaattacgccaccaatttccgtttgagattttattgcaattggttgatttaaaacggagtacgttcttttatcatcttgctgaaaaagacaataaaatggtaagttatcagtcgatattgaagcaaagcggcatcgtacaaagtatgtcgagaaagggaaattgtttggataacagtgcaatggaaagtttctttgggcgtttaaaaacggaatgttactttggtaaacggtttgagacctttgagcaactggaacaagctattcacgaatatattcattattacaatcatgagcgtattcaagtaaaactaaaaggactaagccctgtggaatacagaactcagtccttgaactaaatcagtctaactttttgggggcagatcaaaaaccaccgcacttttttgggcaatttacatcttaatttttgctatcgcgctcattggcattgtggtgggtaatttttattactataaaacctataacaattattacgatatgttgatgtttggtttagtggaagacgataccaaagccgtgttgaaaaatatctatgatgattaccctgttatttcaggatctctcgcagtgcttgtgttagctgcgcttcctgcgtactttatgtattatgcgttataccaaggattgttaaattgggatatgcattggtctgttgcaactttgctttttgttggctcattccttgccttggcattttttgtacgcggtacaatacgctccaaaccattaaccaaagatcattcgcaagtttcctctttagccgttatcaataaactagtcccaaatggcgtaattgctgtggaatgggcatttagagatcgtaaacgcaatattctttttgaggtggttgatttagacgaaggtaaagccttaatgcaacaagtctttggcacagatagcctgattgagcgtacgcctgttaatcctgcattgaaggaaagcaaacctcatgttgtatttgccttaatggaaagctttggtaccaattatttggttttagataaccctgaaaccaatgatttattgggacaattacggccgcactttgaacaagattttgtgttcaaacgctttacctctgattataacggcactgcgccaactttggcatcgttgcttttttatagccctattcaaaatatcagccaatcagctgcacagcaaatcgccctgccctatagtccatttaaaacctataaacaacaaggctatcgtacggtgtttatcacatctggtggtttaatgtggcgcaacttaggcaattatttgccgttgcaaggtgtggatgaatgttatgaccaaaatgatattatcgaaacttttcctgatgcaaaacctaccatgtcttattggggcattgcggatgaatatgcctttgccttagcagaaaaattactgaaagaaagtaatgaacctttatttatcaatatattaagtatgacgaatcatccgccttatgaagtacctcaacattacaaggcggagcgtattaatcctcaagtactagaaggaaaatttggcagtgaagaagaaaaccgcaaatccctttccacttatcaatatgctaataacgccttggggcaatttattacacaagtggcgcaaagtgcggtgggaaatcgaaccattattgctgctacaggagatcaccacgtgcgctgcgtgcgtttcgatgcgccaaaacagaattttatggcaatgggcgtaccgttttatgttcatgttccaacggaattacagagcaaacttgcccttaaatttgatccaagccgcattggttcgcacaaggatattatgcctacattatatggtttaagcttatcagatgcggaatattggaacctaggcgggcgcaatttgttggcggagcaagacaatgaaaaatatgcttttgcttataacgaagggctttatgccgatagcgaaggggtgagcgatggcgagcatctcacgcaatattcttggcaaaatccaaccgcactttatcctgacaatctttgagttaccgagttgaaaccagtgagtgataaaaaacgggcgcgaattcaggcttataaacaacttttaacatggcagattcattacttagtgaaaggattaaaatagtcattcctttcaagtgcggtcatattaccgaaaaaatggggttgatttaatgaaaaccccattttgcccttctctaaatatcccaaaacctacttcatattctcttgaatccttccttcatccaataattatttctaaaaaaagttgacaatattaatttatactagtttaatagtacaaaattaacaaatgacaggatgttaaaaatgcagtccgtttttatccaaaccaaagaatatcatgtggattattgcaatgatcccatcgccatttttgcgacactttgccaaaaccgacaaaataccttgcttttagagtctgctgaaatccaaagtaaaaacagtttaaaaagtttgttgctagtagatgccgcattaaaaatttcttgccaaggacaacaagttgatttcgaggcattgaccttaaatgggcaaggggttttaccctacatcgcacaacaattacagcctatttgtgaaataagttcgtttgatacccatcatctttcggtgaagttttctttgccaaacccaaatcttgatgaagacagtaagctaagcgccccgtcgatttttgatggattacgttgcttaacaacgctttatcagcatagcgatattccgattttcttagggggattatttgcttatgatttagtcaccaattttattcctatggaaaatattcaattaaaagacgatggtttgagttgccctgattatgtcttttatttggctgaaaatttattacttattgatcatcaaaccctgtcagcgacattgcaaaccttttgctttcatccaaaggcagccgatgacttgaatcaaagtgcggtgcaaatttgccaaaatttgcaaaaagttgaaccgcacttgcctcacatcctcgcctccacagaagttcgcacgaatttagaagatgaggcatttaaagatattatccgttcacttaaacatcatattcatattggggatgtattccaaattgtaccatcaagacgtttttctttagcttgtccaaatcctcttcgggcataccgacaactaaaacaaaccaatccaagcccttatatgttctttatgcaagatgaggtgtttactttatttggagcctcaccggaaagcgccttgaaatattccgcacaaacacgccaagtggaaatttatccgattgctggttcaagaccgcgaggttttgatgagcaaggtcaaatcgatctggatctggatgctcgcttagaattagagctacgcttagataagaaagaactcgcggagcatttaatgttggtggatttggctcgtaatgatgtggcgcgtgtgtgtgaaagtggctcacgccatgttaaggcattaatgcaaatcgatcgttattcgcacattatgcatttggtttctcgggtcgtaggaaaattgcgccctgaactggatgcgttgcatgcttatcaagcctgtatgaatatgggaactttaaccggtgcgccaaaaattaaagcgatgcaattaatttaccttgttgagcaacaaaaacgacatagttatggtggcgcagtgggttatttgtcctcaaacggtaatttggatacctgtatcgtgattcgttctgcttttgtgcaaaacggaatagcgcatattcaagccggctgtggcgaagtgttagattctgatccacaaatggaggcagatgaaacccgccataaagctaaagcagtaattaatgccattattcaaactcacagtgcaatataaggatttttatcatggcaaccattatttttttagataattttgattctttcacctataacttagtcgatcaatttcggacattaggtcatcaggttcagatttaccgtaacgattgtgatatagcgttgttagaacaagccaccttagctcaccccaataccctacttgccttatcccccggtccgggtaatccctctgaagccggcaatttactgccattaattgcgcgcttaaaaggcaaagtgcctatgattggtatttgcttggggcatcaagctttgattgaatcttttggtggcaaaattgttcatgccagcgaagtgttacatggcaaggtatcgctaatttctcatgataatttagctatgtttgaaggtttgaataatcctatgcctgttgctcgctatcattcattaatgggcgttgagttgcctgatgagttaattgttaatgccacttatgaaaatatcgtcatggcaattcgccataaatctttaccgatttgtggttttcaattccatccggagagtattttgactgtacagggatctcaattattgaaacaaactatcgcatatttaatgaattttaatagaacacaaggaatataatatgcaaacagaacaactcttacttaaaattattgagcaaactcatttaacatcctcggaaatgcaacagcttttcacatccatcattcaaggggaattaaatccaatacagctcactgcgctgttaattacgctaaaaatacgcggggaaagcgctgaagaaataagtggtgcagtggcagcatgccttaatgcggcacaacccttccctacccctgattatgcatttgccgatattgtcggcaccggtggggatagtgccaataccattaatatttctaccgcctctgcaatagttggagctgcttgtgggttaaaaatcgcaaaacatggaaatcgaagtgtatcaagcaaaaccggctcaagcgatttattaaccgcacttggggtcaatatcaatatgccagcggatattgcaagacgggcattggatgaaatcgggctttgttttctttttgcccagcaataccacctcgggtttaaacacgcggtttctgtgcgtcaagcactaaaaacaaggactatcttcaatattctagggccgcttatcaaccctgcacgaccaaaacgtcaactacttggtgtttattctcctcatttactcaaaccttatgccgaaaccgttgcacaactcggtcatcgacatacttttgttgtgcatggctgtggattggatgaagtggctattcatggacggactgatgtagcggaaatctatgatgggaaaatcacctactacagcctttctcctttggattttggttttcaagccaaaccattggaatctttacgtggtggtgaacctgcagaaaatgcccaaatgataaccgcactgttacaaggtcaaggcaaacctgaacatgcccaagccgttgcaatgaatacggcattattgatgaaattgtttggttatgagaatatcaagcataacgcacaacaggttttggatgtcatccaatctggtaaaagtgttaatgttttatctcaattaacgcgttattaaaaggaattcactatgccacaacgccacacgcaacctagtattttgaaaacaatcgtacaggataaattactttggattcaacaccaacaaacccattttcctttgaatgcgtttcaacatagccttcaacctagtgatcgggatttttataccgcacttcagcaaggttcggcgcaaaaaccggcttatattcttgaatgtaaaaaagcctctccctcaaaaggtttgattcgagccaattttaatgtagaagatattgcacaggtgtataaaagttatgcctccgcaatttctgttctcacagatgaaaaatattttcaaggggattttacttatattccgcgcgttcgccagctcgtcaaccaaccaattttgtgcaaagattttattgtgagcgaatatcaaatttatttggcgcgctattatcaagcagatgcgattttattaatgctttctgtgttagatgatgaaacctatcgtcgattggcagaaattgcacatggattaggcatgggaatattaacggaaacttcaaatcaaacagaattaactcgagccattgagcttggcgctaaagttattggtatcaataatcgtgatttgcatgatttatctgtcgatattgctcgtacactgcctcttgcacgccaaattccggcagaccgaattattattagcgaatcaggtatttaccaccatcatcaaattcaacagctgaaatctgatgtacatggttttcttattggtagcagtttgatgggaagtcccgatctccatcaaagcgtccgcaccttaatttttggcgaaaataaagtttgtggacttactcgtccgcaggatgtacaagccgtgtatgagcaaggcgcattgtatggaggcttaatttttgcagaacattctccccgacagctttcattacgccaagctcaagagttggtggtacaggctcccttgcgttttgtcggcgtatttcaaaatcaatctattgattttattgaaaaaatcgtcaaccaacttgatttatttgcagtacaattacatggcgaagaaacggctgaatttattgccgcacttcgccaacaattaccgcaatcatgccaaatttggaaagcaatttcagttgatgcgccccctaaaattacattagccgcccttgcaaccaaaacacaaagtaaaagtgcggtaaaaattccgtcgattccccatgtggatcgctacatattggacagcaaaatcggcaatcaacgtggagggactggacagccttttgattggtcgaaaatccctcaagaatataaatctaaactgctccttgccggtggcattaatccggacaatattgagcttgccttatcacaacattgcttaggtcttgatctcaattccggcgtagaaagtctaacgggcatgaaaagcccacaaaaattagcagcggtgtttaacaaaattttggagcgtcaaacacctaaaaaattatcataaaaatgtaaaaggaaatgctatgacaaccattcttaatccctatttcggtgagttcggcggtatgttcgttcccgaaatcttagtacctgttttacaagaactggaaaaagcctttgtggaggcgaaagaagatcctgctttccaacaagaatttcaggatttattaaaaaattacgccggtcgccctacagcattaacatgttgccgtaatttaacaaaaggcacgaacactacactttatttaaaacgtgaggatttattgcatggtggtgcccataaaaccaaccaagttttagggcaaattctcttagcaaaacgcatggggaaaacacgtattattgctgaaaccggtgcaggacaacatggcgttgcgactgcattagcctgtgcaatgctcaatataccttgccgtatttatatgggcgcaaaagatgttgaacgtcaatcgcctaatgttttccgaatgaagttaatgggcgccgaagtgatccctgtacaaaaaggctcttgttcactcaaagatgcttgctgtgaggctatgcgggattgggctgcaaattatgccacaacacattatctgctcggtaccgccgcaggcccgcacccatttccaaccatcgtgcgtgaattccaaaaaatgattggagaagaaaccaaaaggcaaattttggagaaggaagggcgcttacctgatgcggttattgcggctgtcggcggcggatcaaatgccattggtatgtttgccgattttattgaagaaaaaagtgtacgcctaattgggattgaaccagcaggcaaaggcattgaaaccggtgagcatggtgcgcctttacgtcatggttcagtcggtatttattttgggatgagatccccgattatgcaaaccaaagacgggcaaattgaagagtcttatagtatttcagccggtttagacttcccttctgtcggcccgcagcacgcgcatctccatgctattggtcgtgcagattatgagagcattacagatgatgaagcacttgaggcatttcaagctttagcacaacatgaaggtattattcctgctttagaaagctcccatgctttggcttacgcattaaaactcatcaagcaagatccaacaaaaacacaactacttgttgtgaatctatccggtcgtggtgataaggatattttcacggtggataaaattttaactgcaaaaggagctatcaaatgattgtgcaatcatctcgtttcagccgtttatttgctcaattagctgataaaaaacaagggggatttgttccttttgtgacactttgtgaccctgattttgagcgctcttttgagattatttgtactttagttgataatggtgcggatgccttagaattaggctttcccttttctgatcccttgttggacggaccggttattcaggctgccaatgatcgggctctcaatgcaggttgtagcaccgaagaaagttttcagttacttgccaaagtgcggtcaacctatccagacataccgattagtctgttgctttgtgccaatttaatttatgcgcaaactcttgataaattctatgcacgctgtgccgaagtgggcgttgatgccgtattggttgcagatattcctttactcgccgcagaagaatatatccaagctgctcaacgtcatgatgtacagccggttttcatttgtccacctaatgctaatgaatccacaattaaagcggtagctcaacatactcgaggttatacttatttagtctcaagagccggcgttactagcgcagaaaatcaaacacaagctgccaatttagatgttcttattgaagggttaacccaatatcaaagcgccccaattttacaaggttttggtatcgcaaaaccggaacaagttaaagaggcgctgcgtttaggggctgccggcgcaatctcgggttccgctacagttcagattattgaacgaaacctcgacaatcaccctcaatgtttgcttgaattggcacaattcgtacaaaacatgaagagggcaacacatctctcataaataggaaatataaaataaaaagggcgaaatacttctttcgccctgtcatcctactgtctgttatgccttttattcctaatattaagaataggataacaactagaaattcaacactttatctgcattgaccgtccaatcagctaattcaactaatgtaccaatttcaacgccttcagctggtggtaatgaggtaattccacgtgcattagtgcaagttttacataatttgaccatcgccccttgtgcggtaagaatttcaagcatttgttgcaaatggtaaccttctgccagctgttgatgagcaagtcccccgctaacggcatctgacattagcaataactttaattcaaccgcacttttgtgttgctcttgtagttgtaaagctaaacgtaatgcgctgaaaaaatgttcatcaccatatggagaagaatgaataataaaaagtattttttgcatgagaatatccttatttgaaatgaaatagaaataacatttagaaaaaatgactatttatcataaagataaaaatgatctgcaccccaaaagttggactaaacaaccaactaattaaggtgcaaatttttatggctaaatacacccaatcttttaaacaacaagtgatcgaattttatcttcaacataataaaaatcgctcattaactcgtcagcattttcaggttaaggaaaccatattaagatattggattaatcagtataatcacacctcgtgaaggaactacgccaccaatttccgtttgagattttattgcaattggttgatttaaaacggagtgcgttcttttatcatcttgctgaaaaagacaataaaaatgcagcgattaagcaagaagtcatcaaaatttatcacaaaaatgacggtaattacggttatcatcgtattacgctggaattaagaaaaatatggctgattaaccataaaaaagtccaacgcttactgcaacaacttggtttgaaagggaaaaacaaacgcaaaaaatatcattcttatcgtggcgaagtcgacaaaattgcagagaatttgctaaaacagaattttcacactacagtcccaaatcaaaaatgggtcaccgatgtgagtgaatttaagtgtgcagaaggtaaactttatctctcgccgattaaggacttgtttaacggtgaaattattgcttatgatgtggcaagaaacccaagtttcgagcagataagccgaatgataaaacaagctgtggcaaggcttgacggagcaacgccaatactctattctgaccaaggttggcaatatcaaatggtaagttatcagtcgatattgaagcaaagtggcatcgtacaaagtatgtcgagaaagggaaattgtttggataacagtgcaatggaaagtttctttgggcgtttaaaaacggaatgttactttggtaaacggtttgagacctttgagcaactggaacaagctattcacgaatatattcattattacaatcatgagcgtattcaagtaaaattaaaagaactaagccctgtggaatacagaattcagtccttgaactaaatcagtctagctttttggggtcagatcatagctactcgcaattttatagccgagctgcttatgacggctctcgcgaaatcagtttttatcttgataaagctgttcatggcaaaggtatcggtaaagcctgtgtgaatttcttaattaaacaaatgcccaattaccaactgcatacattattagcttttgtgttcggcaataacgatcaaagtttaggcttactgaataaaatgggctttgaaatttggggaaaacttccccaagttgcagatatggaaacagattttgaagatttagtaatcttaggattgaagcaaggcgtatgtggcaactaaaggcattttccgaactttctgcccaagaactgtttgaaatttaccaagctcgagtcgctgttttgtcgtagaacaaaattgtgcgtatcaagaagttgatgaaaaagatcggaaagccttgcacctttttgcaaaaaattcggcaaaactgaccgcttactgtcggattatccccgaacaagatggtgtgcatatcggcagagtgttggttaccgaagaagcacgaggaacaggatttgcgaaaaaattgatggcacaagccttaaccatttgccagcaacaatggcaaagtgaaaacgtctatgtgcaagcccaagcctacttgcaagatttttatcaatcgcttgggtttaaaccgatttctgaggtttatttggaagatgggataccgcatttggatatggtgaagggtgagtaatatgatgaaattgaccgccttgctaggagaataacaatgacgaaagacgaaattctacaaaaacaaaaagagcttgatgttttattctctgcttggatagcggaaaagaaaaagaaagaagttttgacctatcgtcgagaaaatggggatttgattgagcatcacccaaatggttttattcgagtgattgaatatgcacaataagtctcttgctattttctactgcggaacaaatggagcaggtaaatctacattacgctcttttaatcgggattccgtgcaaattgtgattgattcagatcatattgcaatgcaaattaatcctgacaatccaagattggcagatattgaggcaggtagaaaagcaatagagctatttaaatttgcaatacgacataatatttctttttcaatggaatcaaccctatcgggtaaatctattttgcaaagaatggaagtagcgaagaaaaatttttatactcgtttaaattatgttggagtagatgatccaaaaataaatattgctcgtgtcaaagcaagagtaaaagcaggcgggcattttattgatgaagagacgattaaaagacgttatcaaattagtcgagaaaatttaattcaagcaattttattaaatgatgaaacatttatttacgataattcatcagatagtcccaaaatacagcttgttatttcagcaaataaaactgttactaaattagcagataaattgcctcaatggtgtgaggatttagtgaacgagttgttaatattggggtatacaaaataaaattgtgcttcgttattgagtttggacaaatctcccctaacccctctttgctaaagagggggatcagatcgaagaaaataatcgctcatctgaaaaattgagcctctttttgaagtacttcgattttatattttcgtttgagccagttcccctctttagcaaagaggggttaggggagatttggcagaagtgaaaacgaagtcggtaagtaaaatttgccttatccctagcacggcaaagccgtactagatcaagcataagttagtcctttcaggactttgatttgagctacagtgtagcttatttatacataatgttgagaaatatatgaaaatagaagaaaacacagttttacagaaattattaaatttaattgatagtttaagtactactaaatttaaagatgcaagtgatgagctaactaactttatttattctttaaacaaaaatcagttaatagctcttgtaagagctattggtatattacctgaatcaataaaaccaagctcaacccaagaaaaattattttctaaagctggagatattgttttagccaaagctcttcaattacttaatttagatgctagacctttagaacaaagaggaaatgctgctgatgtaacagcactatctatagagtttaactatggcttagttgctgatgcaaagtcttttagactaagtcgcacagcaaaaaaccaaaaagattttaaagtaaaggctttaagtgactggagagaagataaagattatgctgtattaacagccccctttttccaatatccaacaacacaaagtcaaatatttaaacaatcattagatgagaatgtattacttttcagctgggaacatttagttattttattgcaattagatctaaaagaaacagattcttttacgtttgaacaattgtggaattttccattaaaacaaagtaaaaaaacatcggtggcataatctgagaataattttatgaaagattttaatgaatattttatgaagttatttaaaatagataaaaaaacattacataaattattccaaaatgaaattaaatttattgaaaatagatctataaatgaaaagtcttattgggaagggcaaattaaaagaattaaatctttaactagagaagaagctattgaagaattattaaaagaaataaacatatcatcaaagatagatatcattgatgggtttgttgaggcaataaagaatgatgaaagattgtatctataatgatgattcgataattgctataaaaaatatcaaaagtaattctattcattcaatcatatctgatattccttatgggatagattatgatgattgggatacgttacactctaatactaacagtgcgttaggcggtagttccatagctcaacagaagacatctctatttaaaagaagaggaaaacctcttaatggttggtctgaagcagacaaaagacgaccacaagaatatcaagaatgggtagaaagttggtctaatgaatggtatagagttctaaaatcaggtagttctgtctttattttcgctggaagacaatttgcacatagagttattgttgcttttgaaaatagtgggtttacttttaaagatatgcttagttgggaaagagataaggcaccacatcgtgcccaaagaatttcctgtgtatttgaaaaaagaggagatacttttaatcagcaaaaatgggcaggttggagagttgcaaatttacgtccaatatttgaaccaatactatggtttcaaaagccatataaaacaggggggactttagcagataatttaatagagaatgaagttggagcttggaatgaaaatgcattaacatcttggaatattcagcgaggagctttaaatcattcaaacatgtttaaagtacaggtgaccacagaagatagaaaatatcatatcacccaaaaacctttaaacttaatgaaattactggtggaactagtcactaaagaaaagcagattgttttagatccttttgctggtagtgcatccaccttattagctgctcgagaattgaatagacattttataggatttgaaaaaaataaagaaatatatgatatagcagttaaacgcttagaaaatactttggataataagttagtacatcaaaaaagagacaacaatgacccaaaaattcgaaatggcagatcgtttcgactcatcggcagtcgaacaagcactttataaacactgggaagaacaaggctattttaagccgaatgaaaacccgaatgttccaagttactgtatcgcaattccaccgccaaatgtgacggggagtttgcatatggggcacgctttccagcaaaccttaatggataccttaatccgttttaaccgtatggaaggcaataacaccctatggcaagcaggtacagaccacgctggaattgcgacccaaatggtcgtggaacgtaaaattgcggcggaagaaggcaaaacccgtcacgattacgggcgtgaggctttcatcaataaaatctgggattggaaagcttattcaggcggtacaatcagccaacaaatgcgccgcttaggtaactcaattgactgggatcgtgagcgttttacgatggacgaaggcttgtccaatgcggtaaaagaagtgttcgtgcgtttacacgaagaaggtttgatttatcgtggtaaacgcttggtaaactgggatccgaaattacacacggcaatttccgatcttgaagtggaaaacaaagagagcaaaggctcgctgtggcatttccgctatccgttagctaatggggcgaaaacggcggacggtaaagattatttggtggtagcgactacacgtccagaaacgatgttaggcgatacagcggtggcggttcaccctgaagatgagcgttaccagtctttgattggcaaaaccgtgatcctaccgcttgcaaaccgtgaaatcccgattgttgcggacgattatgtagatcgtgagttcggtacaggcgtggtgaaaattactcctgctcacgacttcaacgactacgaagtcggtaagcgtcatcagttgccaatggtgaacgtgatgaccttaaatgcggacattcgtgcggaagcggaaattatcggctcagacggtaaacctttgacaaattacaccgcacttattccagcggattatcaaggtttagagcgttttgcggcacgcaagaaaatcgtggcagactttgaagcactcggtttattagatgaaatcaaaccgcacgacttaaaagtgccttacggcgaccgtgggggtgtgccgattgagccgatgctgacagaccaatggtatgtgagcgtgaaaccgcttgccgaagtggcaaccaaagcggtggaagacggcgaaatccaattcgtgccgaaacagtatgaaaacctttatttctcttggatgcgtgatattcaagactggtgtatttctcgccaattatggtggggacaccgcattcctgcatggtacgatgcggaaggcaacgtttatgtggctcgtgatgaagcggaagtgcggtcaaaatatcagttaaatgctgatgttgcgttaaaacaagatgaagacgtgttagatacttggttctcatcaggcttatggacattctcaaccttgggctggccggagcaaacgaaagaactcaaaatgtatcacccgaccgatgtgttaatcacaggctttgacatcatcttcttctgggttgctcgtatgattatgtttacgatgcacttcatcaaagatgaaaacggcaaaccgcaagtgccgttcaaaactgtgtatgtaacgggcttgatccgtgatgaacaagggcaaaaaatgtcgaaatcaaaagggaacgtattagacccgattgatatgattgacggtatcagccttgaagatctacttgaaaaacgtacgggcaatatgatgcaaccgcagttggcggaaaaaattgccaaagcgacccgtaaagaattcgagaacggtatcgctccgcacggtacggacgcactgcgtttcaccttagcggcattagcgagcaacggacgtgacatcaactgggatatgaaacgtttggaaggctatcgtaatttctgtaacaaattatggaatgcgagccgtttcgtactcactaacgataaattagacttatcggcaggcgaagtggaatacagcttggcggatcgttggatccaatccaccttcaaccgcaccgtaggcgagttccgtgatgcgttaagccaataccgtttcgatttagcggcaaataccatttatgagttcacttggaaccaattctgcgactggtacttagaactcaccaaacctgtgtttgctaacggtacagatgctcaaaaacgaggtgcaagccaaaccctcgtgcgtgtgttggaaaaattattacgtttagcgcacccgattattccattcattacggaagaaatctggcagaaagtgaaaggctttgcaggggtggaaggcgacaccattatgttacaacctttcccgaaagtagaagaaagccaaattgacgaagcagcagaaatgcaaatcaactggttgaaagagttgattgtggcagtgcgtaatattcgtgcagagtgcaacatcgccccaagcaaaggcttggatttcttagtgcgtaacctgtctgacgaacattgcaaaatgttagcggaaaacgaccgcttgttaaaagcaatggcgaaattagacagcgtacaagtgcttgcccaaggcgaagaagctccgctttcagtggcgaaattggtgggcaacgcagaagtactagtgccaatggctggctttattaacaaagatgccgagcttgctcgtttgaccaaagagatcgaaaaacttcaaggcgaagtgaaacgtatcgaaggtaaactcagcaacgaagcctttgtcgcaaaagccccagaagcggttattgccaaagagcgtgaaaaaatgcaagagtaccaagacggacttgagaaattgcagacgcagtataaggcgattgaggcgttgtaatatagtaataactgtcgttggaggtgatattctccaacggctctattagtcacgaaaacacatttcattatgcacaatacagtttataaatggcctgagccgtctcatctctatccagatagaggaaaaaaatcttatagattaaaacgtttccgttatcgttttcgctctatattacatagatctctcataaggaaatttgaacataaaattaattctgaatcttcgttaaaaccgttattaatcaaaagagcagattatagttatcctttagttcatcgtttcttagataaacgctttaatagtcaaagacgttttaacatgatttgtgacaatttagactttttacctaaagtactcttatctaaaaatctccctcagttatgggatagccctatatgttttacagaagtaattgaagattttgaaatctatttaaatgtcaacgaatatcaaccaatggagggtttctgggcattagaattacgctataaaccaagcggtcagttagtttatttattgacatttggtaaattagaaaatgcattacttatcgcagttattcaaggtccgaactttgaaggttctaaagaattagtcaaacaactaactaaaaaatgccatgggcttcgtccagcctatttaatggttgaagccatgaaagctttaactcaggtcttagggtattctaaattatttggcattccacaaaaatatcagaataagtcacgctttgttcaaagcacacgctattttgttgattatgatactatttttaaagagagtaatggtgaattaaaggaatattgggaacttcccttaacattagagtcaaaaaaccttgaagatattccgagtaataaacgctcaatgtatagaaaaagatacacaatgcttaatcatttattaagggctattgcttctaaactaaaatctgagttagatgtagtcgtttagataaattcggtacttaattttaggggcatagtagacaaaatggttgctaatttcgtgaaaactatgcctatatgacaaagtggttactaatgaatatttttaattattcttagcaactctttttatttaaaaaatcctgtataaacaatatctgagaccctatcccaaattctgtgtaaacacccatttcaacttaatggtgatcgtctaggcgatcaccaaaatcaatcataaatcgattcatcgccagtttccagttctgaatcggcattgtccatttttttgatgcatctttaatcgcaagccaaatcactttgaaaactgaatcatccgtccgatttttcgttaatccattatgattatttaattttcgtttaagttcactaaatagcccctctgagcgatttgtcgtcttttctatatttaattaagtatgtttttcatagataaaaataaaatccatataacgctttaaactggcataagcatttcttacattgcgatgtttataaggaaaatagcctttttcattcgctttatcactcctttcttttaaaaatgcttggtgttttatgaaccaagagtgtaatcgccgataaaattcattttttgagctttttgtgagtgtttttgcaattatttttaattctttacccgcttgtgattgatgcttttttcttaatttttgcatcactatcgctaccatataaaattgacacatttgtactggtgtattaaataaatctttcatcaagccacgtctaccatcacagacaattgattgaattttatagcctttcatacgaagtgaattaaacgctattctgtaataaacatcttttcccgttttgatgacacgatggtaaaccactttttttagaaagcgaatccatcaggactaaaatactaaattcacgaccaaagaaggtagtatcctacaataatatttaaatcacgtgatagtggtggatttaatgctgttttaggggctttatcaatatatctttgaatcgttccgactgaacaatgatatttaatagcaagttgttgataggtttgttttcctattgaataatcattccaaatacttattggatttaatttctttttaagggtaaatgttttattacaggcattacatttatagcgttgaatattatttcttataccatgtttgtgaatgtcgctactgtggcaaaaatgacattttttggttcataattcaacaaagtggcttaaagcccgtaatataaggctttaagccactttttagcagtagatttgtctattataccttttaatagaaaggcttgtaagaatattcatcagcaatcattttatctactatactttgatagatcttgtcaaaaacaggagctatcggagaaagggatattactttttgtttgtgatattactttgaatcttttccagtgactctctcgtcatttcttgtgatttttccagcatttcggctggatcaagtttatctccccattctgtaactttattatttaataaggttactgataatctatcttgagataacatctgattatctatcatactaaatccgacaagtgttttcccccaatagcttagcacttcaacgtgccctttatctgtatttctagcagatactttatttggttgccctaataagctaatcacatcttgtttagacatatccatttgtaattgcatagctagctgattatatgatggtttaggtgtacagccgactataaaaataataaaagaaatacttgctaataattttttcatattaagctcctacattgtaattaacaatctaaaatttctaaatagaactcgtaagaattagattatttgaatgccacacgcgcatttctaaacaacctcatccacgccccatcttccctccagtactccggataccaagagttgctcaccgcacggtaaacgcgttctgggtgtggcatcataatagcgacacgtccgtctaggttagaaatggcggtaatgccgtttaccgagccgttcgggttggctgggtaaacttcggttgggttgccgttattgtcgatgtattgggcgataaccaagttctgcttttgtaaattttcaagctgatctgaccgcttgaattccacctgtccttcgccgtgggaaacggcaatcggcatatgcgagcctgccattccgctgaaccagagtgagttggtgtcgttgattttcaccagtcccacacgggcttcaaagcgttcggatttgttacgcacgaagcgtggccagttttctgtaccaggaataatttctgccaagtttgacaccatttggcaaccgttacatacacctaatgcgagtgtattcgggttagtaaagaattggctgaattgatcacgcaacattgggttgaataggatcgatttcgcccagccgccgcctgcaccaagtacgtctccgtaagagaagccgccgcacgccacgagagcattgaagtcggcgagattgcgtctgccagccattaagtcgctcatatgcacatcaatcgcattgaagcctgcacggtcgaaggcggctgccatttcgtaatggctgtttacgccctgttcacgtaagattgccacggtcggtttcacgccacggttgagaaacggtgcggcaatatcttcattgacatcataggttaagaatgcagataagcctttgttatttgggtcttttttggttgcaaattcttgatcggcacattcagggttgtcacgcaagcgttgcatttggtgtgtaagttccgcccaaattccacgcaattcagagcgtttttcgctgagtaatttgcgtgtgccactggtgatttcaaacagatcgccttccgttgccgagccgatgtctttggtaatgtgtagcaagttatgggctttcaatacatcacgcaccgcatttaagtcgctctctttgatttgaataaccgcaccgagttcttcgttgaataacacggctaaaccattgtcgcctaatgcggtaatgtgagctgatacgccacagttgcctgtaaacgccatttccgcaagggtggtgattaagccaccgtctgaacggtcgtggtaagcgagtaatttatcatcagcaactaaggcttgcattgcgttgaagaagtttttcaaggtttctacattcaccacatccgcaggtttatcgccaagttgtttgtaaacctgtgctaacgccgttgcacctaagcggtttttgccttcgcctaaatcgagtaacaataagcgagttgtgcctttatcggtgcgaagttgtggagtcacggttttacgcacatcttccacacgggcgaaagccgaaattacgagagaaagtggcgcagttaccgctttttgctcgccgttctcttcccaagtggtacgcattgacattgagtccttgcctaccggaatagtaatgccaagtgcagggcaaagctcttcgcccaccgcttttactgcttcatataatcctgcgtcttcgcctgcgtgacctgccgccgacatccagtttgccgagagtttaatgcgtttaatatcgccgatattggttgccgcaatgttggtaatgctttccgctaccgctaagcgagcagatgcgccgaagtcaagtaaggcaaccggtgcacgttcgcccattgccattgcttcgccgtgataactgtctaaacttgctgtggttacagcacagtcggcaacagggatttgccacgggccgaccatctgatcgcgagctaccattgccgtgaccgagcggtcgccgatggtaattaagaaggttttttccgccaccacaggcaagcgtaacacacggtggaaggcttctttaagctgaatatcttcctgtgcaagcggtggattttggacggtttttgacgaaacctgacggtgcattttcggggtttttccgagtagcacgttcatcggtaaatcaatcgggttgttgtcaaaatgatcgtcgtgtagggttaaatgtttctcttcggtcgcttcgccaatcacagcataaggtgcgcgctcacgttggcaaagggcttcaaataatggcaatttgtctgctgcaaccgctaatacataacgctcttgcgactcgttacaccagatttcaagcggtgacattcctttctcatcacacaaaattttgcgtaaatcgaatttaccgccacgatcaccgtcgtgaactaactccggcattgcgttcgataaaccgcctgcacctacatcgtgaataaataaaatcgggttctcatcgcctaactgccagcaacggtcgatcacttcttggcaacggcgttccatttctgggttttcacgttgaacggaagcaaaatctaaatcttctttggatttgcctgacgccattgacgaagccgcaccaccgcctaaaccgatattcattgcagggccaccaagtacaattaatttcgccccaacaggaatttcgcctttctgaacgtgttcggcacgaatattaccgataccgcctgcgagcataatcggcttgtgataaccacgaacttcttcactaccaaaactgtttactttttcttcataggtacggaaatagccaagtaatgcaggacgaccaaattcattgttaaatgccgctccgccaagtgggccttcaatcataacatctaacgcagatgcgatacggttcggcttagaaagcggattttcccacggctgttcaaagtttgggatcaccaagttagacaccgagaagcctgtcaaacctgcttttggttttgcaccacgccctgtcgccccttcatcacggatttcgccacctgaacctgtcgccgcccctgggaatggtgaaatggctgtcgggtggttgtgggtttctactttcattaaaatatgcgcatcttcttgatgatagcgatattgcccgtcttgatcagggaaccaacgaccgactttggaaccttccattaccgccgcattatctttataggcagaaagcacataatctggcgttttctcgaaggtgtttttaatcattttgaacagcgatttctcttgtttttcgccgtcaatcgtccagtctgcattgaaaattttatggcgacaatgctctgagttcgcctgtgcgaacatataaagctcaatgtcgtgcggattgcgatttaatgccgtgaaattttccaccaaataatcaatttcatcttctgccaacgccaaacctaattccacgtttgccacttctaaggctttgcgaccaccgtttaaaatatccacagtcgtaaacggtttcggctcgtgctgggcaaatagttggttcgcttggttttcatcggttaaaacagtttctaacatacggtcgtgcaacaagccttttagggttgccaactctgcttcatttaacgcttgttcaaactcaaaatagtacgccaaaccacgctcaatgcggtttaccgcttctagaccacagttatgggcaatatctgtcgcttttgacgaccacgaagagatcgtaccaatgcgaggggttacaatcaaacaaaagccggttggttcgtgttccgcaagggttgggccataatgcaacagctcttggattttttttgtttcatcggctacaagcggtcggtttagctcaacaaaatgcaaatattcggcatagaccgatttgacaggcagttgatgttgctcgaatttttgttgaagttggtttaaacgaaagtcagataaggcaggtgagccacgaaaggtttgtacagtcattgggcagttccgttaatgatagaaaacaaaattgaaggcattataacggattgcgcaaacgtttgcattttaaaaattcagaaagtttttctcattttatatttggaaggggtagtctaacgaaacagtatcgcacaattggagtaacaaaaatagcactcatctagacaatatgccttcttctgttaatttatttcgtacaatctatacttgaacagtattcaaaggctataagggaataacaaatccccgccttttaagacggagatatttattagtagcttgaatttataataacttcctctccatatccgccagcctgagggaatggcgtataagttgaacttgtggtacgcaatacacgaataccacgaatgccagcctctttagcggcgagaatatcatcatcgctatcgccgtagtgtaactgaatattatgttttaaaatccctgcggctttattgtattttgtttttaatttatcttgaccgtgtccgcccataaaattaacaggttgcatattttttatgccaaaggttttttcaagtaacggggtgacttggtcgtccttacccgcagttcttcctgtgataaagaaaatctgatcgccacgctcttggtgcatattaatgagatcttgagctacctgtttcggaatagagtatttatcacagcctgcattaatttcgtcccagaactcttgatttttgagatagctataatcattcggtgaatacttctgcttaccatagtagaagcaaccgctacttgctaatacggtatcatcaatatcaaagctcacattcatcggggctttgccttttaagctctctttaatttgctcaatagaaacccaatgaattggggcttgctgttgctctgctaaacgtgtgttaaatccggattgagtataaggctctttaggggcagcttgagcagaaagtgcaacaaacatatacgctaacaaagctgtacgtaaaaaaatagatttcattatatatactccttttataagtgaacagtaattgagctaatactcagatgaattttaattttcattctaaataaaatcaaaatactttaattaacggattgatataaaacaaattatagttcttttaaatttaaattgttaagatcgttttcacaataggttatagggaacataatatgaaaactgcaatattttatttaacaaatgatggacaaacaaaaaaaatttctgactatcttgcgaaggagctacagcaagagacacaagttttctccttacgagacttttctctttggtctgtagaaacattagaacaatttgattgtattgttattggcgcatcgattcgatatggacattttgacccagtattggaacaatttattgatcgatattatgagctactaaatagaaaaaaatctgttttttttagtgtcaatttaactgctcgtaaaataactcgtaatacaccttatacgaatacatatacacgtaaattgctagacaaaattctatggaaaccaaatatcgctgaagtatttgctggagcattactctatcctcgctataatttttttgataaaaccatgattcgctttattatgaaaataacgaaaggtgatacagatactagcagagagtatgaatatacagattggcagcaggttagtgaattagctcaacgaatcagaaagctatcatagtttatccgaatgatgaattaacacaaaccgttcccaaagctgttcattagtttcaatatgctcaggatcggtgatgatacagttgttgatcggacacactttttggcaggttggcgtttcgtaatgtccaacacattccgtgcaaagatcgggatcgatgacataaatttcatcgcccattgagatcgcttgattaggacactcaggctcgcacatatcgcagttggtacatttgtgggtaatcaataacgccataatttgttaaatgaggaataatttggaagagagattataccgaatagtgcaaaagtagaaagtctttatacataattttgcaatttgttatgtaaatcttaccgcttgactatacatttttaaatgacaaaaaggtcgatttcgcctatcattctgtctatcaatgtgaggacgaacttatgacaaattttgcttatcttcaacaaaaacgtaaacagttaaagctaaaagtgaatgatgtttgcgagcaagcaggggtaactagagcttattttaaccaattagtgtcggggaaaattaaaaatccaagtgcgacaaaattaggtgcgttgcataaagtgttgaatatcgttgaggaacaaaatcaacgagtaggcgtaatttttggtaagttctatccagtgcatacggggcatattaatatgatttatgaagcctttagtaaggtggatatgctacacgttattgtttgtaccgatactgaacgtgatttacaactgttccgtgatagtaaaatgaagcgtatgccaacgaatgaagatcgtttacgttggatgcaacagatttttaaatatcagcaaaaacagatttttattcatcatttagttgaagatggtattccaagttatccaaatggctgggaaggttgggctgatcgagtgaaagaactctttgccgaaaaacatattcagccaacattagtctttagtagtgagatccaagataaagcaccttacgagaaatacttaaatttggaagtgcatttggtcgatcctgaacgtaactcatttaatgtatcagcgacaaagatccgcaacaatccgttccaatactggcgttttattccaaaagaggtgcgtccattctttgtgaaaactatcgctattttaggtggtgaaagtagcggaaaaactgttctagtcagcaaacttgctaatgtatttaatacgacatcggcgtgggaatacgggcgagaatttgtctttgaacaacttggcggtgatgaacaggcaatgcagtattcagactatccacaaatggcattagggcataagcgttatgttgattatgcaatgaagcacgcacacaaagtggcgatcattgatacggattacattactactcaagcattctgtattcaatatgaaggcaaacctcacccattcttagattcgatgattaaagaatatccttttgatgtcactattttattatcaaataacactaaatgggttgatgatggtctgcgtagtttaggttcacaaaaacaacgccaacgcttccagcagttactcaaaaaattgttagaaaaatataacgtaccttatattgaaattgaatcgccaagttatttagatcgttataatcaaaccaaagcagtgattgaagcgatcttaaatgaagaatccataacattaacttttaaaaaccaaaacgagaagagcgaatgatactttttgcgggcgatcctcacggtagctacgtccacctttacccctttgttcaagaacgtgagaatgtggcgttagtgattttaggggatttgcaattaaccacgaccgcagagttggataagctggctcaacactgcgatatttggtttattcacggtaaccacgatagtaaaacggttgctgcgtatgatgctatttggggaactgcttggaaagaacgaaatcttcacggtcgcgttgtcaatatacaaggcacaaaaattgcaggactagggggcgtttttagagggcatatctggatgcctcctcaccgcccaatgttctttgatcctatccattattgccaatatagtccacaagagcgtatttggcgaggtggtgtaccactgcgtcaccgtacctcaatttttccttcagatgtggaaggtttagaaacgcaaaaagcagatattttaattacccacgaagctcctcgcccacacccacaaggttttgcagtgattaatcaactggctcgaaaaatgggcgtgaagaagatttttcacggacatcaccacgataattttgattatcgtctaattaatcgtaataaggcctgtgaaatttttaatatcggttttagaagtttagcagatattcaaggcaactatttgctaattggcgtagatgatcgggataaataaaattttattagcggtcagtttttgtcaatagtttgcaaatcttaatataacccatccccgtcggttgtgatctctgactaaatcagggaaaatagccaccatttttgaaaaagaaaacgagaatagaatgtcattaaataattaccctcaagaagtaaataaacgcagaacttttgcgattatttctcaccccgacgctggtaaaacgaccatcaccgaaaaagtgttactttacggaaatgccattcaaaccgcaggttcggtaaaaggtaaaggctcacaagcgcacgctaaatccgactggatggaaatggaaaagcaacgtgggatttcgattactacctccgtaatgcagttcccttacaatgattgcttagtcaatctactcgacacaccagggcacgaagacttctcggaagatacctatcgtaccttaacggcggtggatagctgtttaatggtaatcgacagtgcaaaaggggttgaagaacgtaccatcaaattgatggaagtaacccgcttgcgtgatacgccgattttaacctttatgaacaagctcgaccgtgatattcgtgatccgatggaattgttagacgaagttgagagcgtgttgaagatcaactgcgtgccgatcacttggccgattggttgcggtaagttgttcaaaggcgtttatcatctctataaagacgaaacctatctctaccaaacagggcaagggcataccattcaggaagtgcgtattgtcaaagggctaaataatccagagttagatcaagctgtgggcgatgatttggctcagcaactgcgtgacgaattagaactggtgcaaggggcaagccacgaatttgaactagacgccttcttaaacggcgaattaacgcctgttttcttcggtacggcgttaggtaactttggagttgatcacttcctagatagcttaaccgagtgggcgcctgctccgcaagcccgtgaagctgatttacgcaaagtagaagcaagtgaagaaaaattcagtggctttgtgttcaaaattcaagcaaatatggatccaaaacaccgagaccgtgttgcttttatgcgtgtagtatcgggcaaatatgaaaaaggaatgaagctcaagcacgttcgtatcggcaaagatgtgatcatctccgatgctttaacctttatggcaggcgaacgctcccacgcagaagaagcctacgcaggcgatattatcggcttacacaatcacggtacgatccaaatcggcgatacctttacgcaaggcgaaaacttgaaatttaccggtattccgaacttcgcccctgaattgttccgccgtatccgcctaaaagatccgcttaagcagaaacagttgcttaaaggcttggtacaactgtcggaagaaggtgctgtgcaagtgttccgtccactgatgaataacgacttaatcgttggtgcggtcggtgtgcttcagtttgatgtggtcgtttcacgcctgaaaaccgaatataacgtggaagcaatctacgaaaccgtcaatgtagcaactgctcgttgggtggaatgcaacgatgccaagaagtttgaagaatttaaacgcaaaaacgagcagaatttagccttagacggtggcgataacttaacctatatcgccccaacaatggttaatctcaacttggctcaagagcgttatccggatgtggagttctttaaaacaagagaacattaattgccctctccctccgaaaatcctgcggatttttctccaccctctcccgtaaacgagagaggggaaaaataagatacagaatagaagaataaatatgagcgaacaaatctacggtattcacgctgttaaatcctttttagatgttgcacccgaacgattaatcgaagtgtttgtactaaaaggtcgtgaagataaacgattaaccccattactcaacgaattacagcgtttaggcattcgagtgcaacaggtcaatcgccaagcccttgataacaaagcccaaggcgaagtacatcaagggattattgccaaaatcattcctgctaaagagctaaatgaaagcgatcttgatcaaattttagatcgcaaagcaaatccgttcttattgatcttagacggtgtgaccgatccccataacttaggggcttgtttgcgtactgccgatacggcaggagttgatgcagtgattgtgccaaaagataaatcggcacagctcacctcaacggctcgcaaagtggcttgtggtgcggcggaaaccgtgccacttattcgagtaacgaacctcgcccgtactatgcgtgagttacaagaacgtaatatttggatcgtcggcacagctggcgaagcgacagaaagtctgtatcaggtgaaattaactggctcgattgcgttagtgatgggggcagaaggggacggaatgcgtcgtcttacccgtgaacattgtgatcaactggtgagtattccaatggcaggatcggtatcatcgctgaatgtatccgtggcgactggggtttgtctgtttgagattgtaagacagaagttattatagtcgccttaattctttttttgaattatgaaccaaaaaaatgtcatttttgctacagtagcgacattcacaaacatggtataagaaataatattcaacgctataaatgtaatgcctgtaataaaacatttacccttaaaaagaaattaaatccaataagtatttggaatgattattcaataggaaaacaaacctatcaacaacttgctattaaatatcattgttcagtcagaacgattcaaagatatattgataaagcccctaaaacagcattaaatccaccactatcacgtgatttaaatattattgcggatactaccttctttggtcgtgaatttagtattttagtcctgatggattcgctttctaaaaaggtggtttaccatcgtgttgttaaaacggaaaaagatgtttattacaggatagcatttaattcacttcgtatgaaaagctataaaattcaatcaattgtctgtgatggtagacgtggcttgatgaaagatttatttaatacaccagtacaaatgtgtcaattttatatggtagcgatagtgatgcaaaaattaagaaaaaagcatcaatcacaagcgggtaaagaattaaaaataattgcaaaaacactcacaaaaagctcaaaaatgaattttatcggcgattacattcttggttcataaaacaccaagcatttttaaaagaaaggagtgataaagcgaatgaaaaggctattttccttataaacatcgcaatgtaagaagtgcttatgccagtttaaagcgttatatggattttatttttatctatgaaaaacatactgaattaaatatagaaaagacgacaaatcgctcagaggggctatttagtgaacttaagcgaaaattaaataatcataacggattaacgaaaaatcgtcagatattgtttatacaggattttttaaataaaaagagttgctaacatttagagaaaatagatattagcaactgttttgtccacttggtatagtttttgacgaatcagcaactattttgtctattacaccaaataaaagggctgaatacgattaaatatcgcatccagcccttaagataacaatctaatcttcttaaactaaaaacagattatttgatgattttcgcaacaacacccgcaccaacggtacggccaccttcacggatagcgaaacgtaaaccttcgtccattgcgattgggtgaattaagcttactgtcattttgatgttgtcgcctggcattaccatctcaacaccttctggtaattcgatagtacccgttacgtcagttgtacggaagtagaactgtggacgatagcctttgaagaatggagtatgacgaccaccttcttcttttgataatacgtaaacttctgattcgaagtctgtgtgtggagtgatagaacctggtttagctaatacttgaccacgttcgatttcttcacgtttggtaccgcgtaataatgcacctacgttctcacccgcacgaccttcgtctaataatttacggaacatctcaacaccagttacagttgttttagttgtatccttgataccaacgatttcaacctcttcacctgctttaatgataccacgctcaacacgacctgttactactgtaccacgacctgaaattgagaatacgtcttcgattggtaataagaatggtttatcaatcgcacgctctggctctggaatgtagttgtctaagtggtttgctaattcaagaattttctcttcccactcgggcacgccgtttaacgcttgtaacgctgaaccacgtacgattggtgtgtcatcacctgggaaatcatattgtgaaagaagttcacgaacttccatctcaactaattctaataactcttcatcgtcaaccatatcgcatttgtttaagaatacgatgatgtatggaacacctacttggcgacctaataagatgtgctcacgagtttgtggcattggaccatctgttgctgcaactactaagattgcgccgtccatttgtgccgcaccagtaatcatatttttaacatagtccgcgtgtcctgggcagtcaacgtgtgcatagtgacgtgattctgtgttgtactcaacgtgtgaagtattgatggtaataccacgtgctttctcttctggtgcgttgtcgatttgatcaaacgcacgcgcagcaccaccgaattttttcgcaagaacggttgtgattgctgctgttaaggttgttttaccgtggtcaacgtgaccgattgtacctacgtttacgtggactttatcgccacgattaaattgttctttagccattgtaaagtttcctttgttgatgaaatcccgtagcacgatatgtgctacggagtttgtaagttaaaaattattttttacgcgcttcgataactgctgccgcaacacttgttggagcttcagcatattttaacggttccattgagtatgatgcacgaccttgagtttgtgaacgtaagtctgttgcataaccaaacatttctgaaagtggaacttcagcattgattttaacgacaaactcgttcgcttcttgaccgtttaccatagcacgacgacggcttaagtcaccgataacgtcacccacataatctggtggagtttcaacttccactttcataattggctcaagtagaactgggtttgctttagcaaacgctgctttgaatgctaatgacgctgctaatttgaacgctaattctgatgagtcaacatcgtggtatgaaccgaagtgtaaacgtacacctaaatccactactgggtagcccgctaatggaccagatttaagttgttcttggatacctttatcaaccgcagggatatattcaccagggattacaccacctttgatttcgttcacgaactcatatcctggaccttctggatctaatggatataagtcgataacaacgtgaccatattgaccacgaccacctgattgttttgcgtgtttaccttcaacatcattaacacgagtacggatagtttcacggtaagatacttgtggtttgccgatgtttgcttccaccttgaactcacgtttcatacggtcaacgatgatgtctaagtgtaactcacccatacctgaaatgatggtttcgcctgactcttcatcggtgtgaacacggaatgaagggtcttcttgtgctaaacgacctaatgctaagcccattttctcttggtcagctttagtttttggttctaccgcaacagagattactggctctgggaattccatacgctcaagaatgattggtgcttcttgcgcacataatgtatcacctgtacccacatcttttaagccgattgctgcagcgatgtcgcctgcacgaacttctttgatttcatcacgtttgtttgcgtgcatctgtacgatacgaccgaaacgctcacgtttttgttttacagagttataaactgtatcaccagagttaattacacctgagtacacacggaagaaggttaagttacctacgaatgggtcagttgcaattttgaatgctaatgaagagaatggctcatcatcgcttgcgtgacgctcgcctggtgtaccatcttcattgataccttcgattgctggaatatctgttggtgctggtaagtagtcgattaccgcatcaagcattgcttgaacacctttgtttttgaatgcagaaccacagcaaactgggattacttcacctgataatacgcgttgacgtaatgcagatttaatttcttcttctgttaattcttcacctgcgaagaatttttccattaactcttctgaagcttctgctgctgcttctacaaggttgttacgccattcttcacactcagcaagcatttctgctggaacatcttcataagtgaacgtcataccttggtcagcttcattccagttaattgctttcattttgattaaatcaacaacaccagtgaagttttcttcagcaccgattggaagttgaagcggaacagagttaccacctaaacgagttttgatttgctcaacaacacgtaggaagtttgcaccagtacggtccattttgtttacgaacgcaatacgtggaactttatatttgttagcttgacgccatacagtttcagattgtggttgaacaccaccaaccgcacagtaaaccattaccgcaccgtcaagaacacgcattgaacgttcaacttcgattgtgaagtcaacgtgtcccggagtatcgatgacgttgatacggtgttgtggatattgttgagacataccagaccagaacgctgttgttgcagctgaggtgattgtaataccacgctcttgttcttgttccatccagtccatcgtcgctgcaccatcgtgtacttcaccgattttgtgacttacacctgtatagaaaaggatacgctcagaggtagttgttttacctgcgtcgatgtgagcactgataccgatattacgatagcgctcaatgggagttgtacgagccattattattaccttatttggaatctaatgtgaatttgtttatatagtaataggcttcatcacaaattttgagatgaagcctacaaacatcaaaagcttattaccaacgatagtgagcaaacgctttgttagcttcagccatacggtgaacatcttcacgttttttcactgctgagcctttgttgtctgctgcatctgaaagttcgttagctaaacgcattgccattgatttatcgccacgtttacgcgcagcttcaacaatccaacgcattgctaatgcattacgacgagttggacgaacttctactggtacttggtaagtagaaccaccaacacgacgagatttaacctcaactgttggacgcacattttcaagtgcgatttcgaatgcttctaacgcatctttaccagagcgttgagctaatgtttctaacgcattataaacgattgattctgcgatagattttttaccatcaaccattaaaacgttgatgaattttgcaagtaattctgaaccgaacttcggatctggaagaatcttgcgaggttcaatactacgacgacgtggcattgcaatttctccgtattataaatcttcaggattatccaaaactctatggcgacaaagtcgcattgactggagtttatggtttaaatagtttgactaattagacgtttggccttacttaacggagaaccattaagacttaggacgtttaacgccgtatttagaacgaccttgtttacggtctttaacgcctgcacagtcaagtgcaccacgtacagtgtgataacgcacacccggtaagtctttaacacgaccaccacggattaacacaacactgtgctcttgaaggttgtgaccttcaccaccgatataagaagttacttcaaaaccgtttgttaagcggatacgacatactttacgtaacgctgagtttggttttttaggagttgtagtgtatacacgagtacacacaccacgtttctgcgggcaagcctctaatgcaggaacgttgctttttacaacctttttcacacgcggtttgcgtactagctggttgatagttgccattaataaagctccagttaagattaaaacaataaaaaagcctttcacagacgaaaggactaactcattctaaaatagaactcaatagaagtcaaacctatttaataatattggatatctgatttagagcaaggactcttgaaaataatgataatagtcctgatgtagaccgactcatgaacataattacccaaagattatttgagatctacagcgagaataaattgtaactaaaaactaagaaaatcccgttcagcttagattattcatattttctatgtttagttggcggaggaagtgagattcgaactcacggagggcattaaccctcgctggttttcaagaccggtgcattcaaccgctctgccattcctccgagttgatgctattttgatttgctcttgagagagaaaacctgctggtaattacttaccaacaggttgtatattcagtggcggaggaagtgagattcgaactcacggagggcgttaaccctcgccggttttcaagaccggtgcattcaaccgctctgccattcctccgctgaaaacaggcgaaatgatatagataactctgaactaggtcaagcataaaatgatgcaaaaccgtcaaatgttctatttttcgcctacttggttgttacgaattaaccaaaccccactttcaatatgctcggtgtaagggaattggtcgaacaatgcacagcgttcaatgcggtgagtttgagttaattgttttaaattgtcggctaacgtatgtggattgcaagagatatagaggattctttcatagccctgcaccatttctaatgtggcttgatcaagccctactcgtggcggatcaacaaaaatggtattgcaatcatattgtttcaaatcaataccacgtaagcggtaaaagacccgaacgccattcatcgcttccgtaaattcttccgcagacattcggataatttgcaagttatctacgccgtttactgcaatattatattgggcagattctaccgatgattttgaaatttcagtcgctaataccttacgaaattgatttgctaacgcaattgaaaaattaccattgccacaatagagttctaataaatcacccttactatttgccgtacaagctctcgcccattccaacattttgatgttcattttgccattgggctgcgtaaagctgttttctacttggcgatagcggtaaatttgcccatcaacattcaaggcttcttctacataatcacaatctaatgcaattttttgcttcgtcgcacgcccgattaactggacatcaaagccatagccgatcaaccgttgtttaagtaacttcgcttgctctatccattcttctgtcagcgatttatgataaagcattgaaacggcgatttgcccacttaatgtacttaaatagtcaatctgaaacagcttacgtgtaagtagctcattgtctttgatttcagccagcaacaccgtcatcattcgattaatcagttggcttgcaatcggaaattgatcgacacggtagcgttgcttagtcgcctgatcgaacataatgtgatagagatcaccattatcatgccaaacacgaaattctgcacgcaagcgaaaatggcttgtgtcagaggcaaaaacgtcaagttcaggtgcattaaaaggtgcaagtagagcggtgagattctctgccttttttgcaagtaacgctggatattgatgaattggtaaggtcatttgaatttatcaagaaagaaaaaagaaaaggcttttcaagccttcccacatattattctgctgaatcatcgccaccaagatcgccacttacatcgcctgaaagggtgtaaatgcgtttggttttgctggttaaatcacggtatttaagccacgttttttctaagaaagtttctgcaactttttcacctttaacaacggctacgaactgtttttcttccgctgtagcaggttcacgttcaccgttttctaatgctaagcaggcttgaccaaattgctctagggtttgcgattcacgaatggtgtaatcaccgtgacgagagaaaccacgaggataatttttatcgtcgaaaaaacgacgtgttacgctaaaactttctgccataattgcctctatttacacttttatttagaaaaatcaaaattgggcaagcattaaagctaaaacttgggaaaagatcaatggtttattgatataaaaacaagaaaagagatagactaacccgaatcccttataaaaactgaggcagtctgagatattcacactgcctcatcaacattttatttataatcttgagccaacttacctgctgcttctaccaccacggaaaccgcacgatcttcagtgcctttaatggttgcttcgtttgggatctcttgttgagtacggtttacgattacacctgcaaccattcctgaacgtaagcctaatgcagaacacatagtgaagagtgtcgcagactccatttcaaagttcatcacatttaattcttgccactgtttcaatgaaccttggaaatgacggtagattttacctgtgaatgtatcgtaacgctcttgacctgggtagaaagtatcagatgacgccgcaataccaacataaggatcaataccttgatttttcgctgccgcataaagctcattcgtacaacggaaatcagccaccgctggatattctaatggtgcaaaatggcgacttgccccgtctaaacgtactgcacctgtcgttaccaacacatcacctacattaatatgcggttggattgcccctgttgtaccaatacgcaagaaagtacgcacgcctaattgagcaagctcttcaacacagatagaaaccgatggcccgccaatacctgttgagcaaaccacaattggctgaccgcctacataacctaaccacgatgtaaattcacgggttgaagctaagaactctgggttatccatttttgctgcgatacgctcactacgagctggatcgcctggaacaatagcgactttcgctccttttaacattgctttggttaagccaagatgaaacacttctgacataattgactccttttgagaaaaattcgagtaacctaaccgcttcattctaccaatcaagcggtcagaattgcgatcttttttgcaaaccaatgttcaaaaatgtgaacaagatcaactggaaacgtttgcttgaggtttaatttctcgcaaaattggattttgcattgaaattagggtgtctgttgattgaatttcatcaataccctgaattttagtagctaaaacatagtgcaattcttgaatggtatgggtcattactttaataaaaatagagtaatcccccgtggtgtaataggcttcaaccacttcatcaaactcctgcaactttgcaatcaccttttcataatccttcgcactttttagaataatcccaataaaacagcagacatcatagcccagtttacgcggattaatgcgtactttagtgccttcaataattcctgcttgacgcattttttcaacacgaacgtgaattgtccctgcactcaccccaaaattttttgccatttcagcatagggaactcgagcatcttgggttaaaacttgcagaatttgttgatccagtaagtcaatctgcgatgttgcctgatagtttttatgcattttctgttccttttctatcttttgttagaaattaactaaaatatagcataaattattaaataatatctaatatagattaactttgtttgatttttttatgtaagttattgcgtttatcaagaattaatttaaattacgcacatctcttacagaatttattcaaaaggaaatttattatgcaaaaatcatttattcttcaacaacaagaaatcagctttgttaagaacacctttacccaaaacctcatcgaacagttagatattattgaagtacaaggcccaattttaagtgaagtaggcaacggtatgcaggataacttatcaggtatcgaaaaagcggtacaagtgaacgtaaaatgtatcccaggtgcagtttatgaagtagttcactcactcgctaaatggaaacgccacacccttgcacgttttggtttccaagaaggcgaaggcttattcgtccatatgaaagcgttacgcccagatgaagactcactcgatccaacacactctgtttatgtggatcaatgggactgggaaaaagtgatcccagcaggaaaacgcaatttcgactacctaaaacagactgttcgctcaatctaccgtgcaattcgtttaaccgaattagccgttgaagcacgttttgatattccatctgtattaccaaaagagattacctttgttcacagcgaagatttagtgaaacgctacccaacattaaccagcaaagagcgtgaaaatgcgatttgtaaagaatacggagcggtattcctaatcggcatcggtggcaaattatcagacggcaaagcgcatgacggacgtgctccagactacgacgactggacaacggtatcggaaggcgaatataaaggcttaaacggcgacatcttagtttggaacgaacaacttggtacggcatttgaattatcatcaatgggtatccgtgttgatgaaaccgcactacgcttacaagtggcattaacaggcgacgaagaccgtttagaaatggactggcacaaagatttattagcaggacgtttaccactttcaatcggtggcggtatcggtcaatctcgtatggcaatgttcttattgcgtaaaaaacatatcggtgaagtgcaatcaagcgtatggccgaaagagatgttagcgaagtttgagaatattctttaatattatctcaaaagcaggctaatatttttccggcatagtagacaaagtggttgctaatgaatatttttaattattcttagcaactctttttatttaaaaaatcctttataaacataatcttatgtcttttcattaatcctgtatgatgcgataatttttcctttagttgcccaaataagttttcaagtctatttgtcgttttttcgatatttaaatcgtcatgcttttcataggtaaatagataatccatataacgtttaaaactatgataagcacttcttacattccgatgtttataaggataatagcccttttcattcggtttatctgaccattcttctaaaaacgctttatgttttaaataccaatgatgtaatcgtaaatagaagtcttttttagcgctctgtttaagtgtcaatgcaataattttgggggctgtcctagataacgactaaaagctctattttaagttaaaataaccaaatgagaaaaagtcgttcaaatcagcataaacaaaataaactcattgagctgtttgtggcaggtgtcactgctcgaacagagcggttgagttggtaaatataaataaaacgacagcagcctattacttctatcgtctgcgattgcttatctatcaaaacagcccacatatggagatgtttgaaggtgaaattgaagccgatgaaagctattttggcggccactcgcaaaggtaaacgaggtcgtggagctgtgggtaaaaccgctgtattcgggcttttaaagcgtgatggtaaggtatatactgtcgttgtaccgaatactcaatctgcgacacttttaccgattattcgagaaaaggtgaagcctgaccgcattgtttacaccgatttttatcgaagctatgatgttcttgatgtgagtgagtttaatcattttcgtatcaatcacagtactcatttcgcagaaaaacaaaatcatataaacggaattgaaaatttttggaaccaagctaaacgtcatttaggcaagtttaacggtattcccaaagcacattttgagttgtatttgaaggaatgcgaatggcgttttaatcacagtaactaaaaatctcaaatttccattttaaaacaattggttaagggcagtttaagttggttatctaggacgaccccaagatttatttatttaatacaccagtacagatgtgtcaatttcatatggtggcaattgtgatgaggaaattaagaaaaaaacatcaatcacaagcgggtaaagaattaaagattattgtaaaaacgctaaaagaaagccacaaaaatgaattttatttgagattacatcaatggtatttaaaacataaagcgtttttagatgaacggtctgaatatcccaatgagaaaggatattttccttataaacaccgtaatgtaagaggggcttatgctagtttaaaatactatatgaaatatttattcacctttgaagaatattctcacttaaatatagaaaaaacaacaaatcggttggaagggttatttaaagaactgaagcagaaattatcggttcataatggattaacgaaaaagcataagattatgtttataaaggattttttaaataaaaagagttggtaataattaggaaaaataattaaaccaagagcctctcccacaatttgtgtaaatacctgtttctgagataatacattcagacacaggtattttattatgaacgaaaaacaacttcacgccttggcagcggaatttgccaaaaacctaaaaacaccagaagacctcaatcaattttcacggatgctcaagaaaatcaccgtcgaggctgcgttaaatggtgaactgaccgaccatcttggttatgaaaaacatcagcctagaaaaggtaaaaatgcacgtaacggttacacatctaagaccgtcatttgtgatgaaggtgagatagaaattgagacgcctcgtgaccgtgacggcacctttgaaccgcaacttatcaagaaaaatcaaacccgcatcacaggaatggatgagcagattattgccttatattccaaagggttaagtaatcaggaaatcgttgaaatgttcaaagaactctatgatgcggatgtgtcaagcagcctgatttctcgcgttaccgacgccgtgaaagaacgcgtaatggaatggcaaaatcgcccacttgatgcggtttatccaattgtttacctagattgtatcgtagtgaaagtacgccaagatggacgaattatcaacaaatccgtgtttgttgccttgggtgtgaatcttgaaggacataaagagttattggggctttggattgctgaaaatgaaggtgcgaagttctgggcgaatgtgctgacagagcttcaaaatcgaggcttaaaagacatttttattgcctgtgtagacggtttaaaaggcttcccggaagccatcaatgcagtctatcctaaaacgaaaattcagctttgcattgtgcatttagtgcgtaacagcttgaaattcgtttcgtggaaagattacaaagccgtcaccgcagatttaaagcaggtttatcaggccccgacggaagcacaggctcgcgaaaatctgaccgcactttcgcaaaaatggcaggcaaaatacccgcttgtggcgaagggctgggaagataactgggcaaatattgccacattttttgattatccggctgatattcgtaaagcgatttataccacgaatgccgtggaatcgcttaatagcgtgattcgtcgcgtgattaaaaaacgaaatgtattcccgacggatgattcagttttcaaagtgatttggcttgcgattaaagatgcatcaaaaaaatggacaatgccgattcagaactggaaactggcaatgaatcgatttatgattgattttggtgatcgcttagacgatcaccgttaagttgaaatgggtgtttacacagaatttgggatagggtccaatttaatattttgcaaattgatatattatttcattttaataaacactcttttcacttttctctactttatttctttttatattcagataaactaacacagttattcaatcgtattttcgatatctggagtttttaatgaaaaatgtattagtgatcaaatcaagtattcttgccgataattccacttcaaacaaattagttgattaccttaaatctaaaatcacagcgaacgtgactgaacacgattttggggtaaatccacttccttattatgatttaaatgcggcatcaggtacacgtgatgaaccgcaaaatgatgctcaacgtgcagcacttgatttatctaacaaattgattggtgaagtgaataacagtgatgtgcttgtatttgccgtaccaatgtacaacttaggtatccctgcacaacttaaaacttatattgattacttaaaccgtgcaggtgtgactttccgctatacagcgaatggtcctgaaggtttaatcaaaggtaaaaaagcagtggtagtgcttgctcacggcggtatttataaagatggtcctgcggacttagctaaaatgtatatgcaaacggtgttaaactttatcggtattactgatgttgggtttgtgtatgcagaaggtattggttatggtcctgaagttgcagctaaagcagttgaagcagctaaggttgaactggatcgtattgtgcaaatgttttagcaacaaatttgtctactataccccaatgaagtcgtttttataagaaaagtctattactcctaaaatagcatagtatacaaaatggccactaaaaatggcttaaaatcttatagtacaaggctttaagccacttttttgaattatgaaccaaaaaaaatgtcatttttgccacagttgcgacattcgcaaacatggtataagaaataatattcaacgctataaatgtaatgcctgtgataaaacatttacccttaaaaagaaattaaatccaccactatcacgttatttaaatattattgcggataccaccttctttggtcgtgaatttggtgttttagtcctgatggattcgctttctaaaaaagtggtttaccatcgtgttattaaaacggaaaaagatgtttattacaggatagcatttaatttacttcgtatgaaaggctataacattcaatcaattacctgcgacggcaggcggggtatattgaaagatttattgaatacaccgacgcaaatgtgccattttcatatggtagcgattgtgatgagagcattacgaaaaaagcatcaatctatagctggaaaagaattaaaaacaatagcattaacgcttaaacagagttctaaaaaagacgtctatttacgattacatcattgatatttaaaacataacgcgtttttagaagaacgaccaggtaaaccgaatgaaaagggctattatccttataaacatagaaatgtaagaagtgcttatcatagttttaaacgttatatggattatctatttacctatgaaaagcatgacgatttaaatatcgaaaaaacgacaaataggcttgaaaacttatttgggcaaccaaaggaaaaattatcgcatcatacaggattaacgaagcaacataagattatgtttataaaggattttttaaataaaaagagctgctaagaataattaaaaaggggctgacgcagattagctctaattttcacaccattttctcaacgttttaagttgctcttttggtgttccaaagttaaaccgaaattcacattctttcaagaataaagggaaactttttcggtcaattccattatattttcggagtatccgcttagcttgactccaaaaattctcaatgccgttgatgtgattttgtttcactgtaaacagctccgaatggctaattcgttcgtggtgaaattcgcttacatcaagggcatcataactacgataagtatctgtataaacccagctgtcgggcttgattttccttgatataacaggcattagcgttgttgtcttcgtatcattgactaccacagtaaatacttttccttgccgtttcaatatcccaaagacagccacttttcctgccgctccacgacctcgttttcctttacgatgtccaccaaaatagctttcatccaactcaatttgtccgtcaaatacttcatccacttcaagtgctaaatgataactgataacctcgcggattttgcgataaaacaggattgctgaattgggctgaataccgagtaaatctgcggctgatcgagcagttacttctaacacaaaaaattcaagtagctttttctgtatagatttctttaatttacaatgagttatcttcatttttgtaggttaacatactagctaatctacgtcagccccattaaaaatattcattagcaaccactttgtctactataccattttatacatactaaggattacgcttaaacttgctaaagtcaggcgcacgtttttcattaaacgcattgcgaccttcttgaccttctttcgtcatatagaacaacatcgttgcattacctgctaattcttgcaagccagcttgtccgtcacagtctgcatttaacgccgcttttaagcaacgtaatgcaatcgggctgttgcgtaacatttcacgacaccagcgcaccgtttctttttccaaatcagcataaggcacaacggtattcaccaagcccatttctaaagcctctttcgcatcatattgacggcataagaaccaaatctcacgtgcttttttctgcccaacaatacgcgccatatagcttgcaccccaaccgccatcgaatgaacccactttcgggccggtttgaccgaaaatcgcattttctgcggcaatggttaaatcacagagcatatgtaaaacgtgaccgccaccaatggcataaccagcgaccattgccaccacaggcttcgggcagctacgaatatcacgttggaaatccaatacgtttaagtgatgtacaccactttcgtctttataaccgccgtaatcgccacgcactttttggtcgccaccagaacagaacgctttttcgccttgacccgttaaaacaatcacaccgattttttcatcaaaacgtgcatcagagaaagcttggatcatctcttttaccgtttgcggacggaacgcattacgcacttcagggcggttaattgtgattttagcgataccgtcagtcgatttatgatacagaatatccgtataaccttcgctgcaatcgaaccattcaacaggggcataaagtacatcatcttttgggttttgcattttgtattccttttagtttaaataagtggatagattatactgggaatttatgaatttttccttgattatatactcagcctctcttctatgggaaatttgtatattaccaaatcctaatccgctcattaatcggacggtacattgcatcaccttgctttgtattaaaagcattatggaagcccgaaatatttaatacaggggcaaaagcacggtattgtcctggggcgtgtggatcgcttttcacttggtgcgttaaggcttggaccgtcgctttatttcgccacgaacgtgtccagctcataaaaaagcgttgatctggggaaaggttctccaagattggggtcacaccgtgatcttgctcataacgttttaatgcatcataagcaatacttaatccgcccagatccgcaatgttttcccctaaggtgaaacgtccattgacaaaaattttcggggcgacttcaaatttatcaaattgagcaactagttgatcggcaagggcttcaaatttttgtcgatcttctgctgtccaccactcttttaagttgccatcaccatcaaattttgaaccgctgtcgtcaaagccgtgagtgatttcgtgtccgataatagctccgatagccccaaaattaacagcaggatcggcgttcatatcgtaaagcggtgcttgtaagatcccagccgggaatacaatacggttcatcaatgggctataagaagcattcaccacctgtggcaacattccccattcattcaaatcaacaggtttgccgattttacttaaggcttcttggtaattccatttggcaatttcacgcaagttagcataaagcgaaccgccctgttctacggtttttaaatgcagttggctataatctttccatttgtttggataacccacttcaacgatgaatttatctagcttcactttcgcttttgctttggtttctgccgacatccaacttaaattgtcgatacgctgatggtaggctttaaccaaataaccagccatttcaagcaggtcttttttagctgtcgcagggaagaatttttccacataaaattgagcaaattcctgcccaatttggttgttaatcaaacgtaacgcacgtttatctaacggtctttgctgtttctgtcccaccaactgcttgccataaaaagcaaaattcgtatcatctaaggctttgtttaaataggtagacgcatttgaaacggttttaaagcgtaggtaatctttaattaacgcaagattttgtgggttgattagctgatcaaactgttttaagaaattcggctcccacacaataacttcttccgtattcaccccaacggcgttgagataatttgcaagattaatatgtttactcgctttagctaattcattgatagataaaggattatagcgtttttgaatatctcgacgctgctcattggtaaatagggttttcgcaatcgctttttcatactccacaatcgcttttgctttttgcttcggattttttacctgagcaaaatgaagcatctgtgcaacataatcttgataaagctgtaatgttttacgattttcaggggtatccttttgataataatcgttgctcaaaccaaggctatcattactgaaatagattgcgttttggcgagagtttttcaggtgggcaaacaccgaccaaccaaataacatctcattgccttgcttggtttcattaattaaatattgctctaactcggcaaaggtttttatctgatcaattcggcttaaatcagcttgaattgggcttaaaccaagcttttcacgagcaggcaaatcggtataactttgatacagtgcttttaaacgttgtgctttttcatcatttgcaaaatttgggtctgaaatgaccgcttgtaacagctcaacagaacgtttttcattcaattccttgagttctgctaaggttccccaagaagtgcgatcagacgggatttgggtggtatctacccacttaccattcacataacgataaaagtcttgctgtggagaaacactgttatccaccccttcggttaaggtgctttggtaggttttcgtggtacaagccgttaagcctaaagcaagggcaataaggctaaaagagagcgtttttttcattttatctcctaaaaataagcggtaagatttggctaatgatttgcaaaaaacttagtccatcttaccgcttatcagttcaattgctttagttattctgtacatacttccgctaagtagtaataagattaaggttatcttttataaattatgcggatttcgagtattcgcatcaaccaaattacgcattaacaaagcataatctaattccacatcggctggtacatctaaaaagacaaaatgcccatcgcctaagccagcatcaacagcttcatttttgcggtttaacattcgttcgattttgaacacgatattgccttttggggtcatcatttcgacttcatcgccaagtaagaatttatttttcacggcgacttccgccataccttttgtattgcgtttgccggtaaattcgccgacaaactgctgacgttctgaaatcgaatagccgtaatcgtaattttggtattcatcgtgggtatggcgacgtaagaaaccttccgtataaccacggtgtgccaaggattctagggtatccattaaactttcatcaaaaggcttgcctgctgccgcatcatcaatcgccttgcggtaaacttgagcagttcttgcacaatagtagaatgacttagttcgaccttcaatttttaaggaatgtacgccgatttgggtcagtttctcaacgtgttgtactgcacgcaaatctttcgagttcataatgtaagtgccgtgttcatcttcaaaagcggtcatttgctcatctggtttttgcgattcggcaagcaggaaaactttacttgtggtatcgccttcgcctaaggttggtgcgacatttttaatttcaatctgctgttttggatcgatttttgacacgatattgccaacatcatctaccttaccctcttccacctgatattcccagcgacaagcgttggtacaggtgccttggttcggatcacgtttgttaatatagccagacaataagcaacgcccagaataagccatacacaatgccccgtggacgaaaatctcaatttccatatcaggcacttgctcacgaatttctgcgatttcttcaatggaaagttcacgggaaagaatgacacgggttaatcccatctgtttccagaattttaccgttgcccagtttaccgcattcgcttgcacggaaagatgaatatccatttctgggaaatgttcacgcaccaacataatcaagcctgggtcagacataatcaacgcatcgggcttcatatccacaacgacttgcagatctttaatgaaggttttgagtttagaattatgcggagcgatattgaccaccacatagaattttttgccgagtgcgtgagcttcatcaataccgattttcaaattagcgtggttaaattcgttattgcgaacacgcaagctgtaacgtggttgccccgcataaacggcatctgccccgtaagcaaaggcataacgcatatttttcagcgtgcctgctggcgataaaagttcgggtttatgttgtaacatgtggattctctttctgataacaagtcaggactttcccgaaggaaaacgtaaaaaggcgttattctaacggaataacgcctttgggttaagaattatatgtttgtttagtgaaaattctgccattacaagcggtcagtttcgactcaaaatttgcaaattttagagcctaactgaccgcttgtatttaggaggcaaacaggttagacgccagctttattaatcaaaaactgactcaacaacggcactggtctgcctgttgcccctttggcagccccagatttccacgcagtgcctgcaatatctaagtgtgcccaagtgtattttttggtgaagttcgataggaatacccctgcggtgatcgctccgcctaaacgtccgccgatattggcaagatcggcaaagttggatttaagctgttcttgatactcttctcccattggtaaacgccatgctttatcatccgcttgttctgcagcatttaataagtcgtttgcaagtgcgttatttggtgaaatcaatccgctattgtggttgccaagtgcgatcatacacgcccctgtgagtgttgccacatcaatcactaattcaggatcgaaacgttcggcataggttaaggtgtcacataataccaaacgtccttctgcatcggtattgaggacttcaacggttaagcctgacattgtggttagaatatcaccagggcgataagcgttgccgtctggcatattttcacagcctgcgagtacgccgataacatttaatggcaatttcatttccgcaatggctttcattgtgccatagacagaagccgcaccgcccatatcatatttcatttcgtccattgcatcggacggcttaatggaaatgccacctgtgtcaaaagttaagcctttgccgacaagaataatcggttttgctgcaggatttggcgatcctttatattcgataattgaaagataagcatcattttcagaaccacgagaaacggcaagataggcgttcatttgtaatgccgccatctctttttcgtccagtaccgtggtggtgatgttatcgtactctttggctaagccttttgctaattcggataaatatttcgggttgcagacatttggcggacagttcgctacatttttggcgaagatcacgcctgatgcaatcgctttgccgtgttcaaccgcttgttctgccacagttaaatctttgcggttagcgatattaaatacgattttgcgtaattcacggcggatttcaggtttcacgctcttaaattcgttatattggtagccgttttcttgaatagcttcaatcgcaaagcggatattccagtaaacggaacgggctttgacgtgtaattcggttaagaagcagattgcttccgttgagcctgtgtcgttaatgacttgtaccattttttgaatggtttgtttgtattggcgttcagtcagttcacgctctttgccgcagccaactaacaacacgcggtctgcggcgacattgggtacgttgtgtagtaataacgtttgcccaacacgtccttctaaatcgcctttacgcaataaattgcttaaatagccgtcacttaatttatctaattgctccgcagcaggcgataagcgacggggttcatacaccccaacaaccagacagcctgtacgttgtttttcaacagatccgtttttaacgctaaattccataaaatactcccgtgattttttttgtataaaagggtatgatcacacattttgcaagcgatgggttttggtaaaattttacaatattatttagcctttgtttgaatgataaagaaaggtagggacacactgcgtgtgtccatatttctggctcaaacacatatttgcggacatatatagttttatggacacgcagctttacggacacacgcagtgtgtccctacaagtgggctattcaaaattttacccaaatccaaccgcttgaacttgcaattaaaatatgggtcataaaactacctgtttgcttgaaaattgcaagcgataaattgtcaaaatgagaactttgtcgtgattttaagtcgatatttaacgaaagaaatatttaaaagccaaattgctatacttttcatactgttagtgatcttcttctgccaacaattagtacgagtattaagctcggctgtgagtggcaaagtccctacagacttagtattgagcttgctcggattaggtatgccgacaatggcacagttgatgttgcctttgtcgttatttattgctcttttgctcactttagggcgtttttatgctgaaagtgaaattacggtaatgcgcgcttgtggggtggggcagagccttttagtgaaagcagcgttatttttatcgatctttaccacggcagtggcggtttataatgtcttttggcttaccccttgggcgattaataaacagagcgaaatgttggctgaagcaaaagcaaatcctcgctttgctgcattagccgcagggcaatttatgtctgcaggtgggtatgtgttatttattgataacattaaagataacaccattaatgatgtttatgtttttcagcctgaacagcaaaagaaaaataaaccctctgtggtggtggctaaatcgggggaattacaagggcttccgaatggcgatcaaatgttaaatttaaccaatagtactcgttatgaaggaacgcctcaaacggcggatttccgtatttcgcattttgataattacaatgcctatctcggctatcaagatgttgatagtgatgaaaaattggttcaacgtgccgattttcagaagttgcttgctgaaacttccccagaagctcaggcagagttgcagtggcgtttagcgttgattttatctgtgccattgatggcgttgctggctgtgccgatgagtagtgtaaacccacggcaagggcgttttgcaaaattattacctgcgttattgttgtatttaatctatttcttattacagagttcgttaaaatcggcaggggcttcgggtaagctaaatgtgtctttgttaatgccaatggtgtctgtggcatttttagtgcttggcactcttttaaatagctgggaaagtaaatggttttcggcattgcgttatcgtttttcaagtaaaaaggtggcaagtaaatgaatgtattagagcgttatatcggcagaaccattcttgcttccattatgcttaccctatttatgttagtagggcttggggcaattattaaatttgtcgaagagttccgttccgttggtcgagggagctacgatggcttacacgcagcatattacaccctattgacgatgcctcgtgatattgaaacctttttcccaatcgcagcgttgcttggttcattaatggggctgggcggtttggcgagccgtagtgagttagtggtaatgcaatcggctggattttctcgcttccgcattgggctggcggtgatgaaaacggcaattccattaatggtgattacgatgattatgggggaatggggcgtaccgcaaacggaacaacatgcccgaaatatgcgatctattgctcaaagtggcggttcaatgctggcgacccaaggcggattttgggcgaaagatggcaatgattttatctatattcgtcaaattcaagatgaacgtaacttaaataatattttaatttaccaatttgaaaatcaggttttaaaatccatcaaacaggcggaaaaagcgacctattcggaacaaggctggcttttacagcaggtggataaatcagaaattcacgaaagcggaataacccagaccagagaaacagatcaggcgtggaaaacaagcattacgccgagcaagttagggatcgtgtccttgaagccagagtcgttgtctatttcgggattagcggattatgtaggctttttaaaagatacagggcaagatccaaaacgttttgagattacgttctggcgtaaagtttttcagccgatctcaatggcggtgatgatgttgcttgcgatttcctttatttttggtccgctacgcagtagtacgatgggggcaaaaattgtgatcggtattctcgcaggctttgtattttatgtggcgaatatcgtctttggtaatttaagtcttattgtttcgtggctacccgtaccaataggggcattaatcccaagtttgctctgtttaagtgtggtgtggtggttgttgaataagaaaagggattaaattaaggaaagactatgttaaataaattagtattaaagaatttcacagtatttaacgaagttgatttaaatttttctccccatttaaatgttattataggggaaaatggaatgggaaaatcgcacattttaaaattagcgtattctctcattgcttgtaatgcttctgctttttctgtaagtaaaacgcaaatgcaaaagaattatgcagataaattaattaatgtatttagacctgaaagtttaggccgacttgttcgccgtaaacaagggagagagcgttgtgaaatttcagctaaatttgaaaatgacttttataattgtcaatttagttttgcgacatcaagtaaatccgaagttcaaatagatatattacctaaaagtaaaatagagaataatcctgtttttttacctacaagagaattattaacgatttatcctaattttgttcatacttataataatcattatttagagtatgaggaaacatattatgacacttgtttattattaggaaattatttagccaaaggtcctagagaggagcgtgcaaaagagctattaaaaccattagaagaggcaatgggggggaaaacggttttagataatgggcgtttttatctttctattcagggacaaggaactatggaaattcctttggttgctgagggattaagaaaattagcgatgattgcgagattaattgcaacaggatctttgttaggtaaaggtgcgttattttgggatgaaccagaggcaaatttaaatcctaaacttattaaaacagtcgctaaggttattttgcaattatgtaataacggtatccaaatttttattgcaactcattcactttttttgttaagagaactagaaatactttctaaacgacaagaatttgctcatttaaaacaattttatttcggtttaaaaacgatagataatggtattgtagttgatcaaggtgatagtattaatcaattggaagttttaacattattagacgaagagcttgaacaatccgatagatttttagcattggtagaataaatgtcagagattgtaattaaagaaggtgatttaacgtttatttttaacgagtttattcttgttgaaaaatatgatgatttatctttttatcgtaatcaatttaatgcttttgcaaatggaaccaaagcagtagatattattgtggttgatgaaaatgataactggatgattgaagtaaaagattatcgacaatatcagagaacgaaaacaatgccattagccgatgaaatagcaattaaagttagagataccttggctggaattgttgcgatgaaattaaatgcgaataatcaaagcgaacagcagtttgctaaacagtttttgaagaaaaataagataaagatagtattacatttagagcaaaaaagaagtaattcacgtttattccctcagccgatcgatcctgcaaaattaaaacaaaaattaaagatgttattgaaggcagtcgatgctcatccgtttgtggtgaataaagatagcttacattcgacaatgcattggaaagtcatttaatataaatagaaaataaccattatgtcccaacctcgttttgttcatctgaaagtacacagtgatttctcaatgattaatggcttggcgaaagtgaagccgttaatcaaagcctgtgttgccaacaatatggtcgcaatggcattgaccgattttactaacttctgtggcttggtgcgtttttacggcgaagccttaggatcgggagtgaagccgattgttggggcagatgtgatggttcgccctgaacctgagagtgaagagttatacgaacttacccttttagccaaaaataataccggttatcataacattacccttttactttcaaaggcttatcaacagggctatgtggaatttcctgtggtggaaaaagcgtggctggcagaacataatgaaggcgtgattttgctttcgggcggtagcaatggcgatgtaggtaaggcattattgaaagaaaatcagcaagaagccgaacagcttttggctttttatcaacgttatttccacaatcattattatctttccctttgtcgaacaggaagaagtgatgaagaacgttatattcaacaagcggtcactttttcgcaaaaatttgcaattccgttggtggctgtcaatgatgtgatgtttttaaaacaggacgattttgaagcccacgaaatccgtgttgccattcacgacagctttacgttagacgatcctaaacgcccacaaaaatattcggaacagcaatacttccgttcagaagacgaaatgtgtcagttgtttgccgatttgccacaagcgattgaaaataccttattcattgctcaacgttgtaatgtcaccattcgtttaggggaatatttcttaccgaatttcccgacgggcgatctttccactgaagattttttagtcaaaaaagccaaagaaggtttggaaaagcgtctggtatttttgtttcctgatcctgaagtgcgggcaagcaagcggtctgtttatgatgaaagattgcaagtcgagttggacgtgatcaaccaaatgggctttcccggctactttttaattgtgatggaatttattcagtggtcgaaagacaacgatattcctgttgggccggggcgtggctcaggggcaggatccttggttgcttatgcgttgaaaattaccgatcttgacccccttgaatttgatttactctttgaacgtttcttaaatccagaacgggtttcgatgcccgattttgatgtggatttctgtatggacgggcgagatcgtgtgattgaacacgtgtcggaaacctatggttgccaagcggtgtcgcagattattacctttggtactatggcggcaaaagcggttattcgagatgtggggcgtgtgcttggacacccttatagttttgtggatcgtatttctaaattgatcccccctgaccctggtatgacgttggcaaaagcctttgaagccgagcccaaattgcctgagctttatgatactgatgaagaagtgaaagccttgattgatatggctcgtaagctcgaaggggtaacacgtaatgcaggtaaacacgcagggggcgtggtgattgccccaacggcgattactgatttttcgccactttacttcgactcttacggtttacaccctgtgacccacttcgataaaaatgatgtggagtatgcaggcttggttaaatttgactttttgggcttacgcacgctgacgatcatcaaatgggcgttagagatgatcaatcaacgcttggaaaaagaaggtaagccactggttcggattgaaagtattccccttgacgatgaaaaagcctttaaattattaaaagcagccaaaaccacggcggtattccagctagagtcacggggtatgaaagatctgatttcacgcctacaaccaagtaactttgaagatattattgcgttggtagccttattccgtccaggtccgcttgagtcgggaatggtgcagaactttattgaccgtaaacacggcaaagagccgattgcctatcctgatgcccagtatcagcacgagtcgctgcagccgattttagagccaacctatggcattatcgtttatcaagagcaagtaatgcagattgcacaggtgttggctggctatacgctcggtggtgcggatttattgcgtcgtgcgatgggtaagaaaaagcccgaagagatggcggctcaacgggcaacctttgaagaaggggcgaagaagcagggaattgatggcgagttggcgatgaaaatcttcgacttggtagaaaaattcgcaggctacggctttaataaatcgcactcggcggcttatgcgttggtatcctatcaaaccttgtggctcaaaacccattacccagcggagtttatggcggcggtgatgacttcagagatggataacaccgataaaatcgtcggcttttatgatgaatgtatcaatatgggattaaccgttgttccgcctgatattaacagcggtaaacaccgttttagtgtcaatgaaaaaggcgaaattgtctatggtttaggggcaatcaaaggcgtaggcgaaggcccgattgatgcgatgttagaagctcgcaataaagacgggattttcaaagatctattcgatctaaccgctcgtgttgatttaagaaaagttaatcgtcgcacatttgaaggattaattatggctggggctttcgataaactagggcctcaccgtgcggcgttgatgaaaaatttagaagatgcccttagagcgtccgatcaacataataaaatggaagcacttggacagagtgatatgtttggcgtgctgactgaaacccccgaagaagttcagaacgcctatgccaacacgccaaaatggacggagcagaccattttagataacgaaaaagccaccttaggtttatatctaagtggacaccctgttggacgttttttgaaagagttagctcattatgcaccgaataaattaaatgaagttcaaccaacctatcgaggacaaactactaccgttgctggattaattatgggggcaagaattgcgacaaccaaaaagggtagtcgtattgggattgcaacgattgaagatcgttcaggtaaaatggatctcacccttttttcagaagcactggaaaactatggcgatctgttgcaaaaagatcagattattatcgcaacaggggctgtgcaacacgatgatttcagtggtggcttaaaaatggcggttcgcgaaatgattactcttgatgaagctcgtagccgttatgcaagaagtttagctctagcgatcaaacaagaacagctctcagcaaaatttatcaaagatctgaccgctattattgagccttataaagagggaacattaccgttacatttctattatcaaagcccagaagggcgtgtattattgcgtagtggcgttgagtggcgtgttaccccaaaagagacgatgctgcagaaattaaaagattttttaggcgaaaatgccgttgagttggagtttgagtaggagtaaataatgctacgtataatttatactattctaggttatttagtactacctattatttctcttatcatatggcagaaagaacattctctacctaagcgtcgtaaatgtttgaaggaacgatacggtttttattcatcgggtgaaatcaagcctcaagcaaatggcattgttattcacgccgcttctgtgggagaagtgattgcagctactcctttgattaaagcgattttagcgaattatcctcagttgtctgttacggtgacgacagtaaccccaacggggtcagatcgtgttaaagcagcatttggcaatcgtgttcaccatctttatttaccctatgatttgcccgatgcggtgaaacgttttttagactttgttgaaccaaagttattgattgtgattgaaacggaactttggccgaatttaattcatcaaacccatcaacgccaaattccctttgtgattgccaatgctcgtctttcgcctcgttcagcaaaacgttatggttggattaagccttgtttgcaagagatgttgagtgaaattgattttattttggctcaagatcaggtgagtgcagatcgttatttggggctaggatttaaggctgaacatttggttaatactggcaatcttaagtttgatttagaagtttcacctcaattacgagagaaggttgctcaaaccgccgttgaactacatttacttgaccgtccgatttgggttgcaggtagcactcacgaaggtgaggaaaagatgttgttggaagcacatcagcagttattaaagcaatatcctgatttagttctgatccttgttcctcgccaccctgagcggtttgatagtgtggaaaatttactaaaaaatatgggaatgtcctatgtaacacgctcttcttttgaacttttaagtgcaggaacatcggtactgttaggcaatacaatgggagagatgatgctgttttatggcttggctcaggtcgctttcgttggtggaagtttagtcaaacacggtgggcataatccgttagagccaattgcatttgaacttcccgtgatttctggtgtacatacttttaatttccctgagatttttgctaaattaagagaggttcggggcgtgattgaaattcaaagtgatgtcacttcgattgttgatgccgtcaattacttttttgaaaagcctgaacttggacaaaaaattagtcaagcaggggtgagtgtattacaagaaaatcaaggtgctttaactcgtcatcttcaactgttagccccttatttagagaaatagaatgaaccaaactgtaatttatgctggcacatttgatccgataacaaatgggcatttagatattattcaacgcagtagccgattgtttggcaaagtgattgtggctgtggcaaaaaatccctcaaagcaaccgctatttagccttgagcagcgtgttgagttggtacagcaaagctgtcaaatgctgaataatgttgaggtcatcggctttagtgggttgttggtcgattttgctaaacagcataatgccaccacgcttattcgaggtattcgaggggcggacgacattgagtatgaaattcaactggcacagttaaatcaaaaattagcagggcagttagaaacgatttttttacccccagccgtagagtggcgttatctttcttcgacaatggtaagagaaatttatcgccatcagggagatgtggggcagtttgtgccagaaatagttttaaagtctctaaggtaatcgatgaggaaagtgtgtttacatatgatcaagattttaaagagggtagtgtcaatgtagtttagtgaatgaataatgagatacgtaaaacaagcagataccagatattcgcatgaatttttagtttacagcctaaaaatttaagggtaaaattgcaaaattgctattccatatggatagtaaatgatggtgctgagccttatctcaagccccatccaagaccgtaggtgaacctgtgtgaacagtttcttaatgaaaacaacctacgtagatggtgaacagacagaattatctgcttctgtacaccttagcctcaaaaacgtcgctcaagcggttacttttttgagattttttgtaaattccacagtatttatgtggagtgtatcaggagctaaaaccaatggcattaaatcttcaagacaaacaagcaattgttgctgaagtaaacgaagctgccaaaggtgccctttctgctgttgttgcggattctcgtggcgtaacagtagagaaaatgactgagttacgtaaagcagctcgtgaagcaggcgtttcaatgcgtgttgttcgtaatactttattacgtcgtgcggttgaaggtactgaatttgagtgcttaaaagatacgtttactggtccaactcttattgcattctctaacgaacacccaggtgcagcagcacgtttgttcaaagattttgcaaaagcaaacaaagagtttgaagttaaaggtgcagcctttgaaggtaaaatccaagatgttgaattcttggcaacattaccaacttacgaagaagcaattgcacgtttaatgggcacaatgaaagaagctgcggcaggcaaacttgttcgcactcttgcggcattacgcgacaaattacaagaagcggcataatttttattcgccgtattctcaactcgtttaacttatttactttaggaattgattgttatgtcattaactaacgaacaaatcattgaagcgattgcttctaaatcagtatcagaaatcgttgaattaattacagcgatggaagaaaaatttggtgtatcagcagcggcagcagcagtagcagtagcagcaggcccagcagaagcagctgaagagaaaactgaattcgatgttatccttgcagatgcaggtgctaacaaggtagcagtaatcaaagcagtacgtggtgcaacaggcttaggcttgaaagaagctaaagacttagttgaatctgctccagcagcattaaaagaaggcatctctaaaggtgaagctgaagcacttaagaaagaattagaagaagctggtgcgaaagtagaaatcaaataatttttgatttagcttttaaattgctaattctatactcaataaaacccgataacaaatatcgttatcgggtttttcttctataatgacagctatgaatactattgaaattgtttttgctccaaatgatgaatttatcccttcagattttttaaattatttggggaatataaacaaatctcttgataagccgtcagcttatcaaataaaaaaatggaaaagtcgccgtatggcttatttcctgttacatcaattatttgaaaaatatcatttagataaaagtttattaactcatatcgttaaaacagaaagtgggcgcccttatattgaacatagcgagattgattttaatattagccattcgggcgattgggttgcgattattttctcttatcaatccccgaaaaaagtggtgggtattgatattgaacacccacaaaaaatacgtcgttttaacgatttattacattattatgccagtgagcaagaaatagctgaaataaataatcatcatctattctcggaactctcttcccttgaaagtcgtttttacttaagttggtgtttgcgagaagctgtgcttaaatcacagggttctggaattataaaactgtcggaagtaacccactcattaagtaaacagcagatcacaaccgcctatagcccaacaggaaaactctgcttttatcatcaacttccattttatttggcttatttttttgaacatactcaggctatgttatcattaccaaaactgagccaatggaaaaatggggactacatctcatttgatcatcttcacccaattatttatcaagtaaattaaggatagtatgaataaatttaatttagaagaacaacattctcgtttcgggaaatttatttctgagagttttcaatggatattaaatctttcactcttagtgatagggctaattttagcttactctcttttttatgaagcatactcattaattgaattattttttagccatagtgaaaaattccaaattgtagaaaaaattgtgattttctttttatattttgaatttctagctctcattgttcaatattttaaatataactaccattttccattacgctattttttatatatcggcattaccgcaatggtacgtttaattatcgtagatcactctaatgcaatgcacacgttattatttgcattagctattttagtgatgatcgttgctttatatattgttcattcaaaacgcttacataaaagctaaggaatttttatgacacaaattcagcaatttcagcaaaaagatttagagatcttaaaagaagaagtggtttatcaaggtcacttcacaatgaaaaaaatgtatttccgccacaagttatttaatggtggagtaagcggtgaaattgtgcgtgaattaatgattaaaggctcggcagccgcattaattgcctatgatcctgtcaaagacgccgtagtgttagtcgaacaagtccgcattggtgcttacgatccaacaagcaaccaatccccttggttagtggaactgattgcaggaatggtagatgaaggggaaacgccagaagatgttgctatccgtgaaagttacgaagaagcaggtttaaccgttagcaatgtggaacacgccttaagcatttgggacagcccaggcggtgcggttgagcgtttacatctctttttaggcttagtcgatagcacccaagtcggcggtgtttacggtttagaggaagaaggcgaagatattctcgtccacgttgtgagccgtgagcaagcgtatcagtgggttgttgaaggcaaaattgataatgtgattgctgttgttggattacagtggttacagttgaattatcaaaggtataaagagccacatagcctttcagtacaactgtaatttgatttctaaccgtatggatacaataaatattcaaagggtatagtagacaaagtggctgctaatgaatatttttcattaaagagtgcagataatatagtaaattaaaccgtaaaaagtgatatagcccaccaataatcctatctttgctactagcggttgcttttgatgtaatttatgcagcaagccagcaatagccaataaaatgaaaggataaatccaaaatgcggtagaaaaccaatcaatttgacttgggctaaggttaggattttcgcttaatgcaggtgatacaagcaatgctaatggccataatgaactgggcaaacaaaaaaatgccaatgcccaactaaattttgaaaaaccttgttgcatattatcctcttgggtgaaactgttgatgcagtgattttaaacgagttttcgccacttgggtataaatttgtgtcgtagacagatcactatgtccaagtaacatctgcacaacccgtaaatctgcaccgtgattaactaaatgtgttgcaaacgcgtggcgtaaaacgtgtggagagagtttattactatcaatacccgccaacaacgcataatgcttaattcgatgccaaaaagtttgacgggtcatttgattgcctaaacggctaggaaaaaccacatctgactgcataccattaagcagtgaacttcgcccatactcaaaaaactgttggatccaataactcgcttcttctcctaaaggcactaaacgctctttatcacctttaccaatgatacgaactaacccttgacgcaggcttaagttatccagtgttagagaaacgagttctgtgacacgtaaacctgtggcataaagtagttctaacattgctttatcacgcaattctaaaggatcctgagtatttggaatattcagtaaatccagtacctgctcttcactcaatgatttaggtaaatgggctggtttacgcggagatgtaagtgttgctgttggatcatcatctcgatacttttccaaataaaggaaacgaaaaaacttgcgcaaacagctcaacatacgagatgaactcgttgctttatagccttgctccagtctttcgcccaaaaaggtttgtagatcaacatagtctacttttaaaaatgcattgggttcagaaagccattgggtaaaactttctaaatctagtctataagaggctacagtattttctgataatccctgctcttgccatagagtatcaagaaattgttcaataataggatcaagtggtttcataataacgataaaattatcgtaaaaatctgcaaaattctaacataaaaataccttggaaggtcgactgaaatgaaaaaaccgattagcaaaactaatcggtttatttgaaacatggcaggggcggagaggctcgaactcccaacacccggttttggagaccggtgctctaccaattgaactacgcccctatataattatttacatatagttaaagcgagtaatttactcgcttataaataagtggcggaacggacgggactcgaacccgcgaccccctgcgtgacaggcaggtattctaaccagctgaactaccgctccgcaaattgggtacttggcaatgccctactctcacatggggaatccccacactaccatcggcgtaactgcgtttcacttctgagttcggtatggagtcaggtgggaccacagcactattgttgccaagaaattcttttattaagttagttcactaatttaatgaactaagttaataaccccccgacgatgctctactctcacatggggaatccccacactaccatcgacgttacagcttttcacttctgagttcggtatggagtcaggtgggacaactgcactattgtcgtcgggaaaatcttttgatgattctctctatcttcttttttctgttctttaagggcaaatgtaatttgcccctacatctttctgttctttaagggcaaatgtaatttgcccctacatctttctgttctttaagggcaaatgtaatttgcccctacatctttctgttctttaagggcaaatgtaatttgcccctacactattctaatttcgaaacaagctgttctgagtctctttgttttattttgtttagttagtttgttgcttttattcagctctctaactctctcacgtctacttcaaaaacgcttgaggttgtatagttaagcctctcgggcaattagtatctgttagctcaacggctcacaccgcttacacaccagacctatctacgtcgtagtcttcaacaacccttactagcttatagctagggagaactcatcttaaggcgagtttcgtgcttagatgctttcagcacttatctcttccgcatttagctacccagcaatgcctctggcgagacaactggtacaccagtgatgcgtccactccggtcctctcgtactaggagcagcccctctcaattctccaacgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgacttgtctgtctcgcagttaagcttgcttataccattgcactaacctcacgatgtccgaccgtgattagcaaaccttcgtgctcctccgttacgctttgggaggagaccgccccagtcaaactacccaccagacactgtccgagaccacgtttcgtaatcttcgttagaacatcaaacgttaaagggtggtatttcaaggtcgactccacaagcactggcgtgcctgcttcttagtctcccacctatcctacacatcaaaattcaatgttcagtgtcaagctatagtaaaggttcacggggtctttccgtctagccgcgggtacaccgcatcttcacggcgatttcaatttcactgagtctcgggtggagacagcctggccatcattatgccattcgtgcaggtcggaacttacccgacaaggaatttcgctaccttaggaccgttatagttacggccgccgtttactggggcttcgatcaggagcttctctttcgataacaccatcaattaaccttccagcaccgggcaggcatcacaccctatacgtccactttcgtgtttgcagagtgctgtgtttttaataaacagttgcagccagctggtatcttcgactggttcagccttcggaggtatactcctacaacctacgccagcgcaccttctcccgaagttacggtgctattttgcctagttccttcacccgagttctctcaagcgcctgagtattctctacctgaccacctgtgtcggttttcagtacggtttagtaaagcctttcgcttagtggcttttcctggaagcgtggtatcagttacttcatttccgtagaaactcgtcatcatctctcagtgttatggaagtccggatttgcctaaactccccacctaccaacttaaacagacatccaacagtctgctaacctaaccttctccgtccccacatcgcagctttaccaagtacgggaatattaacccgtttcccatcgactacgcttttcagcctcgccttaggggccgactcaccctgccccgattaacgttggacaggaacccttggtcttctggcgaacgagtttttcactcgttttatcgttacttatgtcagcattcgcacttgtgatatctccagcatacttctcaatacaccttcatcgacttacacaacgctcccctacccaacaggcgtatcacaaatattcctctgatttctatccgcactttatgccaactcaacgtgttgggtgcttgaccaacatctcattccgtttcacttcattcgatgttgttaatcgaaggcgtatttgtgatacgcctgatgccgcagcttcggtgctatattttagccccgttacatcttccgtgcaggccgactcgactagtgagctattacgctttctttaaatggtggctgcttctaagccaacatcctagctgtctaagccttcccacttcgtttcccacttaatatagactttgggaccttagctggcggtctgggttgtttccctctccacgatggacgttagcacccaccgtgtgtctcctatgcattactcttcggtattcgcagtttgcatcgggttggtaatccgggatggacccctagccgaaacagtgctctacccccgaaggtattcacataaggctctacctaaatagatttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccttgcaactatccgcccagttaagactcggtttcccttcggctcccttattcagttaacctcgctacaaaatataagtcgctgacccattatacaaaaggtacgcagtcaccctttcgggctcccactgcttgtacgtacacggtttcaggttctatttcactcccctcactggggttcttttcgcctttccttcacagtactggttcactatcggtcaatcaggagtatttagccttggaggatggtccccccatcttcaaacaggatttctcgtgtcccgccctacttgttgcaagtttagtaccacaacataaacttaaaatacggggctatcaccctgtgtcgcttggcttcccagccaattcttctgtctttgctgctatcacttgctggctctttcgctttcgctcgccgctactgacaaaatctcggttgatttcttttcctcggggtacttagatgtttcagttctcccggtttgcctcaacagactatgtattcatctattgatagtagattcttcatctactgggtttccccattcggatatcttggattaaacgcttcttatcaactcatccaagcttttcgcagattagcacgtccttcttcgcctctgattgcctaggcatccaccgtgtacgcttagtcacttaactatacaacctcaaacatttttatctaaaagaaaaaacatttaagactgatattaactactaaacacttaactgcttttgttcagttaagattttttactactcagactttcttgtttcagggcaaatatgatttgcccctacagaaaatctctcagttttcagcttgtttccaattttttaaagaacaatcgataatcacctttcggctaatcatcatatttaaataaacaactcactgttcgcttaaatatgatgattggtggagataagcgggatcgaaccgctgacctcctgcgtgcaaggcaggcgctctcccagctgagctatatccccaatgtcatcacatcgctttcttcgtttcactcactattcagtatagatttctcttcaccgtttagagtggtgggtctgagtggacttgaaccaccgacctcacccttatcaggggtgcgctctaaccacctgagctacagacccaaaaggatgtcttcgttctctttcttgtctacaattaccaaacaatctgtgtgaacacttgcaaatctcttcattcaggtaaggaggtgatccaaccgcaggttcccctacggttaccttgttacgacttcaccccagtcatgaatcataccgtggtaaacgcccccctttcagttaagctatctacttctggtacaacccactcccatggtgtgacgggcggtgtgtacaaggcccgggaacgtattcaccgcgacattctgattcgcgattactagcgattccgacttcatggagtcgagttgcagactccaatccggacttagatgcactttctgagattcactccacctcgcggcttcgtcaccctctgtatgcaccattgtagcacgtgtgtagccctactcgtaagggccatgatgacttgacgtcatccccaccttcctccagtttatcactggcagtctcctttgagttcccgaccaaatcgctggcaacaaaggataagggttgcgctcgttgcgggacttaacccaacatttcacaacacgagctgacgacagccatgcagcacctgtctctaagttcccgaaggcacaaactcatctctgagttcttcttaggatgtcaagagtaggtaaggttcttcgcgttgcatcgaattaaaccacatgctccaccgcttgtgcgggcccccgtcaattcatttgagttttaaccttgcggccgtactccccaggcggtcgatttatcacgttagctacgggcaccaaacataaagcccaatccccaaatcgacagcgtttacagcgtggactaccagggtatctaatcctgtttgctccccacgctttcgcacatgagcgtcagtattttcccaaggggctgccttcgccttcggtattcctccacatctctacgcatttcaccgctacacgtggaattctacccctccctaaaatactctagccacccagtatgaaatgcaattcccaagttaagctcggggctttcacatctcacttaagtcaccgcctgcgtgccctttacgcccagtcattccgattaacgctcgcaccctccgtattaccgcggctgctggcacggagttagccggtgcttcttctgtgactaacgtcaatgtaatgctctattaaaacatcacccttcctcatcaccgaaagaactttacaacccgaaggccttcttcattcacgcggcatggctgcatcagggttccccccattgtgcaatattccccactgctgcctcccgtaggagtctggaccgtgtctcagttccagtgtggctggtcatcctctcagaccagctagagatcgtcggcttggtaggcctttaccccaccaactacctaatcccacttgggctcatcttatggcaggtggcccgaaagtcccaccctctagtccttagacattacgcggtattagcgacagtttcccgtcgttatccccctccataagccagatccccaagcattactcacccgtccgccactcgtcagcaaagaaagcaagcttccttcctgctaccgttcgacttgcatgtgttaagcctgccgccagcgttcaatctgagccatgatcaaactcttcaatttaaaaagtttaatcgctcaataaactgcttagctaaagtttacatattacttttaagtaaaaatgaatttctagtttaagcacctattaagacttcaaaattaaaaaaatatatttaaacaaagtcaatcaacaagtgcccacacagattgtctgacaaattgttaaagaacaaaaaaagaacgacgcactgccaaatttaattacttcacaacagcgcgtcgttgtgtggtgtgcattatagagaaattcaaaaccaacgcaagtactttttgcaaaaaatttgaaaaaaaatgtccgcttggtgaaaagaaattcagtttgagtgaatttttagcgacaagcgggcgattttcattactttttcacaatacatcaagcaataataaatacattgctctctactgtgaaaagcgatgatgtcgaaagtgttgcaaaatgaatcgcattgccttttccgcttccatcactatcgtagcttaatttccctgttgatgaatcatattgaatatgttctatcactttatctgcacttgttaaactactaaagatcgttttggataattcaattttatcttcagcactgaaatcggtaataacatctgccttaccattcaaactagcattgaaaacaaaagtatcctcaccttccccgccaattaatgtatcatcacccgctccgccgtaaatattattgtctgcggcattaccgattaaagtgtcgctatgtgcggaaccaagtagattttcaatttgtgtaccttgtccgatataggcttgaccttttgtatattcgacatcagaaatatctagaggcgcattcacagccccattactatccactgttgctttatcaggtaagccaaagtatatttttacgtcctgcttactactgtgaacgcttttaatcaagaaatttttctcttttgtctcaccaacataaatccaagagcctggatttaaattaacatagacccctgcttgctctttagatgcgtcaaaggtatcaatccctgcgccatcccaaatataacgaccaccatcggaggcgtaagtattaaaatcagcaaaggtataaacatcatctccagcacgagatttcgcattcacaccaaaacgattttgtaaataggctaaatcatacattcgcaaagaatgtaacttctgatataagctattgtttacataacggttataagacatcactgaaaactcagaactgtcttcaatcaaatagtctttaccaaattctgttgtggaatcagtatgcggcattcctaaggtatggcctatttcgtgtaatgcggtgtaataactgtaatcctcgccccagctcttataatcatttgctgcattccaagtgatatttcccccgctcattgccacagcagcagaaccgttcgtcattttgccaaaattaatcactaaactttgtctatctgtaacaggaaccaccttactttccacaaattcaacgttaagatagcttgagtattgatcataaacctctctaaaaatctctttcaatctcgtatcttgtaacgcatcgcttggaacacttccgcctgtttcaaactccaattgctctgaaccgtggaaataatatttaatcaccgcaggtttctcttgcggtgaacctgccggtacattgtagctcagaccaaatccacctaaacgtttgacaaaataagccgtgctccaacccgcttgtgaatgatcatcttgcactttttcaataaaataagggaaattatagccatcagtagagtgatcattattaatctctttcggtggttgattttgtacaataacgtgcttactgcttatattacttggtgttacaactctctctacatcagttacttggatctctttttcagccaagtctttagttgttaatgttgctgttactttatccgtttggaccaaggcttttttatcaaccattgtcgagaaggtattacccgcttgcactttggtttcatagctcttttcacctactttgaccacaacagtatcaccgactttcacagagctattcgccgctgctgtaacagttccgcttacctcaacctgttgttctgctttgtaatttgctttgtagctggtatcagattgtctttctaaatgtggactgtcgaaagttactgttttcactgcaggtgttcttgtaccataactgatccaagtcgcataggaaccatcatcttttttggttagcccataaatattgttatggtagtcacccttaacgcctgttgctaaagaaaacgataatgaaacgtccttcccggttaattcagctaattcacttgcaggaatatcaaggaagaactgtttatcgtggaaaccagccttataaactttatcgccaaacttcactttcacttcaagcaagcgtttgtgatttaaacccacagcatagacatcagtgaactcaacattgcctttaatgcgtacaagcggttcaatttcgcccatatttaacgaaaagtcgcccactttcttaatatcaatttgagcaacgacttctttatcgacactataagcacgagcagtattggcagaagcattgttattgcctgtaacacttgcttttaccacatatttatcggtcgcaataagatcgcttgctggaacttcaagtttgaattttaaattgctatctacaactgccgatttttcttggctatttaccattatttttacggtttgtcctgcctgagcatcactacctgaaatcgtaatattgcccgaacgttcatcgctgctaattgcattatcgcctgcaataggttcaaggccgagtttgacttcaggtgcaatcgtatcaacttgatattctttttctacaggagcttttgctgggttatccatcttatcttttgcggtaacttcaatcgcaaaacgtccatctgtaaccagaccagttgatactgcttcccctactttcaacgtaacaatatcaccgttatttgcattagtcacagacccagtgatcgtaattttttcctgttgagattctatataatcaataaggttatcattggtaatctgatctagagtaatttggggtacactattctcaacatgatttgattgcattgatgattttgaggatgaagacgatttactcgtatggtttctaactgtttctgatacaacgccagctgttgccgcagttaccgcacctgaactaagaccaaccagttgtgctgtgcttaatgttgatgcgatacttgtggaagcaaccgccgaaatctcagctgcagctgcggcactttctgctgtagcaaatgaggcttgagtatttgctaaatattgtgcattttctataggataatgtagttgataatcttgtcacactaaactaggttgctgacttccttctaccgaaatagcaagatcgtttccaacaacttccgctttagcattagtaattaaatttccatgttcatctattagttggtattttgttcctttctctgctttttgaacaaccgttttagcaccgttcaaaacaatgtcttttgtttgatggttattaaccactctcaatatcatttttttcattgattgactctcttaagaaaaattgatattcaattatcattgatacgaaatattcccgtacattgatatttgaacactatgggattccgatgttaaaatctttggagtataatgctaacttattgaaaaacaaatacaattgacaaaaacatatgtatcatattaataggtattaaaaagaactacctgaataacaaatagttacaatacctatcgttatttctgtataaaatcagtaaaataatatttacatatattgaatttcttggagattaggtatggaaaattctaaattcattggactgggcgttgctggtaattttactgggcatttagaacaagctggagaggatagggattttgtgaaaattcaaactagcgaagttcatcaaccaaaagctatttttcccttttatgttcctagcgaacatctagacaaaaatgaacaatttctttcaacatatcctctctctcacgatatcattgtttttcctgagaaagcagacaatctccaaattgaacctgaagttgcattaatttgtgatattgaatataaagaaggtcgtgtgattgcattaagaccaacacattttgcagcctataatgattgttcaattcgccggcctgatgcccgtaaaatttgcgaaaagaaaaattggggagcccattcaaaaggtatttcttctgtacaaattgcattagataaatttgaacaggggggaaatttagatagctaccacattgcctgttttcataaacgtgatggcaaactttcggaatatggagtagatagtccagttattagctatagctatttccatcagaaattgttagcttggatcattgatagaatgaacaaccaacccaatcaagatccaatgaataatatatctgaactaattaaaaaagcagattatcccaataaagcaattattagtatcggagcaacgtgttacacagattttggaaaaaatcactttttacatattggagatacaagcatagttgttgtatacaacgccaaaaaatattcccacgaacaaatagcctcaatggctgaaaaagaaatctttgtaaacgatgatatttcaccattaatacaaattgttcgataacatcaagtattctatttcctattcgcttgtaccatagccattaagctatttagtccagcagatactttttgctggcgttcttgctcactcagtttaggtttatctcgttcccattgcaaatcatcttgcggtaattcgagtaaaaatcggctgatttcgggtttaattatttcgccatattgacggcgttctttgcataaagaaaaagtcagtgtctgttgtgcacgggtaatgccaacataagccagacggcgttcttcttccacattgtcttcatctatgctggtttggtgtggcaaaatgccttcttccataccgatcaagaaaacgtgtggaaattccaaccctttagaggcgtgtaatgtcatcagttgcacctgatcgctttcgtcatcatcttcgccacgttccatcatatctcttagggtcaaattggtgacgacttgatttaagctcatcggctcgctgagttcatcgccttccaacattttctccacccattcaaacagtgtttgcacattgcgactttgcatttctgcggatttcggggttgctgccgtttcgtagagataggcttcatattgaattttcgccaacatatcctgaattgcagatttcggctcggatctgaccgcttgatcggataattccaccacccagcgagcaaagtcctgcaaggcttgatacggttttggggttaaacgttggatcagttcaaaatcaaaaataacttcaaataggctcacctgtttttcattggcaagttgccctaatttttcaagcgtcgccgccccgatttcccgtttcggcgtattcacaatgcgtaaaaatgccgcatcgtcatcttggttcaccaataaccgcagataggccaacatatccttgatttcggctttggcaaagaaagacgttccgcctgagattttgtagggaatacggttttggatcagcaacttttccaacaagcgagattgatgattgccacgatataaaattgcataatctttatacttggttttgcgtgaaaaacggtgtgcaatcaactcacccacaatacgttcggcttcttgttcttcatttttcgcttcaatcacattgagcttttcgccttcgcccaactgcgaaaagaggcgtttatcaaacaagtgatcgttgttatcaatcagaatgttggcacagtgcaaaatccgttggctagagcggtaattttgctcgagtttaatcactttgagcttcggaaaatcctgttgcagccgccccatattttcaggctttgccccacgccacgagtagatcgactgatcgtcatcgcctaccacggtaaaattgccatcacaaccgaccaacagcttaatcaattcatattggctggtgttggtgtcttgatattcgtccaccaacaaataacggattttctgctgccaacgctctttagcttcaggaaattgcttaaacagcaaagtcggcaacataattaaatcatcaaaatccaaagcattgtaggctttgagctgattttgatattgatcgtaaaaatggctgaacacccgatcacgatcgctttttgctaaggcaatcgtctgttcgggcgaaagcagatcatttttccagttagaaatggtcgccactaacaacttcagcagatctttatcttccgttacattttcaggcaacagatgtttcaacaacgccagctgatcgtgttcgtcaaacagcgtcatccccgacttatagccgagcaatttatgttcacgctttaaaatctcaaaaccaagggtgtgaaaggtggaaatcgtcaatccccgactgctttccttaccgatagaatgtgccacacgctcgcgcatttcacgggcagctttattggtaaaagtcaccgccgcaatctgcttcggcgaataaccgcaacgggcaatcagatgagcaattttattgatgatcacccgtgtcttgcccgaaccagcacccgccagcacaaggcaagccccattgacatattctaccgcttgttgttgttgagtattgagtttcattgaatttccttttgatataagcggtatgattttagtgattttttgcggattgtcgagaatgatttacctttataatcgctcctatcccctactatttttagagggttatagttataatatctagcaatctagaaaagttgagaaaaaaatatgtacagcaaaattttagcgacgggaagctatatgcccacccaagttcgtacaaatgctgatttagaaaaaatggtagaaacctcagatgagtggattgttactcgctcaggtatcaaagaacgtcgcattgctgcagccgatgaaactgttgcaacaatgggctttgaagcagctaagaaatgtttggaacaggccaatatcgatctgcaagagatcaatttaattgtggtgggaacaaccagtaattctcacgcttatccaagtgctgcctgtcaaattcaaggtttgttaggcattgaagatgcaattgcttttgatgtagccgccgcttgtactggatttgtttacgcattaagtgttgcagatcagttcgttcgtacaggacaagtgaaaaaagccttagtgatcggttcggatcttaactcgcgtaatttagatgaaacagatcgtagcacagtgatcttatttggtgacggtgcaggtgcagttattttagaagcaagtactgaacagggtattatttctacgcatttacacgcttcccctgaaaaaaatgagatgttagtgttgccttatgctcaacgtggcgataagcaatctggctatattgaaatgcaagggaacgaaacctttaaattagccgtgaagcagctttctgatgtggtagaagaaactttaaccgcaaataatttggaaaaagctcagttagattggcttgtaccacatcaagcaaatttacgcattattagtgcaacagcgaaaaaattagagatggatatggaacaggttgtgatcaccttagatcgttatggcaacaccagtgctgcaaccattcccgtagccttagatgaagcggtgcgtgacgggcgtattaaacgtgggcaactattgcttcttgaagcctttggtggcggttggacttggggttctgcccttgttagattttaatcggcgaacattaaaatgtctgaaaaaattacttttgccgataaaaaacgtaaaaccgttgaacgtgctgaatttactgctgatggtcgctatcttcgtaaagtgcgtagttttgtactgcgtacggggcgtttgagcgattatcagcgtgatatgatgaataataactgggaaaatctcggtttggattatcaaaatacgccttttgattttgaggcaatttttggcaacggcaatcctgtagtgcttgaaattggcttcggtatggggcgttcactcgtggaaatggcagaacaaaatcctgatcgcaactatattgggattgaagtccacacaccaggggttggtgcttgtatcgcttatgcgttggaaaaaggcgtgaaaaatctgcgagtgatctgccacgatgcgacagagattttgcgagatagtattgctgatggatcattaggtggattgcagctttatttccctgatccgtggcaaaaagcgaaacaccataaacgccgtattgttcaacctgaatttgttacccgtgtattaaccaaactgtcgccgaatggttttatccattttgcgacagactgggaaaactacgccgagcatatgctagaagtattacgtcaatttgatgcttcattgcaaaatacatcagaaaccagcgattttatccctcgccctgatttccgtcctttaactaagtttgaagaacgaggacataagttgggacacggcgtgtgggatttatattttattaagaaataatgttactcaaataggagaaagaaaatggctcaaccaattcgtaatcgcagacagcgtaaaaaaatgcacttagcagagttccaagaattaggctttttagtgaaattccaatttgtagaaggtactggtattgaccaaattgatacaactgttgatcgtttcattgatgaagtaattcgcccaaatggcttagcttatgaaggcagcggctatttgcattgggaaggtttaatttgcttagaaaaattaggtaaatgtgatgaatctcaccgtcaattagtgcaaaaatggttagaagctaatggcttagttgaaatcgaagtgagtgatttgtttgatatttggtgggattatccattactaactcaataaactaatacatagattattatgtgatttaaaagtaatctttgcatgtccctatctcgtttaattattaataatttccgaaatttaacagctgtggatcttgagctgaaccacggctttaacttttttattggagcaaatggaagtggaaaaaccagcctacttgaagcaattttctaccttggtcacggtaaatcctttaaaagtcatattagtaatcgaatcattaagtacaaccaagaagaattcactttatttggcaaaatccaagaagaaaaacacgaatgctctgtcggtttacaaaaaaatcgtcaaggagaaactatattaagaatcaatggggaaagtaataaaaagatcgctgacctagcctatcttcttccaatgcaagttattacccctgaaggtttaacattgctcaatggaggaccaatatatcgcagagcattcctagattgggggttgttccatcaaaatactgacttctatcataattggaatagcctaaaacgactactaaaacaacgaaatgcagcccttgtacaaactcgtcattataatgaactaaagccatgggatgtcgagcttagcaaatttgcacaaatagttagccaatctagggctgtctatgccgaatctattcttacctacattgaaaaaaactgccaattctttttacctgaattagaaattacagcaactttctatcaagggtgggaaaaagagagagattacgccgatcttttagcacaaggctttgaaagagacagatccgttggatatactatggtcggtcctcaaaaagcggattttcgcttccgagctaacggattaccagtagaagacgtactttctagagggcaacttaaattattgatgtgtgccttacggcttgcgcaaggagagtattttattgctcaaaaaaatcgtcaatgtatctttttaattgatgactttgcctctgaacttgacactcaaaaatgcgaattactggctgatcgactgtatcaaagcggttcacaagtttttgttactgcaattacccaagaacagctaaaaccaatacaagggaaaagacaggacaatgccacttcattttttatcaaagacggaaaaatgcaatttatgtaggtaggatacttaaatactataaaaatgttcaataatgcttcaatcctttagagagtttctcactatgagcatagtagacaaatttgtctactatgcctgtatttttatgtaaatgctttctttgggtacgtttgactttccattctaagaaaaatatcttttattgaacaatacaaattgctcttcataatgtaaaactatctgcatcaaaaagcccccaaaacttcacagttctgagggcttttccattttaacaacggtggggcaaagcccacctataagtgactactcttcatcatcaccatcaaaccctgcatttaataatgctgcaaggttttgggttgcttcgtcattaacaaagctttgggtttcagcttcgatgtcttcctcagttgcaaaagaagaagcagaaactgccgcttgtgcgacgctgatttctccatctacgctacgacgttttgcgcgttctttatgatatgcaaaaccagtacccgctgggattaaacggccgacgataacgttctcttttaagccgcgtaattcgtcacgtttacctgccacagctgcttcggtaagcacacgagtggtttcttggaacgatgctgcagaaatgaatgattctgttgcaagtgatgctttggtaataccaagcaattcacgttcaaattccacttctggtttgccttcagcaacacgtttgcggttagcgattttcacacgtgccacttccacttgttcgccttctaagaactcagagtcgtaagcgttggtaattaccgctttacgtaacatttgacgtacgatcacttcgatgtgcttgtcgttaatttttaccccttgtaagcggtaaacttcttgcacttcgtttacgatgtattcagttactgcgtgaacaccacgtaagcgtaagatgtcgtgtggcgtttccgcaccgtcagagatcacatcaccacgttgtaccatttcgccttcaaacacattgagctgacgccatttcggaatcatttcctcgtgtgtttcgccctctgctggagtaattaacaagcggcgttttcctttagtttctttaccaaatgaaacgatacctgaaatttccgcaaggattgctggctctttcggtttacgagcttcaaataagtctgcaacgcgtggaagaccacccgtaatatccttagtcgctgtggattcttgtggaatacgcgctaatgcctcacccacagagatttctgcaccgtcgtttaaggtaacaattgctttacctggtaagaagtattgtgctgcaacatcggtacctgcgattaaaatatcgttgccttgtgcatcgactaattttaatgctggacgtaaatctttacctgccgttgcacgctcacccacatcttgtactaccacagatgaaagacctgtgagttcatcggtttgacgtgttacggttaagccatcgacaatgtcgctgaacttgatgaaaccgcttacttcagagatgattggcattgtatgtggatcccagttagcaaccacttcgcctgcattcacttctgcaccatctgcttttgaaagcaccgcaccgtaaggcactttatagttctctttagttcgaccgaacgcatcaaccacagttaattcggtgttacgagaagttagtactaacttgccatctttgtttgtaaccgatttcgcattggtaagtttgatcgttcctgcatttttcacttgaatgctagattcttttgcagctgcagatgccgcaccaccgatatggaacgtacgcatcgttaactgtgtacccggttcaccgattgattgtgccgcaataacaccgatcgcttcaccttggttgattaagtgaccacgagcaaggtcacgaccgtaacatttcgcacacacgccgaagtctgtgttacaggttacgactgagcgcactttgatcacatcaacagattcacggtcaatcacatcacaccatttttcatcaattagggtgttacgtgggattaacacttcttctgaacctggttttaagacatcttcagctaccacacgacctaatacacgatcacgcaatgcttcttttacgtcaccaccttcgataagtggggtcatcacgataccttcgtgtgtaccacagtcgtcttctacgatcactaagtcttgtgccacatcaactaaacgacgggttaagtaacctgagtttgctgtttttaatgcggtatccgcaagacctttacgcgcaccgtgggttgaaataaagtattgaagaacgttcaagccttcacggaagtttgcggtaattggggtttcgatgatcgaaccgtctggacgagccatcaagccacgcatacctgctaactgacgaatctgtgctgcagaaccacgcgcaccagagtctgacatcataaagatgctgttaaatgatgcttgtttttccggattaccttcacggtttaatacttcttccgttgataagttttccatcatcgctttcgcaacacgttcgttcgccgctgcccaaatatcgatcactttgttatagcgttcgcctgcagttacaagaccagagttgaactgctcttgaatttcagcaacttctgcttctgctgcacggataatttcgtgtttttgttctgggataaccatatcgttgataccaactgatgcccctgaacgtgccgcatacgcaaaaccggtgtacataacttggtcagctaaaactaccgattcttttaaacctaaacggcggtaagattcgttgattaattttgaaatcgctttcttacctaatgtttggttgaataatttgtatggcataccttttggcgaaatcatccataaaattgcacgacctacggtggtatccactaatgaagttttcggctcaaattcgcccgcttcatttttctcgtattcggtaatacgtacttttacacgtgcgtgtaattctgcttgaccggtacggtatgctttttctgcttcacgagggtcaaggaaatacataccttcccctttcgcattcactttctcacgggtcatatagtataaacctaatacaacgtcttgagatggaacgataattgggtcaccacttgccggtgaaagtacgttattggtagacatcattaacgcacgtgcttctaactgagcttctaacgttaatggaacgtgtaccgccatttggtcaccatcgaagtccgcgttgaacgccgcacaaacaagtgggtgtaactggattgctttaccttcgattaagattggttcgaacgcctggatacctaaacggtgcaacgttggtgcacggttaagcaggattgggtgttcgcggataacttctgcaagaatatcccatacaatcggctcttcacgctctaccattttcttcgccgctttgattgttgaagcaataccacggctttctaatttagaatagataaatggacggaataattccaatgccatttttttcggtaaaccacattggtgaagacgtaagtatggacctacggtaattaccgaacgacctgagtagtctacacgtttacctaataagttttgacggaaacgaccttgtttacctttgatcatatccgcaagtgattttaatggacgtttgttagaaccggtaatagcacgaccacggcgaccgttatctaataacgcatccacagactcttgtaacatacgtttttcgttacgtacgataatgtctggcgcaactaaatctaataaacgttttaaacggttattacggttgatcacacggcgatataaatcattcagatctgaagtcgcaaaacgaccaccatcaagtggtactaatggacgaagatccggtggaagaactggtaataccgtcattaccatccattctggtttattaccagattgttggaatgcttctaaaagttttaaacgttttgtgatttttttacgtttggtttcagaattcgtttcttgtaactcttcacgcatggtttcgcattggtgttctaaatccatatcgcgtaataacgcttggataccttccgcacccattttcgcatcgaattcatcaccccagcgctcttcagcgtctaagaattgttcttcagttaataactgacctttttcaagatcggtcatacccggttcgatcacgacatagctttcaaaataaagcacacgctcaatatcacgtaacggcatatcaaggattaaaccgatacgggacggcagtgattttaagaaccaaatatgtgccacagggcaagcaagttcgatgtgtcccatacggtcacggcgaactttcgtttgagttacttcaacaccacatttttcacaaatgacaccacggtgttttaagcgtttatatttaccacataaacattcgtaatcttttaccggcccgaagatacgtgcacagaaaagaccatcacgttctggtttgaatgtacggtagttgatggtttctggttttttaacctcaccaaaagaccaagaacggatcttgtccggcgatgctaaaccaattttaattacatcaaaatcatcgtttgatttagattgtgcttttaaaaacttaactaagtctttcacgtttttgcccctgatttgaggtttttgttcttgaaatagtcgcccatttcaactgaaaatctttggttgcaagcggtcggttttggcaaattgtttgcaagatttgaccgcttgtgtgaacaaatgtagggacacactgcgtgtgtccgcaaattttcgttcttaggcttcgtccaactccatatcaatcgctaatgcacggatttctttcgtgattacgttgaatgactctggaatacccggttccatatagtgcgtaccatctacgatgtttttatacatcttcgtacgaccgtttacgtcatccgatttcacggtaagcatttcttgtaatgtataagccgcaccgtatgcttctaatgcccatacctccatctcaccgaaacgctgaccaccgaactgcgctttaccacccaacggttgttgagtaacaagactataagaacctgttgaacgagcgtgcattttgtcatcaactaagtggttcaatttgagcatatacatataacctacggttaccggacgctcaaatctctcaccggtacgtccatcatataaggtaatttgacctgatgttggtaaaccacctaattctaataagcctttgatttcgctttcgtgcgcaccatcaaatactggtgttgcaagcggtaaacctttacgtaagttttgcgctaaacgcatcacttcttcatcagagaaagtgcttaaatctacagattgtgaaccatgacctaaatcatacgctttttggatatattcacgtaatttcgcaacagattgttgctgtttaatcattgcgttgatttgatcaccaataccacgtgccgctaaacctaagtgtgtttctaagatctgaccgatattcatacgtgaaggaacgcccagtgggttcaacacgatttcaaccggctgaccgttttcatcgtacggcatatcttcaactgggttaattttcgagataacccctttgttaccgtgacgacccgccattttatcccctggttggatttgacgtttcaccgcaaggtaaactttaactacttttaatacgcccggtgctaaatcgtccccttgaatgatcttgttacgtttgatctcaagtttacgttcgaactctttgcgtaactcttcgtgttgttcagcaagctgttctaactgattttgttttgcttcatcttctaaagtttgctctaaccatttctcacgagccactttatctaattctgcttcgcttatgccaccttctactaataagttgcgaacacgagtgaataaaccagcttctaaaatttctaactcttcggttaaatcttttttcgcttcacgaagttgcatttcttcgatttctaacgcacgtttatctttttctacgccatcacgagtgaagacttgaacatcgataaccgtacctgatgtaccgtttggcacacgaagtgaactatctttaacgtctgatgctttttcaccgaagatcgcacggagtaatttttcttctggggttaattgggtttcaccttttggtgtcactttacccacaagaatatcgccacctttcacctcagcaccgatatacacgataccagattcgtccagtttgcttaatgctgactcacctacgtttggaatatctgcagtgatctcttctgcaccaagtttggtatcacgcgccacacaagataactcttgaatgtggattgtggtaaagcgatcttcttgtactacacgttcagatactaacattgagtcttcgaagttatagccgttccaaggcataaatgccacacggatattttgacctaacgccaactcacctaaatccgttgaagggccatcagctaagatttcaccacgacctactggctcacctaatttcacacaaggaatttggttgatacaagtattttggtttgaacgggtatatttgattaagttataaatatcaatacctgcttcacctgcaacggtttcatcttcattgactttcaccacgatacgagaagcatcaacgtattggatagtaccgccacgttttgcaatcaccgcaacaccagagtcaagggcgattggtttttccatacctgtaccgactaatggtttgtccgcacgcaatgttggcactgcttgacgttgcatgtttgcacccattaacgcacggttcgcatcgtcgtgttcaaggaacggaattaatgctgccgccacagaaaccacttgttgcgttgaaacgtccatatagtgaatttcttctgggcgatataaacctgactcaccgtgttcaccacgacaggttacataagtatcagtaaagcggaagttctcatctaagtttgagttcgcctgtgcgataacgtaagcaccttcttcaatcgctgataagtattcgatctcttcagtcacttgaccattcacaactttacggaatggtgtttctaagaagccgtagttgttggtacgcgcatacacagaaagcgagttaatcaaaccgatgtttggaccctcaggggtttcgatcggacataagcgaccatagtgagtggtgtgtacgtcacgcacttcgaagcctgcacgttcacgagttaaaccgcctggacctaacgctgaaatacgacgtttgtgggtgacttctgaaagcgggttgttttggtccataaattgcgaaagttgtgatgaaccgaagaactctttcactgccgcagaaattggtttcgcattgattaaatcttgtggggtcacgccatctaaatcgcctaatgaaagacgctcacgcaccgcacgttcaacacgcactaaaccgatacggaattggttttccgccatctcgcccactgagcggatacgacggttacctaagtggtcaatatcatcgacttcaccacgaccgttacggatttcgatcaatttcttcattacaccaatgatgtcgtcgttgcttaagatacctgtgcctacgccttcaggaatatctaaagaacggttgaacttcatacgacctaccgcagaaagatcatagcggtcggttgagaagaacatattgtcaaataatgcttcagccgcttcttttgttggtggctcacctggacgcatcatacgatagatttccactaacgcacttaaacggtcgtaagttggatcgatacgcaaggtttcagaaatgtacggaccgtaatcaagatcgttagtaaataatacttcgatctcgttgtaacctgcttgtgctaatgctgcaagggtttctaaaccgatctcgctgtttgctgggcaaacaatttcacctgttgaaagatcaacataatctttcgctgtcacacgaccgacaatatattcagtcggcacttggatttgggtaatattgtctttttctaatgcacgaatgtgacgagcggtgatacgacgaccactttcaacatagactttgccgtttgcttcaatgtcgaaagctgccgtttcaccacgaagatgctcaggcactaaggtcattagcaatttgttgtcttcaatgtggaaagtcacggtttcgaagaacatatttaagatttcttcagtcgtgtatcctaacgcacgcagaataatggttgctggtaatttacgacgacggtcgatacgcgcatacaggttgtctttcggatcgaactcgaaatctaaccaagaaccacggtaaggaatgatgcgtgcgttataaagcactttacctgaagcgtgggttttacctttgtcagaatcgaagaatacacccggactacggtgtaactgagaaacgataacacgctcagtaccgttgatcacgaaagtaccgttgtcggtcatcaatgggatttcgcccatatagacgttttgttctttgatgtcttttactgtgcctgctgccgcttcgcgatcaaaggtcacaagacgaagttttacgcgtaaaggcgctgcataggttgtaccacgaatttggcattcacgcacatcaaatacgggttcgcctaattcgtaagaaacgtattgtaattcagttgcaccgttgctgctcacaatcggaaacactgaacggaatgccgcttctaaaccttgaagtccttcaggatctctttggataaatttatcaaaagaatcgagctgaattgttaatagataaggtacgttcagaacttgtgagcgtttgccaaagctcttacgaatacgctttttctcggaatatgagtatgccattaaatatagcctctgattttctgtttggttgagttttcacaatccgcctcaagaccggcaggaagtggcattataaaaaatgatacgaggtgtcgttttctgagttcacacaaagggtcaaaaatcactaccgcagaggttagctcaggggggaacggtctttgcacaattttgcacgaaagcgaccgcttgcgatctataaactcataacaacatcttataaatcaattaattagccaaactaaaacgacgcaaatttagctaatgttattcaagcacaaaatggctagacgaaaattcatctagccagtatgcgaaattcggattgcggattatagcaatttggtgtttttttggcaacaagaagaaactcaataaattttgaaaaacttaattattaaaaaaatggcattcaaagtgaacgccataaaactattagaaattatgtgatactgggcatacagaatacgatggaacattgatagtacgagttgattctagtacatcatagtaacaaattttatttgttccacttacttcttctctaattaaaaagcccattgccgcatatgttgttgtaactgcacttaacattgcaactattaatacagttttctttgtaattgagagtttcattataagaatccttctagagaaattaaacgatattattaaaaagagcatacgcccttgcaaaattcatctataaatcaatttttgcgatcatatattaatctaaaattataataatataaactatagtttatgttttatatctttaagtagattgatgaatatagtgctagaatcaatactaaaaagatgaaaaatgaacatcttactagccatccaatccgccatacttttgcgaataatcttagaaaaatccgccgattaaaggatatttctcaagaagctcttgcttttgatgcagaacttagtcgagcttatattagtgatgtagaacgaggaaaaagagcgatttcaattgatgcaatggggaaaattgcggacgctttagacgtaaatttggttgatttgcttaaaacggactattctgtggacaatctattgcaaaaatagaatgctggctttgtctataaaaactcttatcctcctaaatgcaaaacccaatgtttccatcggggagcggaccgctgacaaacctaaatatgctcttatgtgtcttatatctaatttattctctcacttcgccgtatgttctgccaaatctcccctagcccctctttgctaaagaggggaaccagcttctctgtaaattttaagatcgaagtttctcaaaacaatttggaatttttcagatgcacctcaagacaatgaacaaaatttaatcttactaatttaagctatcaattcgctcaaattattttacattacgtgtaacaagcaatccacgtatcatcatgaaccaattgaggagactactacgccaagtttttagcctcacatcataaaattctcagattttattcctcgtctccgtgcatggtagtactctctatagctcctaataagtatccctatccctcaacaaatgaacattccccttacggcgtaagaagcctgaacggtcgaagtattcgatcagttgcacggtcactttacgcccatattgaatttcatctctaagctgatttaccgaaatttcgccatgttgttcaatgaaatttttgataagctgagcaaatgcactgatctgttcgtgtaataggaaacggtctttgacaatcggcactaaatagcccaacttccctgctttatatagcaagtcacgcatttcagtttcgtctatggagagttcggaagcaatatctctcacccataaagcttgattggtacgttcaaatagcggtcggatttctgcccaaatttgcaattcagcatcattgaactcaattcgatgcgttgaggtatggatccaaccgcgtgtttgtgccaaagtgttatcggcaatcagttcgtcaatgagggcaaaggcaagttgttctgataactctaacgtagcaatacgatgtaaacgagcctttgtcaccccaagctgatcgctatgctgttgatgatactcttcgagcttcgctacaatgtgttgctggatctgagttttaaatgccccgttaaacaggtgattagagttgagatagtaatccgatttttccgccagtttttctaaatcacgaataaaaatctgctctgcccacagtagttgggttaaattcaccgctttatgttgcagatacagtgcaatacgttcttgatagctcgtgcagttagctaactgtgagagataactcaagcgtgcttcgctacgtttatggcgtttcggcgagtggatttcgatcacctctgcaccagcaagggtttgactgtcgtcgccactacgcaaaataagtttgtcttctaaagcaatgtgtaacggcgtatctaaaatcagttcggctatcgcggtatcatcagcaaggcattgtcttctatccagtaaatttaattttgcggtagtgtgactggcaaagtgatagagatgcacaacactgttttcttttaaagcttgggctgtcgttaggcgaacggtaatgcggtcacaagcaaattggggatcctgctgtgtaatccagtcgccacgctcaatctgctctttttccacattggcgatatttaaggctaaacgttgccctgctaccccgatcgatgcttcgttattttgagcgtgaatgttttttatccgcactttctgaccgcttgagagataaaattcatcaccgatagccactttcccagcgaccgccgtccctgttaccaccaatcctgcacctttcacattaaatacacggtcaatcgcatagcgaaacggtttatctatttgtgtgctttggtgattaaggctgatcagatggtgctttaatggctcaatgccctcgcctgtctgagccgaagtcacaaagaaatgggctgaagccaaaaacggataacgctgttttaattgttcgatcagttgggtagtgcgagtcgcttccactctgtctgctttggtgagtacgataataatctgcttaaaattcaacaggcgaagaatagcaagatgttcttccgtctgtggtttaatcccctcgtctgccgataccaccaacaaagcgtgttggataccgccaagccctgccaacatattagacagaaatttttggtgccccggtacatcaataaaacccaaaatatcattttcaatcggcaaataagcatatccaagatcaatcgtcagcccccgttttttctcttctggcaagtgagcggtgtgagtgcccgttaaggcgtataaaagtgatgttttgccgtgatcgacgtgtcctgcggtgacgatgatcatagttcctccaacataaaaataagcacctcaaactccgccacacttcgcacatctagccacattttttgttgtgcaaaacgagcaataatcgggtttggataggttttaaactgtttttctaattcaagtaaatcgctctgtttgtctgccgaaatagtcacggcaagcgatgggattttttctgtcggtaacgccccactgccgatttgagcttcactcggttcaatttgcaaaagataacgataatctaaccgcttacttaatgctacttttaaacgttctgccttgtgttgcaagcaatcaagggattgtgttagcaagtgcaatgtcggtagctcgtccgttaaacgatcagggaaaagatagtggcgtaacgtagcttctaagcctgacaaaatcactttatcacaacgcaaaacgcgtttgagtgggtgctgttgaagttgatcgataaaggcttttttcccaacaataatcccagcttgtggaccgccaagtagtttatcccctgaaaacgaaactaaatccacacctgaagcgactttttgttgcattatcggctcggcaggtaggtttagggattgcatatcggcaagcgagccactgcctaaatcgctaatcacaggcagattaaactcttgccctaatgccgccaactcttcttcactcacactcgaagtaaaaccttgaatttggtaattactggtgtgaactttcattaaaaatgcggtattttcgttgattgcgttgcgataatcttttaaatgggtgcgatttgtcgtacccacttcaaccaacttgcaccctgcttgagccataatgtcagggatacggaaagcaccgccaatctcaattaattcaccacgagagataatcacttctttgccttgagcaaaagtcgccaacattagcaatacggcggcggcattattattgaccacgcaagccgcttccgcccctgtcagttgttgcaacagctcagaaacatagagatcacggtgactacgtttgcctgcttcaatatcaaactccaacgccacattatttcgcattgcactggtagcagctgaaatcgcttgttccgaccacaaacctcgaccaagattggtatgcaaaactgttcccgtcagattaaacacaggtttcattttaacttgagcaaggctttgcaagcggtgagttaattcgttaaaaagcgtatgttccgtttgtagaaagtcaggcagactttgatgttgctgaatatgttggcgagcttgttcaatcagtaaacgagcttgagcaacaaaggattgatgtccgaattgttgaattaaatcagcaccttgtgatatttttagcagtttatcaattgcaggaattgaacgaaatagtgattgcatagcagagatccgtcagaaattttgcacaattctaataaattcagtagaatagtgccactttttcggaggtgtgtcatatccggtgatgtggcaggacttcaaatcctgttgaggatgccagcgttctcgggtgggttcaactcccatacgcctccgccaactcaagtttctacacatctctcaacgtaacccaacctaacaaaaatagccttctaataatcgctttctgagtggagtggattgcataacagaattagtctacccttttttctataaaaagctggcaagaccacaagaatagattattactataaataagatattaattaaatttacaagaatattgtcgggatagtaaatagttagataatatttaatcgcctgattatgctattttcactatttgtaatatagttactttgtttgcctaaaaaagatgttagaaaatcgcttcaagtcgtaaaaaagcaccgaaatggtgtttacgattttgttttttatcattgtaaaaatgaacttcaggctgaataaacacccaatctttccaaattggttgtcgccagttgatgaaaggtccgtagtgagttagatccgcttttttcttattgatgttaccgccaacaaataaaccatagctcaattttttatagcccgcaaaatcgtgctgacgatacaaactatttccccattcaacattctcatctaaatcacgggtatattgtagaaaggtatgattattgataaaaaccttaggtttccactggaatttattttcaaaattagtgcggagatagtgcttgctttctataccgtatcgataaatttgctctaatcgagtagaaaatacctcattgtgtttccaggttttagctactttgaaacgtaagaatatgtctgtcccagaacgaatccctaaatccacatcagtatcaactcccaatgcttttacgccattagaccaacgtaatgctaaagatgcattattatcacgaacctgtttactgtcataccttttatgtttatccaacggctcacgataattacgatgtagctgattttgatcccgagcttggttatctaaatcttcatcaccaaatacaacactcaaatgctgttttaatgctggcaagctgatcttgtaattttattcgttgatgatctacccaagttgggtttgctttagttactaaaggtaatgcaagcaaagaaaatgcgatgagattatatttcataaaataccttctccatttgggattttaatggaactcactacatctaaaagacaaagcggtaagatttcagctcaatcttaccgcttgcattttatctattcaaccactccatataagccttagtcccttctgcaacggttttaaacggcttatcataacctgccgcacgcagtttggttaaatcagcttgagtaaaggtttggtaacgagattttaaatgatctgggaatggaatagtttcaatttgccctttttgatggaacgccaacaccgcatcagcaacggcacggaaagactccgcattgcctgtacccagattgaaaatacccgaaatcctattttgccacgcccaaatattcacctgagcgacatcttccacatacacaaaatcacgcaaaaatgtttccgaaccttcaaatagtttcggattttcgcctttaagaatttgcgtattcaaatggaacgccacacttgccatcgagcctttatgctgttcgcgtggaccatacacattgaaatacttaaagccacacactggcgactctgcctcaggcaaaattttacgcacatattcatcaaacaaaaatttagaatagccataaacatttaacggctgttcaaattttctctcttcaataaagttgtccgaacgaccgccgtaggtcgccgcacttgacgcataaaagaaaggaatttggcgatctaaacagaaatgcaacaactctttagaatactcatagttattttgcattaagtatttaccgtcccactccgtcgttgctgaacaagccccctcgtggaaaatcgcatcaatctcaccaaaatcatcgccagcaataatagatgcaataaaatcttctttatcacaataatctgcaatgtctaaatcgactaaattaacaaacttctcaccatttttcaggttatccaccaccaaaatatcggttctaccgatagcatttaacgccttaacaatattgctaccgataaagccagcaccgcctgttacaataatcattgtcttctcctttatttcgcacgctcaatctgttttttcagtttgagcattttttctttgatacgttggcgtttaagctgggaaatgtgatccacaaacaacacaccatttaagtgatcgatttcgtgctgaatacaaatggctaacaaaccatctgcttcaagcgtaaacgtttgaccttcacgatttaacgctttaacggtcaatttctctttgcgtggcactaaagctcgacaaccaggaatagacaaacacccttcttcaatacccgtttcgccactgctttccaaaatctcagggttaatcaacacgatttgattagttttatccccttcaatatcaatagtaatcacacgtttaagcacattcacttgcggtgcagcaagcccgatcccctcgtgttcatacattgtgtcaaacatattatcaataaaagtatttagttctgcgtccaccgtttctacgggttggcaaactttagccaaattctcatctgggtaaattaaaacgtctaaaacagccatttttgcgatctccgtcgaaaaattaaaaagaatatgttggctattttaaactttttattaggattagggaaatgtatgtagaagggagcttaccattaatatatttttctagcctctagctatccccctctttagcaaagaggggctaggggagatttggcagacgaataaacgaagtgagtgattaaaaagcccttagtttttttattattgattgccaaataaattattttcttcgttatttacttctgtcaaatctcccccaacccctcttttctaaagaggggagtgagatcgaagtaaatttaatatttctacgataaggtaaataataaatgacacatctcacaaaattattagccctgttacaagtgccacagcttggcgcacaacgtatcgggcggttactctcggaagtggactttggcgaattttgtcaatatgacaaaaccgcattaaagcaaatgggctggaatgaacggcaaattcagcgttggtttaatcctgagcataaatggatcgatcaggcgttgcaatgggcggaacaggatcagcaacggattttaactttatttgacgaagattatcctttcttgctgaagcagatcagcaccgctcctccagtgctttttgtgcgggggaatgttgaaagtttatcgttaccgcagatagctatcgtcggcagtcgagattactcccactatggcgaacactgggcagggcatttttcggcggaattagtgaaacatcaacttgctgtcactagtggtttagccataggcatagacggattttgtcatcagcgtgcggtcaatgaaaacgggattactattgcggttttaggcagtggtttagaccaagtttaccctgctcgccacaaaaaacttgctgaacaaatcgttgaaacaagcggtgcattagtgtcggaatttttccctagccagccaccgattgctgagaatttccctagacgaaatcgtattatcagcggattatcgctaggcacattggttattgaagccacggtgaacagtggctcgctcatcactgctcgttatgcgttagagcaaggacgagaagtttttgcattgccgaactcagtacaaaacccgtatagcgaagggtgccataaattgattaaagaaggggcattgctggttgaaaatgttgaagatattttagatgcgattgcgtggcaacggcagtcagtgcatattcaaccaagtctatttgatacgaaacctaaacaagcggtgaaatccgaccccaaatttgcaaaaaatctacctgaactgaccgcttgtcagcaacaattgtttgaacagattagccttgagccgatcagcattgatgatcttgccaaagcgacggatatggcggtagaaaccgcattgattgagctgctgaatttggagttgttgggcgtagtgaagccggtgagtggggggtatgtaatcacttgataataattctcaataatataaaatgagaacctttatcatttaggaggtttatatgccattcattcgatttttctgttttctcaccgcttgttttgcaatttctataactgcacaggctacaaatgagcgggtgatcagtattgggggcgatgtcaccgaaattatttatgccttaaatgcagaacaaaatttaattgggcgtgatagtacaagtcttaatcccccacaggtgaaagcattgcccgatattggttatatgcgacagttaaacacggaaggtattttggcattaaaaccaactaaagtgattgcgagtgaagttgcacagccgtctgttgtattagaacaactgaaatctgctggtattcaggtggaactcgtaccgcttaaatatagccctgaaagtgtcgtagaaaaaatcaaacgcattggtgacattgtcggtaagccacaacaagcggctactttagcagataaatttacccaagaaataaatgcggtcaataaatctccacttgatgtcaatattttatttattctcaatcgagctggcatacatcaaatggcggctggaaaaggtacagtcgcagatacagctattcgattaattggagcaaaaaatgcaatgaaagacgcagtaagatttgctccgatttctcaagaaggaattatttcagcaaatcctgatttaatcgtgcttagccatttgagcttggaaaattttaaatctcccgatgaaatttggacattacctggacttgcacataccaacgcaggaaaacataagcgattagttgttgttgatgatattgcgtttcttgctttcggattaacaatggggcaagagctacaaaaaatgcgtactgcggctgaacaagtggtgaaataatgtcccgttccctttggctgatctcactacttatcgtattgctgcttgtggcactgattgcaacaaatgtcggggcattttctttgacgtggcaagacttaattgcagcagacctaaacagtaatgtgtggcaaatatggttaaatattcgtttacctcgtattttactcgccattatcgttggtttagcccttgcggtttctggcacggtatttcaggggttatttcataatccgatggcagatcctacattaattggtgtaaatagcggggcaagccttgctgtcgccctctctattctgttgccaaatattttaccaacagagtggggcatttatagcacaatgctttttgcttttatgggtagtcttgctgtaactgggtttatctatgccttaagtcatcgtactcaagcctctatgcaaaaattgttattggcaggtattgcagtgaacgcactctgttttgctattgtcggaatgctgacatatatcagtaacgatcagcaacttcgtcaatttacactttggacaatgggaagtttaggacaagcacaatggcagccgttatttattgcaagtacgctgattttacccgcctgtttatatttgtttactctcgctcagaagctcaatgtgttacaacttggtgatgaagaagctcattatcttggcattaatgtactacaactaaaacgactgttgatgttacttggggcgttattagtaggctctgccgtagcagtgagtggtgcgattgggtttatcggtttagtcattcctcaccttgttcgctttaaattaggtgctgatcatcgttgggttctacctgcttcggctctttgtggagcaatcttgctacttattgctgatacctttgctcgaactgcatttgctccagcggaattgcctgtcggtatgattaccagttttcttggcgcaccttattttctgtggttagtcgttcgttatagggaggtaaattaatgttgcaatcagaccgcttgctgatcgctgataagctcacattaacgattaatcagtgtcttttgttagacaatatctctttagcgttaccacaaggtaaggtgacagtgctgattggtcctaatggtgcgggcaaatccacactgctacgcctattatcaggctacctctcggcaaaaagcggagaagtgcgtttgtataataaaggtatagatcaattctctttagctgaattggctcaacatcgtgccgtaatgcgacaacatagtctgctcaattttcctttttctgtagaagaggtgattagaatgggaggctatcatcgaagccaaacggaagtcgatcagcatttagaagaggtgattacggtgacagaatgtacggctttgcgagataaggcttatcgacagctctctggcggtgaacaacaacgcacacaactagctcgagcgttgttacaactttggagtgaagatatgcgaggtaaattgctatttctagatgagcctacgtcagcctttgatctttaccatcaacaacactgcctacgtttactcaaaaatctatgccaaaagaaagggctaacggtatgttgtattttgcacgatctcaatttagccgcgttatatggagatcaactgattttactggcagaacagcacattcaagcctgtggcagtgcaacagaggttatccgaaaagagattattcaaaaatggtataaagcggaagttgctgtttttcctcattttgctacccaagctccgcaaatacaactttctctttaaaatgaaagattataccttgacaaaatatagcactcaaataaaacgataattattatcaattaacatgtaaaattgctatgctgtgttcatcaattcgcaggttaatgatgattagcctgttttttaggcatagtagacaaaagtgttgattttaattattttccctaattattaccaactctttttatttaaaaaatcctttataaacataatcttatgctttttcgttaatccattatgaaccgataatttcggcatagtagacaaatatcctatctaaatcaccgctttcattagatttccgtctattatttctaacttttattgataaaagttgaaaaattcttgttattttatctttagttttgtgtaactctttgtttttttttttttttacaatagcgtgcggggacatttgtgcatcctgaaaatgtaaataaaggtttatgatgttttattaggaaaaacagcttgtagggtgggtcttgacccaccatgtagccgtaacatattgattttattggtgggttaaaacccaccctacaatattcaatccatctaatatatggtttgtcaaggagttaacttcccccgcttgcgggggaagtgcccgagcgaaagcgagggcgatgggggcatttgtgcatcctgaaaatgtaaataaaggtttatgattttttattaggaaaaaggaaaaacagtagagaagcttattatgaataaaatatttagagttatttggagtcatgctcaacaggcttgggtggttgtgtctgagttagtaaagtctcataccaaaacatccgcttacacggataaaagagctcaagtatgcacctcagattattttttagataaacagcaagataaatttaaattaagtcttttaagtctagtattactaggtatattttttagtccagtaggttcagctgagccatggcttcaagatggttctagtcggggaccgcatgttgacgaggctactattggtattggtaaaggtagtagtgttgggcctggttctattactattggttatcaatcagaagctcgaggtaggacttctattgcgataggttattcagctcaagcattcactaacaacgccgtagccgttggggcaactgcaaaagcaggcggttcttctgtggcttatggttatggagcacaagcacgaaaagcaggctctgttgcagtcggtcaaggggctactgcaaatgtagatagaagcactgcattgggtaacacttcaattgttctgtctgatggtggtgttgcattgggttatctctctagagcagatacggtagggggtattaaaggagtaaaacaaagtcattctgtgatggagggagaaagcactgttgagaatggatttaaatctacacaaaatttaaatggtgagagtgttggtgcggtttctgttggtaacaatactcttattgggggaggtaatagcataatcaaacgccaaatcaccaacgttgccgcaggtacacaattaaccgatgcggtaaacgtggcacagcttaaatctttaaccatgaaaattgcaggggataccaataatacacagccaaaagtggggttgtgggatggtacgctcaatgtaaaaggcgacaacggtcttacttcccatgctaatggcgagacaattacggttaaattaaagcaagaggtcaaagataaaattgataagattgatggcttagagactaaaataaatcaaggtattacttttaaaggagatcaaattactcaaactgattcaattaagctaggggaaacactagaagttgtcggaagagataaggaaacggtcgttactgcacaaaataaaaaacttattataggtttagatattgatgttataaataaactggctcagattgacgctaaaatgtcatcctttaaaattaaaacaaataaggataacaatgaagctaaaattgaggatggagatacgatccagtttatcgctggggacaatataaagattacccgcaataataaaaatctaaattttgccgtcacttcaggtatgtttggttctacaactgatggcagattatcaaaacaaaccgaagggcttgctactgttgaggctgtggtatcggcagtgaataatgcaggttggaaactgatgattgcgaaaggggttggtcaagcaagtccacctgctgcggcacatcttatcaaaatgggcgatatggcaacctttaccgctggaaataatattaaattagaacaaaataacggaaatattacgatttctacgattggtaagttaattaaagagactaaaatcgaaaatggtgatttgaaaattacttataccgatggtacgcataacatcatcaaaaaaggtgaaaaaggagaacgtggtgagcaaggtctaagaggtgaacaaggcccagcgggtccgattggtccagtgggtccagcagggactaagggtgaacagggtcaaaaaggagatacaggtccaaaaggagatacaggtcagagaggtgaaactggccctgcgggtccaacgggaccacgaggccctgcaggtgcagctggacctaagggtgaacagggtccaacgggaccacaaggaccgcagggaacagcgggtgctcagggacagaagggggataaaggcgatccaggacaagcggggcctaaaggagaaaaaggagatacaggtcctagaggtgaaactggccctgcgggtgagcgaggagaaacaggccctgcaggtgcagctggacctaagggtgaacagggtcctaaaggtgaacaaggtattcagggacctaagggtgacaaaggtgatacgggtccagcaggaccacaaggtgcaacaggccctgcgggtccagcaggtgctcaaggtccagcaggtcctagaggcgaagctggtcctgctggagcaacaggaccacaaggtccaaaaggagataatggagctccagatgcgactacgaccacaaaaactgaaggtgcaggtgcagatacgaaagtaactactgcaacagcaggtgctgacggtacaagcattgttcagaaagatacaaataatcaaccattgaaatctgcggattataaacttgatggcacaacggttaaagccaaagatgcagaaggtaatgacttaacaacaaccgttaaagcagatggcgtaacggcaacggataaagactctaaaaatactgtcaatgcagatggtatgactgttggtccgaaagacgaaaatcaaacggataaatcagctgcgacttatggcagagatggtgtaacggttaaaggaaatgacggtgcagatgcaattgccttaactagcaaagaaggtcaagatggtaaaacaactaacaccttggcacttaaaggcgaaaatggcaaagatgcagtaagcattacttcgggggcagatggcacagcaccagaaattagctttgctaaaaatggtgagggtacggatgctaaaggcacgggctctatcactggcttaaaagatgttgaacgtaatccagacggcacggcgaaagacagaacggctgcagcgaatgcgggttatgtcgatgatcgcttaaaagaaatgaacgatagaaaaccgtttgagtactttgagaaagatcctgtaacaggcgaggtaaaaactgaaactgtaaatggtaaacaagtaccagttacgcttgttcgcggaaaagatggtaaattctataaagagagtgacttaaaagggaaagttttcgatcctgcaacaaatacatataaaaatgcagatggtagacctgcaacattaactgaggttgcttcaaataatgttactgttcaagcaatgccatctgatgcaagcaatacaccaattgcgatgagcaatgtaggaagtggtttaggtttgaaagatgatgctgaatcaaataaaacggcacttacccctacagatgcacaaaaagctattgctggtgataacaaagacggtaaaggcggcttattggctcaaacgggtaatgcgttaaataatgtagcgacagtgaaagatttacaagccattgcacaagcgggcttagacctcacgggtaacaacgccgataccactgtacatcgtccattgggtacgaagttaaccgttgagggtgaaggcaaatggaatggtaaggactcagcggctaataacctttatgtggaagcgcaagaggcagataacaaacttgttgtgaaaatgaacaaggatttaacgaacttaaattctgtgactttaggcactgcgacaatgactggtgataagaatacaatcaaccttactggtgcaggagagaaagtcgaggaagagtttgttaaatgggacccagtgactaaacaacctattcttgatgagaatggcaatctccagaaatataaagagaaagttgatcctcgtgtgaaactgagtggtattgctgatggtgatatttcaccaaatagtactgatgcagtgaatggtcgccaagtttatgttttaacctatggtatgaagttcttccacaccaatgatggtcataatgcagaggagcaaattaaccataagtcgaatacagtggattcaagagcttcaggttcatactctactgcagttggttacaaagctcacgcgaaaggggagagttctgttgctttaggtaacggggctacagctggagagcaaggcgtggctattggtcacggtgctgtggcgtcaggtaaacaatctatttcgattggtaccggcaatgtggtgagtggtaataactcaggtgctattggtgaccctaatacaattaaagcagatcgctcttatgcattaggtaataataaccaagtgaatgcaggtcaatctgatgtgtttgttgtcggtaacaacgtgaaaaacacaaccagcaactcggtattcttgggaacaaactcaggctatgtggcagcaggtgcaaccactgcgggagcgggtgctttagaaagccaagtaataggtggtgtgtataacgcttacgcaggtggcaaagctactgaagtgaaaggcgtggtgagcgtgggtaatgtaaacagcgatggtacaatggaaactcgccgtattcaaaacgttgcaccaggtttaatctctgagcaaagtaccgatgcgattaatggtagccagttgtatagcttaatatctcagcacaaggtgcatatgggcgatattcacaataagatcaaccgtaataataaagctctgcgtgcgggtattgcaggttctaacgccgcagcaggtttaccacaggtttatctccctggtaaatcaatggttgcagcatcagcggggactttcaaaggtcaatctgcattggctgtgggttactcaagagcatcagataacggcaagctgatccttaaattacaaggtaatgcaaatactagtggtgaaatgggcggctctgtgggggtaggttatcagtggtagatatgataggagcttataacaaattgaccctatcccaaattctgtgtaaacacccatttcaacttaacggtgatcgtctaggcgatcaccaaaatcaatcataaatcgattcattgccagtttccagttctgaatcggcattgtccatttttttgatgcatctttacaagcgggtattttgcctgccatataaaatacctgtgtctgaatgtattatctcagaaacagttatttacacaaattgtgggagaggctcacccatttagcttcatctcactcaatgtataaaagaattgctgaagcatgctttaacctccttacctctccttacggacgtagcttttcggcatagcgtagtaaatcccctatcattgagtttccaagttttattcaaagcactaggtattttttctatatgccttttgtctactatgttatatcgtaagtaattacatccttaattttttttaaagcttgattttctaactgtcttaccctttcagcagaaatattatattgagccgctaactcgtgtaaagtagccttattttcatcaagccaacgagttttaataatattttgactacgttcatctagttgtgctaatgcataagctaattgagcagttgcccttccgctatactcttcatattctaattcatctacaaaatttgaagattcatcttcaagatacatggagggaacataattatcatcgtcatcatcccctacagaggtatcaaagcctatatcctgtccgaccattctagactccatttctttgacatcatctgtagagactcccaattcctctgcgacttttctaatttcctcttcattaaaccatgccaaacgttgcttatttttacgcaaattaaagaatagtttgcgttgagattttgttgtagcaacttttacaatacgccagttttttaaaacatattcatgtatttctgcttttacccaatgtaccgcaaaagaagcaagacgaacaccgatctctgggttaaaacgttttaccgctttcattaagccaatgttcccttcttgaattaaatccgctaacggtaatccataacctaagtaacctctagcgatatacacaacaaaacgcaaatgagacatgattaactgcttagcagcatcaagatcttcatcataataaaagcgctccgctaactccttctcttgctcagctgttaaaactggatattgatttgccattctaatataactatccagcgtcgctccctgaggcactaacatattatttgtgatacaaatatttgaagcattattgtcaatatcaactagctctgcatctttagagtcaataaattctgtatcatccacttcgagttcatcaaactttttcattttcaccccttaatctccatatgtatactatcatagagtattgaatgtatatctaaattaatacttgttccttttagctcttggatgagccaaatcgtaaattctcgccaaatactggaaatcaagatgcgtataaatttgtgttgtcgaaagactactgtgcccaagtagttcttgcaccgctcgtaaatcttgacttgcttctaacatatgcgttgcgaaagagtggcgtaatttatgggggtgaaggtgggtatccaatgcttgcttttgcccccattttttcatcgccaactgaatagagcggtgggaaagtcgcccaccacgctgattaagaaaaacggcgttgtcttttggctgaaactgcccacgtactgcaagccactgttcaattgcatctaatgctttagaaccaatcggcacaatacgttctttgtttcctttaccgagcaatctcacttcacggttaggtaaatccatatcgcctaaatctaacccttgtaattcagacaaacgtagcccagagctgtacatcaattccatcattgccacatctcgtagatcaagcggttcgttactgtctatatttagcaactgcccgatctgttccgcatcaatatttttaggaagatgcttattggctttaggtgattttattcctaaggtggggtttacttttaattccccttgcttcaccaaaaacgccaaaaactgacgtagtgccaccaaccgtaaaccaatactttttgcacttaacccttgtttatggctttgtgacaaaatccaacgtaccgtcgatgcatcaagctcttgccaacgagtaacttctgcttgctgtaacatttcgcaaaccactcctagttggcgttgataattgctgagcgtatgggggcttacttgcttttcaatgcgtaaaaagtcccaatacagttgggtttgatggtaaaggaagttgctcatagacaattaagccaaacctaacttaccaatttttacaccaatattgcccagtgcaactggcccaagatattccgccaagaatttaaacagttcatcaacactgtgaaaaatgcaatgggtttgcacttcattttcgactttacgggtaaattcgtagctgactttgttcgcatcaatgtgagcggtgagatttaaataaaccgtttcaaaatagtggctcattgccccttctaaccctggatcgctgatacgtacgtcccactgattactgaataacacttcgcttttgactgacatttttacctctttgtgtttgcaaatttttgttgaaaaaagactgcttgtacaagcggtctaattgtcttgttttattgtaacaacgaaatatccgccacctgtaagaacaagttacgtaagttgtttagaattgcttgacggttttggcgaagttttggatcttcggcattaaccatcactttatcgaagaagttatccaccacttcacgtaaaccggctaagcggtcaagtgcggtttgatattcgcctttttcaaacagtggagcaagctctgcttgtaatgtaattatttgttctacaagggctttttcttccgtttccactaataaagtacggtcgatttctgatgaaatttcgccttctactttcgctaaaatgttactcacacgtttattcgctgccgccaatgcttctgcactatctaatgtacggaaatgcgacaccgcacgcacacgagcatcgaagtctgccgggcgagttggacggcgagtaagaaccgcttggattacgtccactgcaattccttcatcttgataccacgcacggaaacgaccgagcataaagtccaccacttcttctacaacattgctgttggtgagcttgtcgccaaacaatttcgctgaagttgccactaaatcgctcagatcaagcggtaagtttttctctacaataatgcgtaacgcaccaagtgctgcacggcgtaaagcgaatgggtcggcactgccttttggcgcttgaccgataccaaaaatacctgtgagcgtatcgaatttatccgctaacgcaacagaacttgccaccaacgatttcggcaactcatcgcctgcaaagcgtggcatatattgctcgttcaacgctaccgccacttcttcatcttcgccatcgtaacgggcatagtgcatacccattacgccttgcgtatcggtaaattcaaacaccatattggtcattaaatcacattttgacaacaagccggcacgtttcgccttggtttcatcggcaccaatttgttttgcaatttcgcctgcaagttgttcaatgcgagcggttttgtcacgcaaggtgccaagttgttgttggaacaacactgtttctaaacgtggtaactgatcttccaaacgctgttttaagtcggttttgaagaagaattccgcatcggtcaaacgtggacgcaccactttttcgttcccttcgatgattttgcttggatcttcaggattgatgttcgacacaaagataaagtgcggtagcaatttgccgtctttatcgtaaatcgggaagtatttttggtcgcctttcattgtgtaaaccaatgcttccgcaggcacagcaaggaaacgttcttcaaacttcgccgctaacacgttcggatattccaccaaagaagtcacttcatctaacaagtcttcttcaatatccgccacgccacctaaagcggtcgctttttcctgtgcttttgcaagaattaatgctttacgctcgttgaagtccgcaaccactgagcctttttcttttaacaacgcagggtattgatcggcgtggctgatttggaactcacgctcgcctaagaaacggtgaccacgaatagtcgtgccgcttgcaatacctaaaatttcgccttcaatcagctcatcgcctaacaataagttcacggtgtgaacaggacgcacgaactgctcggttttatcgccccaacgcattgttttcgggataggcaatttcgccaaagcattgctaatcataccgactaacaagtttttggtcggctgaccttcaatcaccgcacggtgaaccagccattcgcctttgtcggtagcaatacgctccgcctgctcaacggtaatgccacagcctttcgcccagccctccgccgctttggtcggcttaccttccgcatcaaacgccgccgacaccgccggcccacgtttttccacttctttgcttggctgactagtcgcaagccccaatactttcaccgctaaacggcgtggtgccgcaaaccattccactttgtcaaagctcaaacccgcttggtttaattccgcttgaacattctccgcaaacgcggttgctaattttttgagtgccttcggtggcaactcttctgtgccgatctcggcgaggaagttttgtgttgtcattttgttattaatctcttatgctaaaaattctttaaataaagaatacttttggaatccactctttattttcttctaacttatacggaccatgaatagaagctctacactccccaatttcaatttctcttgtagatggaaatacaatatttggtaatttatcaagtttcttaaactcatctttttctaataaattaggagagatcgcaatccaatcaatatataccctccattcattttcatcagcatctgttcttgcaatccctattgcaagaatatccatcatttttgaaccttgcccttgtaaacgcttaacagcaattcgatctccttttttgatctttctaaatgagttttgttggcgtattatagagttacctccagaaaaaccctcgggatttggtttataatctttagaatcccaacagtaccaataacctttttcaataaaggaatctaagatttcttcttcaccacccctagtagcaccaactagccaataattcattttatatgctcctaaattatattgaagtataaatctctcacttcattttcacttctgccaaatctcccctaacccctctttgctaaagaggggaattggttcagatgaaaattcaatgtcaaagcccatccaaaataaattttaatttttcagatgaacctataactttcttcgatctgatccccctctttagcaaagaggggttaggggagatttggcagaagctatttccgaagaaattacgctatttttcttccacttttatctcactcaaatactgataaatcgcttccactacaccatcaatatttgtcattacactatgattatcaaacctcatcaccgtaaagccaagcgaatttagctccgcatctcgcaaacgatctttttcttgataatccggctcataatgctgacttccatcaagctcaatcaccaattttgcctttaagcaataaaaatccacaatatagcttaaaaggggcttttgtcgattaaagcgaaatcctaacagctgatctcggtttattctttgccataacttacgctccgcttccgtttgtgtagaacgtaacttttgcgaaagtggttttaaatctctcgaataaggttgcattattattcacttttagcttcaacaaatctctgcttcgctctttcaactctaattcaattcggtacgcagtgagttccgaatttgagacgcattgcgtctcgaattgaaaaaatttgcaaaagatctatgaaattataccgcttgttagttgttaaaaattaaggataacttactttattttcatttaccttaatcaactttttctgaaccaactgatcaataattttaggcaataatttatcagcttcctttttatcaacacctttaagacttgtttgattatagatactattttttaaggtagctaatttaactggcaaactacgtttttgtacttttgatataaatgccttaaattcttgagctacctgaacaatcttctctttttctgcattatttacattcgttacttggctaggcaataacggcaaagcgattttttcttcagtttggttaatcgcttttctaaaacaaattctcggttctcgttggtgttgaataaattggcaaataccatcaaaacctttgtcatttgataaaatatgaaactcaatatttttatcaacgcaggcatctaacttgcctaaataataagtaagatgaaaatctacgttgttttttgaaatatcttttaccgtaattaaggtaatgtttatttcatcattaaatttttcagtcaaacgcaactggttatttaccgagccgataaataaaaaagtgcggtcatattcctgtaaatttaaaccgtctaatgaattcacattttcataatcaataaaagcgtatttcataaatttccttatttctctagctttattgggacgttaagaacaaaaaaagttgagtaagatgcattaaattcaattatgcaatcactgattgcaaaatctctccaactcccccaactctaacaccactctctcatcttccaacaccaaagcaggaataccgatatagccatttgctttggcgtcatcaaacgcagggtggcggtcacgcaatctgagaaatggtttgaaatttgcaccgctttgggtaatatccaccgcttcgtagtcaataccaagacgttgtaattcagcgacaaacggggcggtatcagggcaccagtgggcgaaatataaaattggtttagtcattattacctcattcaaattccccctctttgacaaagagggggtagggggagattttacttacaacccgggaaccctaacgcttcacggcttgcatagtaggcttccgctacgcctttggttaaggtgcggatgcgtaaaatgtagcgttgacgttcggttacagagatcgctttgcgagcgtcaagtaagttaaagctatgtgcggcttttaagatacgctcgtaagctggcaacggtaacggtttttctaatgccaataattcttgcacttctttttcgtattgatcgaaacagtagaataagaaatccgtatttgcatattcaaagttgtaagtagattgttctacttcgttttggtggaatacatcgccgtaagtggttttgccaagtgggccgtccgaccaaacaagatcgtacacactgtccacgccttgaatgtacattgctaaacgctctaagccgtaagtaatttcgccagttaccggtttacactctaaaccacccacttgttggaagtaggtaaattgtgtcacttccataccgtttagccacacttcccaacctaagccccacgcacctagcgttgggttttcccagttgtcttccacaaagcgaatgtcgttttgcgttgggtcgaaacctaacattttcaggctgtctaaatagagttcttgaatgttatccggtgatggtttgattaccacttggaattgatagtagtgttgtaaacggttcgggttttcgccatagcgaccgtcagtcggacggcgtgaaggctgaacgtaagcaaacgccatcggctcagggccaagcgcacgcaaacaagtcatcgggtgagatgtccccgcgccgacttccatatcgaatggttgaaccacggtgcaaccttggtttgcccagtaatcttgtagggctaaaatcataccttggaaagttttcacgttaaatttcgctgtcattgtctttttcctaaaaattcattcaaaaatgttggctattataacgtgtaagcgatgaaattttgggaattttttgaaattagaagaaatatctttactgttacactttatccatgattcacatacgaactattaagaaaataaccctatagtaaggagcattcaaatcaaactagaagaagcatctgcatcgtagcgttgtttgaacatctccacaatatatttatgctgattatttgaagagtcagaaggagctctatagtggtacattaatatttgagtaccttatctgagggttgcaggtgctaaataaatagagggtgagagtggaaaaattctaaacagatctcaccactctttcaaaaagttagctattgaaaagctacgctgattgtgaatttatacaaattccttaataaaacttaacaagttccccacagatcatattcatctgcttgggtaatggttactgaaataatttgacctactttcacttctgcacctgaaaggttatctacatagacaacgccatcaatctctggggcatccgccattgagcgaccaattattccttcttcatcaatttcatctacaatcactgacaaggttctgccaattttctgttgtaaacgatctgccgaaatttgttgttgtaattgcataaagcggtggaagcgttcttctttcacctcttctggaacttgatcttccatttcagttgcaacagcaccatcaacagggctgaatttaaaacaaccgacacgatctaattgtgcttcttttaagaaatccaataacatttggaaatcttcttccgtttctccagggaaaccaacgataaatgttgaacgcagggttaaatctgggcaaatctcacgccactttttaatgcgttctaatgtgcggtcaatagatcctggacgcttcatcgctttaaggatttttggacttgcatgttgcaatggaatatccaaataaggcagaagtttcccttgagccatcaacggaataaggtcatcaacgtgtggatacggataaacataatgcaaacgtacccaaacacccattgaacctagttgttcacagagggtgatcaagttgtttttgattggcataccgttccagaaaaccgttttggtgccttcttcttttttcttatctaaagcgtatgcggaagtgtcctgcgatacaatcaacagctctttgacaccagaatccactaaacgtttcgcttcatctagcacttgtacgattggacgactgtctaaatcaccacgcattgatggaataatacagaatgtacaacggtgatcacaaccttccgaaattttcaggtaagcataatgtttcggggttagcttaatgccttgttttggcacaaggctgacataagggttgtattctggtttaggcacatatttatgaacgtgtttcatcaccgcttcatagctatgtggtcctgtaatttccaagactttagggtgaacttcacgaatttggttctcttttgcccctaagcagcctgtcacaatcactttgccgttagcttctaatgcttcgccaatactttccaaagactcttgcacggcactgtcaataaacccacaagtattgacaatcactaaatccgccccttcgtagctggaaatgatgttataaccatctgaacgaagctcggttaaaatacgttccgaatcgactaaatttttagggcaaccaaggctcacaaagccgatatttggtgctgaactcataaaacaatctcaacaatatagataatcaaataaacaagcctatgcaaagcataggctaaaggaacagaattgtacaaaatttgaagataaatttcgacaacaagcggtttttttatggttaaaatttgcaaatattacgagataaattacctcttgctgttttgattaggcaaaattattcaacattgccaacacaatttcagacgatttttctgcagcaagcggtaagaattcatcaaaagagagatgagattctttgtctgccacatcagaaattgcacgcacaacaacgaaaggcacttggaatgcgtgacacacttgggcgatagaagcggcttccatttccacggcttttacggacgggaaatcattgcgaatacgagcaatcatatcactgccattcacaaacagatcgccactacagattaaaccagatactgcattaaatcctgctttctcggtttctttgatagcaatttgtgcaagttgttcgtttgccataaaggcggctggattagctggcagttgtcctttttcataaccaaaggcggtgacatctacatcgtgatgacgaacttccgttgaaatgacaatatcgcctacgttcaaattagcgtctagacccccagcagatcccgtattaatcaccatttcaggtttagccagttgtaataataatgccgttcccattgcggaggcggttttaccaatacccgattgcaataatgcaacatcagtattattaattttgccttcgtagattttacaacctgcaatttccgttaatttcggctctgccatataacttaataaaatttcgacttcttgtgccattgcacctatgatgccaattttcattttgtgactccttgttgctctttttgtaatttatcgactaaaaagtcgagtacggcgtaggtataatcatcattataaagagtacttttagttaaaatatattcaccattcaataccgccatgggaatgactggcggtgaatagcgttttattaattcataattttgtgagattcttttcggataattttccttttttcttgtttgttcaacggcatccaacgaaatctgattcttatgcaaccatttggctattgcttcatcattggtaataagtcgatcattttgataagagctatcaaataaatacttctcgcttaattcaggttttcccagttctgaaaaaagtgcatttaaacttactgtgatgccatatttattctcactaaaagcggcaacacgttctaaaaccactttatctgagtgtcgagaagcgtattgttttaaataatcatcaccatttaaacagacttcacaaccatactgataaaaataagtaattaacaccttattatctttcggtaataaaatatctaatggttttttataagagtagtagccttttccatcttggaatagaggtgtttttgtaggttcttctgcaaaaagcgaagatataaatagccataagctaataaaatagatccaatttctaaatttcattatgttatccattgaacaaaatcactaaatatcactctaatagtgcggtggtggtgtttcttctgcacgacttgcaacattacttggctgaacactgtgcaatttttcagctaaatgacgcacttggtactgcagtttttctagcataaactgttgggcaatcagagcttgattaagttcctcgattgtatgatcttggaaggcgattttagcttctaactccgccaaagaggtagttatcttattgaaattttctgacatttcaaaatataaaggttgtgttaaaaagaaatacactttaccctatctacctttgttttaacactctatttaatgacttttacaaggaaactttatgtttaaaaacaaactgtctgcattagcaatgatgactgcaacactttttacagcacaagcaacttttgccgaaaccaaagctgatgctaagtttattgatgattcatcttacgcttttggtgtattagtaggaaaggatattgagagagttattagctctcaaaaagagattttttcttataaccaagaacgtgttttagctggtgtgcaagacacattgaaaaaaagcggtaagttaaccgatgaagatttacaaaaacaattaaaagcgttagatgcttatttagttgaacaagaaactaaaatcctagcagaaaaaagtaaagcaaccattgaggctggcgataaattccgtgctgaatatgcaaaaaaatccggcgtgaagaaaactcaatctgggctactctataaaattgagaaagctggctcaggcgaagctccaaaagcgacagatacagtaaaagtacattataaaggtacattaccagatggtactgtgtttgacagctcttacgaccgtggtgagccgattgagtttcaattaaatcaattaattccagcttgggttgaagcaatccctatgttgaaaaaaggtggcaaaatggaaatcgttgctccaccacaactggcatacggcgaccgtcaagcaggaaaaatcccagcgaactccacattaaaatttgaaatcgaattattagattttaaatctacaaaataagtttacttaaacgcattataggggcacaatttgtgcccttatttttaattttatgtagcgacaaagtatgacagcaaaattcaacccgctttctgatgaagatcacgccattttggcttcctactttcccgttgttgatggtattgcagctctctttggtgagcattgcgaaatcgtactgcattcccttgagttcttagaacactctgcgatttatatcgtcaatgggcataacaccgaccgcaaaattggctcgccgattacagatcgggctttatggtcacttcatcatatgcaaaccgacagcgtatccaaaccctatttcacccgtgccaaaggtggggtgttgatgaaatctgtcaccattgctattcgcaacggcaaacaacacgttatcggcttaatttgcattaatatcaatcttgatgtccctgtatcgcaatttttaaatagttttattgccccacaggaaaccgaaggctcagtgaattttgcaagctctgtcgaagacttagtggctcaaaccatcgaaagcaccattgtcgaaataaaaaacgaccgcaacatttccaacagcaataaaaaccgccatattgtcaccgccttatttgaaaaaggtatttttgatattaaagatgcaatcaaccaagttgctgaccgcttagagatctctcgccacacggtttatctctacattcgccagctcaaacaggacggtgaataatgcgatatgtgttggcagtaaaacacggggtgtatggctcacaaggggcgtatctagcctatcaagttgctcaagcacttttagatcaggggcatagaattgaacaaatcttcttttttcaagatggggttagcaatgcaaatcaacttattgatccagccagcgatgaactgaatttggttgaggcttggaaaagcttagcccaatctcaccgcttgtcgttacatctctgtattgcagctgctcaacggcgtggcattgtagagcaaaatctcgctgaaggttttacccttgcaggtcttggtgaatttagccaagcggtatttactgcagatcgattactgactatttaaaatgaaacgttataaacttgctattctctttactcagcccccatttggcacatcaacaagccgagaaggtcttgatgctctattggctgccagtgctttttgcaatgaagatgaaattgccatttgctttctcaatgatggcgtattcaatctagttgctaatcaacagcctgaaatgattttacaaaaagatcacatatccacattcaagctaatcgatctctatgatttaaccgaatgttttgtctgccaacaatcagtagatgagtgtgggctacatcacgcagaatggatactacccgaactccgttttgttagccgaacagcattatttgataccctgcatcaagccgaaaaagtactcacattctaaggacatactatgctctatacgttttccaaagcacaatatgacttatcaacactaaacgctattcttgaacaagttacccctgatgatgctatcgtgttatggcaagatggcgtattacaagcggtaaaatacccacaactttttaccaacaagacagtttttgtgttacaaaatgatatagaggcaagaggattaaccaccacattgccaacaatctcgctggcaatgttggtgcaattgacggagaagtactatccgcaagcatatatttaataatatagttgttactctagtactatcaatgcttctcttctactctcaatctataagttgagaatttgcctaaaacaactttaatttcttcatcagaaaggattgggacatctggtgtcgttgccaagtaccgaaagtagcataaggcacacacggaacgtgatttgttcccgtaacgccaatcatataatgaatagctggaatatctttatttaagatagatactccagtacaggattagtgtaccactacaagcaccgttttcacccattaaagcgtgggcttctcccttatgtagttcaagctgaacattctttagggcttgaactcccacaaaagatttgctgatgttcttcattgagagtaacggcgtattgttattgactgcggtcatctctgcctccattacaataataaaaatggtttacctaggtaacggaaagcatatttgtacaaggttgacagttttcaaagtggatttacattgagatgttaattttgtgaaaggtgttacaaaaaaatcatttattgattattttttcacaaaaagaacctgcccgattttttgaaaaatgtaggaaaatcgggcaggttaaacggaaagatattatacgtttcagtaaagtatctatttgaatttctcactataagccatactgtttacccaagcatgatcgctttcccacgtaaattgccatttacgtacaggaccagccatcacatttaaatagtaattattataaccagcaatagtcgctactggatgatagcctcttggtactttcacaacatctttatcataaaccgccatacattcatctaagcttctatcatcagtataaactcgttgcattgcaaaaccttgtgcatgctcaaaacggtgataataagtttcctcaagataagtttcatttggagaatctttttggtcgtgtttgtggcttggataagaactcgtattgccttcatcagtaaagacttccacaactaataaactatcagcaggctcagtttcaggtaaaatattatgtactaatctttggttattaccgacccctcgtttttctacgcctatctcttgtggcttaattaagcgtaatggtaaatcaccattacttggagcacaacaaacagccagttctaaatcttccgtagcaacaacttttagttggtaatgatgaggaacatataaagcataaggaggaatcttttcaaaaggtgtagatctattcccaatattttcaaaaacttctgttggggtgattacattgcctttccctgcaacaaatactagacagagttcatttgtcccactctctaatgtaatttcttctcctttactcaaaaggtaagcatcaaaacctacatactcccaatttgcgttttctggtgtaatgtgctggatttgtccgtgtttttgactttttgacagtaaatagctcataaatacctcacattaaatattattgacctaagtttgtactataaaaaatatctacacttttttgtattagaaaatgctcatttttctatacggatcacaaaaatgaaatatatttttcattttgatgatttttagcttgaaattttctttttttagaggtagctttgcaccgttattgtctagaattccttctactttatatttcaaaggagcacacatatgagccaatttgttcagaatttcattaatggtacaaaagtagagagtaccagctctcgtttttcgtctgtatttaacccagctacaggggaagaaatcaaaaaagttaagcttagtacagtagcagaagtcaatcaagctattgaagctgcagataaagcatttcctaactggtcgcaacagtccccattaagacgtgcaagaattttatttaaattcaaagagttacttgaagcaaactttgatgaattagctcgtctaattacaacggaacatggcaaaatttactctgatgcaataggggaattaactcgtggtttagaagttgttgagtttgcaacaggtatccctcacttacaaaaaggggaattctcagcaaatgctggacgaggtattgatattcactcaatgcagcagccattaggtgttgtagctggtattacaccatttaacttcccagcaatggtgccgatgtggatgttccctattgctttagcttgtggtaacacttttgtattaaaaccatctgaaaaagatccatctgtatctattcgtttagctgaacttttaaaagaagctggtttgcctgatggggtattcaatgttgttcagggcgataaagaggctgtcgatattttattaactgatcctcgtattcaagcggtcagttttgtaggttcaacccctattgcacaatatatttatgaaaaaggttcagctcacggcaaacgagtacaagctcttggtggagctaaaaaccatgcattaattatgcctgacgccgatattcaaagtacagcaaatacattacttggtgcagcattcggtgcagcaggtgaacgctgtatggcactttctgttgctgttgtggtaggagatgaggcagcagataaacttgttgaagccttagttccaaaagtacaagcattaaaaattggtccaggaattttaccagaaggtcaacaagaaaatgatatggggcctgttatttcaaaagaacatagagcaaaaatcatcagctatattgatcaaggcgtagaacaaggagcgaaactttgcgttgatggtcgtccgtataaagttgcagaccatgaaaatggctactttgtgggaggaaccttattcgacaacgtttcaaccgatatgactatttataaagaagaaatctttggtccagttctttgcgttgtacgtgcgaaagattatgctcacggtatgtctattattaatgggcacatttatggtaacggtagtgctatctttacaagtgatggagatgcagctcgtcaatttacccaagatgtacaagcgggtatggttggcgtaaatattccaattccagtaccgatggcattccactgtttcggtggttggaaagcttctatctttggtccattaaatgtgtatggtagcgatggcgttcgtttctatactcgtatgaaaaccattacaacacgttggccagataatagtgtgagatcacaagctgcctttagtatgccaacactataatctctctcaattctaacactataaaaaaatagcctaacttcaacgttaggttatttttttcccaaaaacatattctctaaatttttagcatcatcaaaagtctataacaaaaaatttacataaaaaacacgatctaattcacaaaattaaaatctagtcgttgcctacataaatactaaatgttatacatacacttagacaatttatttcaaattgttggattttgaaatttatattcacaataaatttcttatgacattgtgcaatatagtggtatttcagagatttcgttattcgctcaacctttaaggagtggcttatgaaaaaagcattattagctgttttatgcagtggtttattactttctcaaacagcatctgccaaaaatattgttattggtgcaccaatggctgcatttgcagataaatggcaaacctatttacaagagtctgtaagagattttgatgcaaaacataatgacgttgaaattaaactcactgatgcaaacggtgaccctgcacgtcaattaaatgatgttgaaaactttatcgatcaaaaagttgatgcattattagttgttccaacagatccacaaattgtgaagagaattgggagattagcgaagaaagcgaatatcccgttaattgttgttaaccgtaaaccaaacgatgaagatatgcaatatgttactagctatgttggttctgatgaaattgaagctggacgtattcaaggtgattacattgtaaatgctttaaatggtaaatctgcagaatctttaatcttaatgggtattcttggtttagatgcaacagctaaacggtcagagggtgtgaaagaaatctttgctagaacaggtaacgttaaagtagtttctgaacaagaaggtaaatgggaaagagacagaggtctcaccattacagaaaacgtacttgccgctaacaaaaaaatcaatgttattgcaagtaacaatgatgagatggcaattggtgcagtacttgcaagccgcaagttaggtattaaagatgaagacatcattattgtaggtgttgatgcaacaccagatgctcttgaatacttaggcagtggcttagacgcaacagtattccaatcagctcaaggacaaggatacgctggagcagaaatcgcttataaaatcgcaaaaggagaagctgttgaaaaatacaactgggttccttttgaattagtgactccagatatgaaagagaaatacagagcaaaatataaataattaaccataaacttattaaagggtggattcaccctttaataagttatctcttttattctcaatctatgaggacaaaacgataaatcatccttaaaaaccaaggagtcaaaaatgaatacaactagctccccttacattttagagatgcgaaatgtatctaaaacgttccccggggtaaaagcgttggacggtatcaatttaaaagtaaaacgtggcacaattcacgcattaatgggggaaaatggagcaggtaaatctaccttgatgaaaatcctgtatggtatctatatttctgatgacggtagtgaattaattttagatgataaaccgttcaaaccatctcgccctattgatgctattcgtagtggactcacaatggttccccaagaaatctctcccgctgcaaatttaactattgctgataacttctatttgggaagagaaattactcaaggaaaattcttattaaaccaaaaagagatggatcgtaaagcagcagaaattctctctgagcttggtattccaatggacgttaccgtcaaaatgtccgaagtttcagttgcaaaagctcaattagttgctattgctactgcggtttctaatgatgccaaaatcatcattatggacgaaccaacaaccgctttaaccgaaatggaagtagaacaactatataaaatcattgatgcggttaaaaaacgtggtatcgccattatctttatctctcataaacttaatgaagttttcaaagtatctgatgaaattaccgttattcgagatggacaatatgtgggtacaaaagccactactgatgtaaccaaagaagaattaatttcaatgatggttggacgggatatgtcagaaatgttccaaagagaacgttttgaattacctgatgaaatcgtccttgaaattaagaattttactcgagcgggtaaatatgaagatatcagtttctctgtccgtaaaggcgaaatctttggtattgcgggtttagttggggctggacgttctgaaattgtagaaagtttgtttggttataaacctgcggatagtggtgaaatttatattcacgggaaaaaagttgagataaacaacccgcttgatgcaatggaacataaaatcggctttgtgactgaagaccgaaaactaacaggcttattcctgaacctaaatattatcgacaatatgattatgcctcaaatgtctccttatttagagcattttctcatttctgttgataaatcccataaaaccgccaatgagcaaaaagataaattaaaaattaaagcacccgatgtagaagtcatcaccaataacttatctggaggaaatcaacaaaaagtgttactcgcccgttggttacttctcgaacctgaaatcctcattctagatgaaccaaccaaaggtattgatgttggagctaagacagaactttataagttaatggtagaactctcaaaacaaggtaaaaccatcattatgattacttcggatatgttagagctattatcgatgagcgatcgcgtaatggttatgcacgaaggccataaggttggcattattccacatcaagaactctctcaggaacgagtcctagcatttgcatctggattagtaaaacagtaaagactcaaaccatattatgtataaatagcgaggtatgtactatgtcacaagcaacattaaagaaaataattaatacatatggaatggtgttaattttaattattttatttctcctattatccgtttctatcgaaggctttttctctgcccgtaccgtgtggagtattattgagcaagtatcaatgttcggtattattgctattggggtaacgtttgccattatcaccacagggatcgacttatcctctggatctgttgtcgcactaacctccgtagttgcagcctcaatggtaacagggggagatttagctagttctgccattttagcctttgcaatgtcccttgctctaggtgcttttttaggtgcaataaatggtgggttaactgctctcggtggtattccgcctttcattgcaaccttaggtatgatgattattgcacgtggtgctgcacagctttattctgctggacgccctatcgatgcttcatctgaagcctttacttggattgccgatgtaaacattctgagcttacctggattagttattctctatattctcattgttattggctcacatattttactaagccgctcaacctttggccgtcacgtttatgctgtgggtggtaatctcaacgcagcaaaaatctgtggaatcaatacaacaaaaacattaattcttgtttatacctttgcgggggctttatctggtcttgctggtgcattacttgcagctcgtacctatgcaggtaacccatcttatggcttagcgtgggaacttgatgctatcgctgcggcagtaattggtggtgtttcgttaagcggtggctttggaaccattccaatgtgtgttatcggagctttaattatcggcacaaccaataaaggattaaatatgttaggcgttgacccttattggcaacaaattgtgaaaggtggaattatcgtgattgccgtattgctcgatacattaaaacgccgcagaaaagccgcatagtcgcataaatatacagattacaagcggcaagatatctctaaaagtttgcaacattttctgtatatcataccgcttacaacttaaggagctttgtatgaaaaaagtgagaattggtttagtaggtacaggctatatcggtcgctgtcacgcgattgcttatgcacaagcaccaacactattcccattaaaaggtgaactacaccttgagtatcttgccgaaattaatcaagaacttgcagagaaaaaagcgaaagaatttggctttgctcgagcaacaggagattggagagaactggttgcagatccgaatgttgatgttgtagatatttgtaccccaaatttcttacataaagaaatcgctttggttgccattgctaatggcaaacatgtttattcagaaaaaccgctcgcattaactgcagcagatgcaaaagagatggttgaagcagctaaaaaagcgggcgtaaaaacgctcgttggtttcaattatatgaaaaacccaacatcacagcttgctcgtgaaattatcaaaaatggcgaaattggtgatgtggtgcatttttatggcacacataatgaagactatcttgctagcccaaatacaccgattgactggcactgctatcgaagtaaagcaggattaggtacgttaggcgatctcgcagctcacattgttaatatggctcattatttagtcggtgaagaaattacctcggttgtgggtgatatgcaaaccgttatcacagaacgcccaaatccaaataacctttcagaaaaagtgaaagtagaaaacgaagaccaagcaaccgctatggtgcgtttttccaatggtgtgatgggaacgattgaaagctctcgtatcgcttgcggtcgtaaaatgggcttgacctacgtggtaacaggaacaaaaggcacattgacctacacccaagagagaatggctgaacttaaactttatttacatgatgaagataaatctcgtcaaggatttaaaactattctcgttggaccagaacatcctgactacgccgcattctgcgtaagtgcaggacacggtattggttttaatgatcaaaaaagcgtagaaatccgtgatttagtcaatggtatcgccgcagatgacagaatgtggccagattttgaagaaggatatagagtatccagagttctcgaagccatcgctaaatccgctgaagaaaaacgctgggtagatgtgaaagaaatttaatatgaaatcggaagggtctgcatatcacaatatatgcggaccttatttttatgtatgctaaaaataggagcctactatgactgacactaaacaaaaacgttaccacgcagactggcagtcaatcaaaacccatgaggtacctcaatggtatgaagatgctaaatttggtatttttatccactggggagtttattctgttcctgcattcgctccaccaacttgccaattaggtgaaattgatattgatgagcagtggttctgtaataatccgtacgcagaatggtattttaattccattaacgttcagaaaggaccaacttacgaacatcacattaaaacctatggcaaagatttcacttacgaccaatttattccgcaatggaaagcagaaaaatggcaacctgaaaaatgggcagaactctttgctcaagctggggctaaatacgtcgtgttaacgacaaaacaccacgatggcttctgtttatatccaagtaaatataccgatttcaactgcaccaaagcaggtcctcaacgtgatttaatgggtgaactcactgaacaagttcgagaaaaaggattacgtatgggagcatactactctggtattatcgactggcaatattcttcagcacctatttttacagaaagccaaaatttctctaatgcctgcccaacctacgaatatgccgactttgcttataaacaaatcattgaattgattgaccgctataaacctgatgttctatggaacgatattggttggccaaaagttggggaacatatgcttccacacctttttgctcactactacaattctgttgcagacggcgttgtcgatgatcgttggaataaactttggtgcgactttacgtctaaagagtataaacacggaacagcctctcgtgataaaaaatgggaaatgtgtcgtggtatggggctttcatttggctacaaccaaattgaagatgaaagtcacctgatttctgttaaagatctcgtgtctcttttagtagaaactgtcgctgataacggtaacttattgctcaatattggtccaaaagcggatggaacaattcctgaagaacaagtggagcgtttgcttgctctgggacaatggctaaatatcaacggtgaaggtatctaccattcaagatgtagtaaattcccaacacaaaaaatcggcaatctcaccacctattacaccaaagtaggatctgatctctatctctttattgatggattacaaaacggacaaaataacttaccgctttcagtgtttggtgagcttgaatcactaaataaagctgttaagtttaacgttgagcacaacgaaaaaggcagaacattacatatcgaaaactatcaagaagattggtatatgttaggtttcaaaattgcaaatggagaagcatagtatgtcaaccacatcaggacgttttattgattttatgaacaaccacgttgcaccagttgcaaaacggatggaaaatcaaccacatatttctgcaattcgtgatggttttattgttgtattaccatttttgattgtcggtagttttatcatgattttgcttattccaccttttgatgagaatacgcaaaatgcatttggtaaagcgtggtgggagtttgctcgttgggcaagcgactatggctggcgtttcttccaaatgtcatttaatgctatttcattatttaccgcaggaagtattgcatacaacttggctaaagcttataaacgtgagccactgcctgcagctttcttgtcggtcatggctttcttattggtcgctgcaccagttaaagatggtatgatggacattaaattttttggtggtattggactgttctcctctatcttcattgcaatttataccgtagagttaacacgcttacttgagtatttgcatattcgcgtccgcttaccaaaagaagttccaacagcagttgccgaatctctcaatattgttatcccaattctagctgtattagtgacactctacccatttgccctttatgtagaacacgccacaggaacaaatattccacaattaattatggactttatggctccattaattaaagtgagtgactctcttggtgcaatctgtttattcgtatttgcaacgcacttattatggttcctaggtattaacggatcacttgtattaatgcaactttggacaccattcctattacaaaatatggcggcaaacttagcggcattacaggcaggagaaccacttccattcattattactaactcattctgggacttctacattgtacatggtgcatctggtggtgttattgcattagcaatcctactcgtacgcagccgctctgcacatttacgctcaattggtaaaatcggtttggttccgtctatcttctcaattggtgaaccgattgtatatggtgttccaatggtggttaacccactattctttatcccattaatctttgcaccaatggcaaatgcgatcatcgcttatctcatcttagactttgatctcatccaccgcatctacttaatggcaccttggacaacccctgcacctatcggagcttatttggtatcaggtggtgatgtttgggctcctatcttaagcttgagtttaatcatactcgatattttcatttactatccattcttcaaaatgtatgaaaaaatctgtatagcgaaagaacaaaaccaagatgctgagtcattagaacaagaacgattaatggcagaaagagcaagagctgaagctaaataatctaagctataaataacaagacctagccaagtggctaagtttttttatgtctcaaatactgatttgatactctaaatttaccttaatcaataaaaatgaaagcggtacgattttgcaaaaaatttaccaaatcgtaccgcttgtatcgggagaattaagcgacttcgcttaatttaactggacgattttcttcaagagattttttcgctgccaacgcaattaagacaggttgtaaaccatcgttaccgttgacgagtgttggtttattgtttaccacagaatcaatgaaacatgccatttcatctgcgaaagattgcatatagcgctctaagaagaagtattttggtttttctgcaataacgccagcttcacaagaatatacagcagttgaatccgtatcgttacgagtttgtaccgcacctttagaaccaaagacttctgcacgttggtcgtaaccatataccgctttacggctgttatcaatgactgcaattgcaccatttgctagttttaaggtgatcactgcagtatcaatatcaccagctttaccaatttctggattaactaatacaccgccagccgcaaacacttcaaccacttcactacctgataagtaacgcaccatatcaaaatcgtgaatagtcatatcaaagaacattccacctgatacttttacatattcaattggtggtgcatctgggtcacgagaagtgacacgaatgagatgtggttcaccaatatcaccgttcgcaacacggtttttaattgctttgaagttatggtcaaaacgacggttaaaacctacttggaattttacacctgctttttcaacagcacttaatacttcgtgaatacgtcccacatctgcatcaattggtttttcacagaaaatgtgtttacctgcttgtgcagcttcgattgaaattggtgcatgggtattggttgacgaacaaaccaatacagcatcaatttcaggatcttgtaggatttttttgtaatcatcatagacattcggaatgcccattgattttgcccaagcggttaattcgtcagtgaccttaatatctgaaatcgctttaatttcagcaccttttacatattttgagatactttctgaatgtacacgaccgatacggcctgcaccaataataccaacttttaacatattaaactcctgcgacttcacgaatatatttgcgaccttttaaagcatactcaaatgggttagctaatgctggatcctgttctgcttctacaaccatccaacctttgtagtcgtatttttcaaggatatcgaaaattggtttgaaatcgattacaccatcacccggaacggtaaatgtaccttttttcacaccttctaagaaacttaaatctttggctttgacttctgcaacaacttcatcacgtacgtcttttaagtgaacgtgtacgatacggtgaatatatttttcaagtacagctaacatcgctttttggcagccttctgaatagtaaaggtggccagaatcaaataataagtaaacatcatcattgacgacagacatatagcgatcgacatcctctggagtttgaatgcctgttcccatatggtgatgtaggctgactttcattcctttttcagcagcgagtttggctaattcattataaccctcagctaaacgttgccagtcttcatcattgaaaataggtttttctttaaatactgcttttgttgtaccttgaatactacggctttgctctgagcaaccaatcacttttgcccccattgcgtgtagaaaatcacggtgtttgataaattcttgaatggtttcttctcgtttaccatcaacaaagaatgtgctgaaccatgcattacaaatttgaataccacggacatctaatttatgtttaaggacagcaacatcacgtggatatttgttacctacttcgcagcctgtgtagcctgcaagtgccatttcactcacacattgttcaaatgtgttttctgcaccaagttctggtaaatcatcgtttgtccaaccaataggggcaatacctaattgaatgttttcagctttcatagtgaaatcctcattgagaaataaatagaaagagtgtaagcggtatgatttgcaaaaaattttacaaatcgtaccgcttgtaattaatattttcttgcttttgctaactgttctttagaacgttgatgtgcttgctgaatacgttcactcgttgaaacatcagcaacaccaacgtgccaccaacaaccatagccatgggccattgtttttggtaatactttaatatcaattaacgtagatacggtttgttgttttgcatcagctaaggctttgcgtagttcatcttcggtagtaactttgtaggttttgcacccataagctgcagcacacattgcaaagtcaactggaattaagccaccattaagttggtttgtttcaggattgcggaagcggaactccgtaccatagctacccataccgttaccaacttgtaagttattaatacaaccatttgccatattatcaaacaacacgacattgatttttttgccttcctgaattgaagtaacgagttctgagtgggacattaaaaacgcaccatcgccaactaacacatatacttcacgctctggttgtgcaattttcacaccaacagctgcattgacttcatatcccatacaagaatagccgtattcaagatgatagctgtcttcactcttacttaaccaagtacgttgtaaatcacctggcaaactacctgctgcacctacgataactgcactattatcaatcgtttcatttacaatacctaaaacttggctttgggttaggcaagagttggtgagtttgataaattcagcataaacggcatcatgatcaagattatcattaatttctggtacaaatccgtcagtaaattttacctgacgtaagcgttgtaattcgtcagcaaagtctgctttggcttgtttaatagcatctccccattgcgttttataacctggtggtagcttatcaatcactgcattaatggattgtttcgcatctgcggtcacctgaacaccatctaatttatacgcatcaaaacgagcaatattaatatttaagaaagcgacatctggattttggaaaatccattttgatgatgttgtgaaatcggtataacgtgtaccaatcccgataattaaatcagcttctttagctaaacggttagcagctaaacagccagtttcaccaacaccaccaacatttaactcgtggcttgaaacaattgcacttttacctgcttgtgtttctgcaaatggaataccaaatttttctgccaaatgttgtaatgaacgacacgcttcagaataacgaacaccaccaccacagataataagtggttttttcttagaggtaattaatttaactgcatctgccaacatttcttgtgttggcggcgtacgttcaatgcgatgtactcgtttttgtaagaagcttactgggaagtcataagcttctgcttggacatcttgcggtaatgcgatggttacagctcctgtttcagcaggatcagttaacacccgcattgcattgatacaagcactcattaactgctcaggtcgttgtactctatcccaatacttgctcactgcacggaaagcatcattagtactaatacttaaatcgtgcggttgttcaatttgttgtaacacgggatcaggttggcgagttgcaaatacatctcctggtagtaataatagaggaattcggttagatgtggcagtagccgcagctgtgaccatattggcagcaccagggccgacagaggatgtacaagcaatgatttgttgacgtttatgttgtttggcaaaaccaattgcaaggtgtgccataccttgttcatttcgtccttgatataatctaagactgcctggttcttgctctaaagcttgtccgataccaagtacattgccatgtccaaaaatagcggcaataccgtgaacaaatttaatttctttgccatcaatttcaatatattgattatcaaggaatttcacaagtgcctgtgccactgtgagtttgatagtctgcatactccctcctaggttagagataaaattaaagtagtttctcatattatgaaaaatttatttcattttataatatcaaagcattttagttaatgatgtgatctatctcgcactttttaaactttattccttattggttaaagatttgacattggtcacaaaaataaataaaaaatcaagtttaatttgaaatattcatttcattttgtataatgattgaaaattaagatcttttcaattattttatggaggcattgttatggcatacgttaatcatcaagatcgccctcttgatgtcatctgtcttggacgagttgcggtagatttatatggtcaacaaattggttctcggcttgaagaggaaatgagcttcgcaaaatatttgggtggctcatctgggaatgtggcgtatggctccgctattcaaggattacgttcttctatgttagctcgcgtcggcgacgaacatatggggcgttttttacgtgaagagctcaaaagcgtaggtgttgatactagccatttaattaccgataaagagcgtttaactgggctcgttattcttggtatcaaagataaggaaaccttcccgctgattttctatcgtgagaattgtgccgatatggcgattagtaaggatgatttcagtgaaagttacattgcttcatcacgtattttagcgattacaggtactcatctttctcaccctaaaacacgagaaacagttttaacagccttagaatatgcaggtcgtaatgacgtaaaacgtgcattagatattgattaccgcccggtattatggggtttaacctctttaggtgatggcgaaactcgctatattgattctcaggaagtgactaaatcccttcaagaagtgcttcatcactttgacttaattgtaggaacagaagaagaatttcacattgcaggtggctcaacagataccttaaccgcattgaaaaatgtacgccaatttacccaagctgtattagtttgcaaacgtggtgcattaggttgttctgtatttgaaggtgatattccaaatcatattgatggcggattaaatgtgtatggtgtacgggtagaagtattgaatgttcttggtgctggtgatgcctttatgtcaggtttactcagaggttatgcaaataacgaaggatgggaacaagcctgtcgttatgcgaatgcttgtggtgctttagttgtttctcgccacggctgtgcacctgcaatgcccacaaaacgagaattagatgattatctcagccgtgcagcaagtgtacctcgtcctgatttagatgaaaaattaaatcacttacatcgagtaacgacacgcaaaaaacagtgggatgatctctgtatttttgcttttgatcatcgtaaacaattagtggatatggcagctaaggtaggtgctgatgttaatcgcattccaaaattaaaacagttactgcttaaagcgatggaacaaaccgcacaagcggaaggtttaactcatggaaatgcaggtattcttgcagatacgacatttggtcaagatgctcttaatgaaattacgggaaaaaattattggattgctcgtccaattgaagaaccaagttctcgtccattagaacttgagcacggtgatttaggtagccaattagttacattcccacgagatcatgtgattaaatgtttagcattttaccacccacaagacaatcaagagcttcgtcagcgccaagatcgtaaattaaaagaagtgtatcaagcctgttgccgtactgggcatgaattgttgttagaaattattctaccagcaaccatggatcaagatgaaaatcactataatgaaatggtagaacacttctatcaattggggattaaaccagaatggtggaaattaccaggtatttctgcagaaggctgggctaaattgagtgaaacaatagataaatacgatccagattgccgtggtatcttaattctaggtctggatgcaccaacagaagtatttgaagcggtcttcaaagcgtctaaagattgctcaaaagtgaaaggatttgccgtaggtcgcaccatttttggtgaggcatcagaaaaatggttagcaaatcagttgaatgatcaagagttaattgatgcagttgcgttacgttatcaaactctgattcgttattggaagcaacgctaattttgcatactaaataaacataaaatacccctaatatgacaaatattaggggtatttagcctactgacaaaccatatattagatggattgaatattgtagggtgggttttaacccaccaataaaatcaatatgttacggttatatggtgggtcaagacccaccctacaagctactttgtcaatagcctgaacacccctaatataataaatattaggggtgttttgatttaaaaagcaacaaaatacagtataattgtgcttaatttgataataataatctgaatgaaatgaatgaagaaacccagttaacccattttcaaaatgaagttcgtaaacaatatgactcgttaagcaaaagactcaaacaagttgcacaatatattttagacaatggagatagtgtaatttttgacaccgtttctgaaattgctgaaaaagcacaagtaccgccttcgaccctaatccgttttgcgaatgcttttggcttaagtggatttaacgatataaaacaactctatcgacaaaatttgatggaaggaacaacaagttatactgagcgagttcaactttttcgtcaaatagaacctaaattaaatgaatccaaaggcgatcatacagatgtccttcgcttatttattcaaggaaataatcaagctctcgctcaactagccaatcaaattaccgaagaacaattagaagccgttacaaaaattctagataatgcaaaccgtatttttattgttggtttaaaacgatcttttagtatcgcaagttatctaaattatgccttaagccatttgaattacgacgtatttttaattgatggtttaggtggtatgtttagtgaacaactaaataggattagagaaggtgatgtcgttattgcaatcagtttttcaccctatgcgacagaaacaatatctgtactagacgcaacagctcgcccaggtgtaaaacacatagctattactgatagccaacttagcccactccttacgtttagcgatgtttcttttattattaaagaggctcaaattagtggctttcgttctcaatgtacaacaatgacattagttcaaacgatagctgtttcattagcattaagaaaagcttcatagtaaaagggtgagtagtttagctactcgcccttctaacataacattaaattaatgtttctcttccactctcaatccataagtggaaaattttcctaaaacgactttgatctcttcatcagaaaggactgggacatctggtgtcgttgccaagagtttcagataccattccgctaaaacctcaacttcgtgagcaacccaaagggctttttccagattaacttcagcagcaatcattccgtgatgttgtaataaaatcgctttgctttttgcgataccttgttttacatactccgcaagttgccaagtaccgaaagtagcataaggtacacacggaacgtgatttgttcccgtaacgccgatcatataatgaatagctggaatatctttatttaagatagatacacctgtgcagttgatagcgtggttatgcaccactgcatttaactctggacgagtttggtacacggcaaggtgaaattgccattcacttgacggcagttttcctgcttcaaaattgccttcgttatccacatagacaatatcgtcttctgtcattttttcataaggcatacctgatggggtgatcagcataccgtcttgataacggacactgatgtttcctgccgtgccttggtttaaacccaaacgggtcatttccaaacaggtgtcaataatttttctctctaatgtttgacgattcatactctcctcctaatctgttaaaactggggtaacgccttttttcaagatgatgttaccgtatttggctaattcgcctgtaatcactacggcataagcgatttttgctcggtcgtaaaaggcgaagcgttcaacacgttcaacaagcggtgcttttccgttaatttttgcgattgcggcgagatagcgttcttcaaccgcaagatcaaggctgtcgccatgtaccgcttgcatcattgccagtggacgttcgacatattggtcatattcaaataatggggtgatcgcttcaagtaaggtggcaatttgaataccatctgcacggatcactttatgatgtaattgatgtgcaggaaaatgggcatctgataagacgatctcatcgccgtgtcccatctctgcaagcactttcagcaattcaggggaaagtgcagggtgaatgccttttaacatatattctccttgttttttctctacctcattccccctctttagcaaagaggggttaggggagatttggcagacgaataagcaaagtgagagattaaaaagtccttaatattttactactcgttaccaaataaattattttcttcgttaattactcctgtcaaatctcccccagcccctctttgctaaagaggggagctatattggggaaaatttacgctcctatgattgataaaccctcacatctccactcggctccatccgtttaagcgctggtttcattgcctgttgagcttgttcgatattctcgaatacgcctgcacctgtgagcgtgaacatcgcagcgcctaacacggtggtttcggacatatcgacgacatcaattgggcggttaagcacatcagcacggatttggttccataagccgttttttgaaccgccaccaacacagataatactttctgcattgaactgtccgacttgttgcaatacatcaagtccagcttttaagcggtgagccatatattccaaacctgcatgataaatttcgccccgttgggtgtgcattgatagcccttcgattgagcctgtttgttggctggtaccgtcaaaattgccgactagttttacgccgttcgaacctgctggaacttgtgatccctcgttaatcatcgttggataatagtcagctgtgcctgcaacatcgctaaagaagcgtttaccgagccactccataatacctgagctgacccattgcacgcctgggttgaaatagcctgcttggctgtcaaattcaatggttaagccatctttgacgtattgccattccggtttggcttgttgggtgcgagccattaagatttcccaagtgccagaacttaataccggttggttgtagcctgcgcctgagccgaagatcgcaaactgggtatcgtgtccgcaagagagaacaggaatatccgccgataaaccaagctcttcagcaagtgtaggcagtaatgtgccgattttttcccctgcacttttcatcggtggaaaatggtttgccgttaagcccaacacatctaacacttcgctatcccacgagtcgcttgcaatgttggtcatcattgatgtaccagccattgttctgtcggtgctttgtacacccgttaaacgataagtgagaatggaagaaataaacaagaaactctccgcttgtgcgtaaagttcgggtttatgttgtttcaaccaaagtaatttgaataacgtgttgaagctgtaatgtcccacgccgtttcgttggtagagtttttccacatcgagataatcgccgagcgcttgcataatcggctgagtgcgtgggcatttccacgaaataatcgggtagagttgtttgccgtgtttgtcaaaaatcgccccgtccaccccaaaggtcgtaaccgaaatcccgacaatatcttgccgttgttcaggggtaagttgtgcaagggtttgtttggcacaggtcatcagttttgaccagatctcatcaatatcccaaatgtgatagtcggttgcttcttcaccttgttgggtattgtttgcaatgtgatgtaccgccagtaatttgccgtgatgatccattgccactatgcgtaaattggttgcaccacaatcgaagataaatgcgattggcatagagcctccttttatcttattcccccctttgaaaaagggggctaggggggattttaaatagtgcaatttaacgcaccgatctttaaatcccccttaatccccctttttcaaagggggaaattttgttagaaaaggtttaattaacgataaagcggtccaaaattcgcacaagcacggtaatcttgaccttctttatcttgtccgaacatactccacgcacttgggcggaacacatctttatctgccacgttgtgcatattgactggaatacgcaacattgaagcaagggtaattaaatccgcaccaacgtgtccgtaagtggctacacagtggttagctccccagtttgccattacagagtaaacatcggtgaatgcaccttgtcctgtcaagcgtggtacaaaccaagtggttggccaagtttcgttggttcgtttgttgagaatgtcgtggacgtgttcaggtaagtcgatagaccaaccttccgcaatttgtaatacagggccgacacctttcacgagattgatgcggtgcatcgtaaacggcattccgcctttggtgagatattgtgaagataaaccgccgccacggaagtattcataaaccgctggacaccaacgggtattttctaagcagcgtttaccatcttcttctgtcacttcccagtacggtttaatcacaggtttgccgtctttatcggtatgttgtcctgtaccgtctaatgcggctgaacctgagttgattaagtggataaagccactttctggtcgccagcctgttacacgttctacggagtcttggctccagtaagtacgcacatcggcaaagatttgagcttgaccagttaagaggttaccgaacaacatattaactgcattgagcgagtcattttcggtcgcaagaatatatggaggacgcacgccgttccagtcataagttgagttgagtaaggcttccataaagtcgccgttcgggctgtggtctgtccaatggcgttgtccttggaaaccggcggcgatcgcattgtgtcctaaggcttcttcaccaaaattgagttcagccagttttggattacccaccattaaatcacgggtgataatggtcattttcaccaaagtttcacgtaattttgctttttcttcagcattcatttggttttcaggcgcattgacatcaaccccttcaatgcagaattcatttgcccatttcaatgccaactcatactcttctttgtcataaatgccacgttccatacggcgagtgagttcagacatatcgacatattcgttacgcatacccaagtagtcttggaagaactcttgattaacgatagagcctgcaatccccatcgatacagaaccgatagagagataagatttaccgcgtaaggtcgccaccgctaagcctgcacgagcaaagcgaagtaatttttcacgcacatcatcagggatagattgatcgctcgcttcttgcacttcagtgccgtagatagagaatgctggcaagcccatttggttgtgcccagcaagcgaagcagctaaataaactgcccccggacgttcagtaccattaaagccccaaatcgcttttggcatatgcggatccatatcaatggtttcagagccatagcaccagcaaggtgtcacagtaatcactgcacccacattttcacgtttaaatttttcggcacaagcagctgcttcaaatacaccaccgatacaagtatcggcaatcacacattcgacaaaatccccatttgtatggcgaacttcttggctaatgagcttcgccaccgctttcgccatattcattgtttgatcttctaatgattcacgcaccccaagacggcgaccatcaatggttgggcggataccaatttttactggagttgatttgagttgagtcataaaaatccccttaattaactggttaaactgacgaggatattttgctacttattgacgatgaaaaaagaatttttacgaaatttgtgcagattttgtgaattgcctcacaaaaagccagccctaagcggtaagattgagtaattttttttacaatttacttgcccgatttggcgatagaaaggggaaaatcgggcatcttttcaacataaaataaatataataatatgcgtactaatttcgttttaaaccgaaattggtatcaaatattgataaatctatttgataggttttattttcatcttaacaggagttttttatgagtaatttgaaagtaggagttttatgctttactgtattaacattagttggatgtgctactgaaggttcaagagtaattacaccaacatcaactcaggcagcaataactgcaagtcaatataaaggcgtaaaatcagttatttccgtgggaaaatttgataataaatcaagtttccagaatggtgttttctctgatggggcagatcaattaggtaatcaatcaaaaacgattttaatttctcacttacaacaaactggtcgtttttcagttgttgatcgcacaaatatgagtgaaattgcttctgaagcaaaaatcaaaggtaaaaaacaaaatctaaaaggtgcaacttatgtgattactggcgatgttacagaatttggacgtaaaaccgtaggcgatcatcaactatttggaattctaggtagaggaaaagaacaagtagcctatgcaaaagttaccttaaacgtcgttaacgtagaaacatcggaagttgtttactcctcacaaggtgctggtgaatataatttatcaaaccgtgaagtgctaggttttggtggaactgcaagctatgatgcaacactaaatggaaaagttcttgatcttgcaattcgtgaagctgtaaataaccttgtaaatggtatcgaatctggctcttggcagccatctcactaaggaatcaatatgaaaaaaataaaatatactattttccttgttagctctatcattttatctgcttgttcttctaataatgtaaataaagatatttactattggggaaattattctgatgttatatatcattattataatgaacctggtgattttggtaagcaagaagaaagtttaaatcaaattattgctgaagcagctaaacatcaaaaaactgttgcacccggtgtatatgggcatttagctcttgttttattaaaacagggaaaacaagctgaagctcaaacagctatgaaaaaagagcaggaattacatcctgaaagtacaacgcttatgcaatacctacaacgtaaaaaatagggatcatctatgaaaaaattgtttgttttattaacaagtttaatattattagctggctgtgctaaacaaaaagtggattcttatgattatactgagttaaaaaatagcaaaccaaaatcaattttggtagtgatgccaacaaatagctctgtagatgcaaaggcggatacgagtgttcttgctagaacaagctatcctttaggtgaactaggttactatgtttttccagtcgcattagttgatgaaatattcaaacagaatggtttaactgatggaaatgcaatccgctcagcaaaaacaaacaaaatccgtgaaatttttggtgcagatgcgatcttctatgtgaatgttgaggaatatggtacgagctataaattaattgatagcgtaactaacgtatccttagaaggaaaactagttgatctcaaaacaggaaaaaccttatgggaaggggctggttctttcgcacagggatcatcaaatagtaatgatggtctgctagtgatgctagttaaagcagctgtgagtcaaataatggataccagtaaagataaagggtatcaaatagcagcacctgcaacatcaaatcttgttcacttagggaaaaacggtggtttgcttattggaccaaaacatcctgattacaacaagactcaagtaagtaaatagcagacttaaaacaaaattgccttgtttctaaacccagatttatgattagcggaataaagaagcagggcaaaatttgatcattacattattattttactttaaatagttatattaatttgatgttgcctacaaagcatctgaatagaatcaggagggcaacgattcgtaaataaatggtgaattgtagaaagatcacaaagctgaataagatctttacgttcaaactttgaatgatccgctaataaaaatactttcttactcgctgctagcatttttcgtttagctattgcattcatttcattagattcccacacaataccgtctgcaatactggtgcaagaacaaatggcaatatctatatttaaacgagaaagtagatgctccgaaagagatccataaaatgcatcatatttcgctgaatacacaccacctgttgcaatgatctcaatgctggttttatttgccaatgctctaatattgtgcatagaacttgtgacaactgtacaaggtagatcaggtaagagttgtgcaaaattccagctacttgaactcgcatctaaacctatcacagctccaacaaaaaaatgctctaatgcattttctgcaatagactttttcacgttactattcattctgcgacgaacatcaaaagaacgacctatatcacgatttttatggcttaccgcaccgccgtgagttctatacaatagaccttcctttgccattttattcagatcacggcgaatagtttccaaagaaacgttgagatgtgttgcaagctcctgcacgctcgcttcttgataggtttcaatgtaagttaaaattaattgctgacgatgttgcataaagtttatccataaacaactgaactgcacaaattttagggatttttttctaaaagagaagctaatccattaaaaactgtgagttgtgtcacattataaatagaatagatattgttcaaaaaaagggaaaagtaattcatttcatctgtggataactctcttttttcctgtatttatcttgagatctattcttgaataacttatcaaaaaatatcatctgtggataacttaccactttatccacaactaagatcttgctctttttcaagatcatcacaatcgttttatctttagatcttattgaatttattacatatttcttagttattcacagttcttcgtaagactaataactacaataataaagatcttaatataaatagatctatttttattaagatcggcgataatcttcaagatctataccactttagatcaaaaccttttttcagatcttgcttttttcaggtagaatagacaaattttcatttaaacagaatttaatcaaggcaaataagatgatttatcgtgaaatatacgatgtgatcgtagttggtggaggacacgcaggtactgaagctgcacttgctcctgcgcgtatgggtttaaaaaccttacttttaacacacaatgtagataccttaggacaaatgtcttgtaacccagcgattggtgggatcggcaaaggacatttagtcaaagaaattgatgcgatgggcggtttaatggcaacggcaacggataaagcagggatccaattccgcaccttaaacagttcaaaaggccctgctgttcgagccactcgtgcgcaagcagatcgtgtactttaccgccaagcggtgcgtactgcattagaaaatcaaccgaatttggatattttccaacaagaagtagtcgatattctagttgagaataaccgtgcagtcggtgcggtaaccaaaatgggcttagcctttaaagcgaaagcggtcattttaacggcaggtactttcttggcgggtaagatccatatcggtttagataactacgcaggcgggcgagcgggagatccagcagcaaccatgttggctgatcgtttgcgcgatctcaatttgcgtgtagatcgtttaaaaacaggcacaccaccacgtttagatgctcgcacgatcaattttgatgtattggcaaaacagcacggggacgaggttttacctgtaatgtcatttatgggatccgttgagcaacaccctcgccaaattccgtgttacatcacacacactaacgaacaaactcacgatttgatccgtaatagtttagatcgtagcccgatgtacacggggattattgaagggatcgggcctcgttattgcccgtcaattgaagataaagtaatgcgttttagcgatcgcaacagccatcagatctacctcgaaccagaaggtttaaccaccattgaggtttacccgaacgggatttcaaccagtttgccgtttgatgtgcaaatggggatcgtcaattcaatgaaaggcttggaaaacacccgtattatcaaaccaggttatgccattgagtacgactatttcgacccacgagatctaaaaccaacccttgaaaccaaagcgattgacggcttattctttgccggacaaattaacggcacaaccggctatgaagaagcggcggcgcaaggtttattggctggaattaacgctggtttacaagtacaaggcaaagatgcgtggttcccgacccgtgatttagcttacacgggtgtattggtggacgatctctgcaccttaggcaccaaagagccgtatcgagtattcacttcccgtgcggaataccgcttgttgttgcgtgaagacaatgccgatgcccgtttaacaccgattgcccatcagtttggtttaattgatgaagcacgttgggctcgttttaacgagaagatggaaaacatcgaaaaagagaaagcacgcttgaaacagacgtgggcgcacttacaaatggcgaaccttgcggaagtgaatgcgttattaaatagcccacttgcccgtgaagcaagcggtgaagatttaattcgccgtcctgaagtgacttacgaagccttaactcaaattgccccttttgcaccagcgattgaagataaagaagcggccgagcaagtcgaaatttcgattaaatatcaaggctatatcgaacatcaacaacaagagatcgaacgccacaaacgccacgaaaacacccaaattccagctgaatttgattacgacaaagtggaaagcttatctaacgaagtgcgtgcgaagctgatgcaacatcgtccagtctctatcggacaagccagccgtatttcaggcattactccagcggcgatttccattttattggtgaatttgaaaaagcaaggaatgttgaaaagaggtgagttgtaaaatttgccaatcatttcaataaattaatcgtagggacacactgcgtgtgtccacaaggggttaataaaatctaaaatgtgtatgtgtaaaacattgatagcggacacacgcagtgtgtccctacatattgaattaaatgtttcgtggacattatacaattcaaccttgttgtaggggctaatcacattagcccctaataaataccgaataaatttaattaggcaaatatcatttgctccacaggaaattgaatgaaagaaaaagcattgccggaagggtggaataaaataaatataactaaagtatttacccaaatatcaacaacaggtaaaaatatcgcaaccaaagattgtttatctgttggtaaataccctgttattgatcaaggtgctgaatatatttcaggatattttaacgatgaaactaaagttattcctgttgaaaataagataattgtttttggtgatcatacaagaaatttcaaattaattgattttgattttattgttggtgctgatggtgtaaaaatttttcaacctgcaaaagatatagatcctgatttttttattatcagtgtttgtcattaaatttgcctaataaaggttatcatcgccattttcgttatttgaaagagtgtgattttatttatccttctatctcccaacaacaaaaactcgcccaaaaattaaccgcacttttacctcaagtggcagaaatcaaacaacggcttgagaaaatccctgctttactgaaaacttaccgccaatcagtgttggctagggcggttaatggagaattatcggcgaaatggcgggaagaaaatggggtaagtttggatagttggaataaagctaaaattaacaatttaggctcaattttcagtggaaaaactccaagtaagaaaaatcccagctattgggaaaatggtactgtatattgggtttctgcaaaagatatgaaatttgatgaaattacattttcgtcagatctaattactgaaaaagcagtaaatgaaacaaaattaaaaatttgtcctacggatacaattttaatggttatgcgtagtggtattattgcacatacatttcctgttgcattaacaaaagttgaagtaacaataaatcaggatttaaaagccctaagacctaaaaaagattttgttcaacccaaatttattttttatttattaaaagggaatgaacaaaaaattttggaaaaatgctcaaaggcaggaacaacagttgctagtatcgaaatgccagaatttgaaaagtttgtatttgatattccttcactagaagaacaaaactacatcacccaagcggtcgaaaaacacttaaactttgccaatcagcttgaagcccaagtcaatgcagctttggaacgggtaaatttaatgacacaagctattttggcgaaaggatttcgtggggagttgttataattgccaaaattttgccaataattttaaataaaaaccgaggagcgaataatggaaaccaacttctcttttcttcaagcctttccaaccttattcaaacaggttcaatttgcagagcgttatttttctgaagatccgaatacgtcaatgtataaactccgccagtttggcgagttcttagccaagcaaattgccgtacgttttcgtttggcactgcctgaaaatatcacgcaaaatgatcgtttaaaagcattgaaagaatgtcgccttgatcgtgagattttgtcaatgtttcattttctcaaaaacgcaggtaatgaagcggttcacgaagggattgaagatagtcaaaaagcaattacggcaatgattgcagcttggcagctttctatttggtttgttcgtacctttggcgataatatggcaaattttgagcctgtaccgttttgtccggattatttacaagcggtaagaaacaatgaaaatcttgcaaaatacactgaaaatccgaccgcttcgcaacaggaagaacagcaattagtcgaagctaatcaagcagaaattcaagccatttccaccgcactttcaaaccaaagcgaagaagaaaaacaagcctttgatgtggcgcgcgaaaaacgtgcagcacaagcctttgagcgtttgaagaattatgaattacgtttgttggacgaaaaacaaactcgccttttgatgattgaccctatgttgcgagaagccggctgggaagccgatagtgaaaatttggattatcgaaaaggtgttcgccctgaaaaaggacgttatcttgccattgctgaatatccggtggggaaagatcgtgcagattatgtgcttttttgtgggttagtgcctgtagccattgtggaagcaaaaaaggcgaatgtgaatgttgccagtaaagttgcacaagcagagcgttatgcgaaacagtttgagatcacagaaaatttaaccgcaccttgggtgttggcgaaacggactgtcgcttgggcttcagatgaaagtgccaatgatggcttgcatttttatgtaccctttgtgtattcctgtaatggtaaaccttatcttaagcaacagctagaactgtcggggacatggtttagagatgttcgtcagccgtctaatcttaagcgtgcgttacaacaatttcatacaccagatgtattattggaaatgttaaaaaaagatgaagaacaagcaacgcaaaaactcgaaaatgaaccctttgatttcttggggctacgaccttatcaagagaaagctatccaagcagtagagcagaacttgagtgagggtaaacgagaaatgttgctggcaatggcaacgggaacagggaaaactcggacaattacaggattaattcaccgctttttaaaaacggatcgttttcgccgaattctttttttggtggatagaaccgcactggcggagcaagcggaagatacctttggtgggatgaacgtggaacccaaccaaaccttaaatacgttgtataactttgcggtgaatggtgtggttgaacctgaaacgaaagtgaaggtggcgacggtacaatctttggtaaaacagattttttattcgggcgaagcaccggcaattgatcaatttgactgtattattgtggacgaagcccatcgtggctatacgcttgatcaagaaatgacagatggtgagttagaatttcaagataatgagcaatatttatccacgtatcgccgagtgttagattattttgatgcagtaaaaattggtttgacggcaacccctgctctacacaccaaagaaatttttggtgagcctgtttttgtctattcttacaaagaagcggtgattgatgattatttggtcgatcacgagcctccgatagagattaagacgaaacttaatcaagatggtattcattttgagcgtggcgagcagttagaatttatcgacaccggtacaggtgaagtggtattaagtgaacttgccgatgagcaaaattttgatgtagagagttttaatcgcacggtattaaatgacagttttaatcaagtggtttgtgaaggtttactggattatcttgatccttttggcggcgaaaaaaccttgattttctgtgcgacagatctacacgctgataagattaaaggcatattagataccttattcaaacaaaaatatggtgatgagtataataccaatgccgtggcgaaaattacggggcaagcggataaacctaatacgcttatcaaatattttaaaaacgaacgttacccgaatatcgccattacggtggatttgctttctacggggattgatgtaccggagatttgcaatttagtctttttacgccgtgtaaaatctcgtgtgctttatgaacagatgaaaggtcgagcgacacgtaaatgtgaagcattagggaaaacagtgttccatatttacgatgcggtgggtttatgccgagcaatggcaagtgtggataccatgaaaccgatagtgaagaacgttcatcaacccatttcgcaattagtggaagaattacaagcggtaggaaaaattgaaaataatgcaaacccactagccaatgaacatcagcaggcattacttgaacaaattagccaaaaaattatgcgattgctgcgtaaagcggacaaaatggcagaaaaaagcccacagatgaaggaaaatctcgctattcttgaacaggaatggggtgtaaaacctaatttgttgcataaacatttacttaagattggcgttcaaggggcggtacaatttttcgaaaaacatcgcaatatcttaaccgaatttaaccgcttgcaagctatgttaccaagcgaacgaatgctggtgatttctacgcacgaagatgaagtgcgagaaattaccccaatctacggaaagggcgaaagtgcggacgattatttgcaagaatttatggcctatattcaacagcatagtaacgacagtgttgcgatacaggtaattattaaccgccctcgcaatcttactcgtcagcagcttaaagatattgagcttgctttagatgcacaggggtttagtaaagcgaaactgaataaagcaatggggcaaaaaacgaaccgtcaaattaccgccggtattgtggcgcatatccgccgtgcggcgattggcgacagtcttgttccttttgaacagcgtgttgatcatgcgattgaaaaattgtgccaaacacattcatttaaacccaaccaacaaaaatggttagaacggatcgcaaaacagcttaaacaaaatcacgatgaaattttagatcgtagtcgtttaaccgagctattccaagggcaatttagtggtattcgagccgaatttggtgaaacattagatgagttattggcagagttaaatgaggggctgtgggagaaaatggggtaagtttgaattgttaagaaaaatttaatctaagcagtcgaaaaatacctaaattttgtaaatcagcttgaagctcaagttaatgccgctttggaacgggtaaatttaatgacataagccattttggataaaggatgtcagggatagttgtaaaaatcgtgcaaaaaattggatttatggtacactttagttaatttaacttccaaaaggtggaaattatatgctgtttacctatctttttatcgataatatctataatttctcaaatgcagtgattgattttacgttaaaacgtaaaatcttacacagtgctattgatggagaatttcttgatgaacgccctaattttcgttttaagcgggtttgtattctttctggggctaatgcgagtggtaaaacatcactcggtaaaataatgcgttatattcagcattttattttgttcccaaatagtaatttattaaaacaaatcaatgataaagagaaaaatgggttgataaaagtagaatttgttctacctgaaaataatactattcattatttagaaattgtacagtcaatagcaagaaaatcagaatatcctttaattaaatatgcttcaattcctattttggataaagatactagcacatcagcaagaaagcgtttgatggaattttttgctaaaaaaggaaattcaaatattaagaatggcaattattatgaaactgaagataataatcctatttttttatttgacaatattcgtcaaaagatagcagaaaatttatgtttttattatatgttttctgataatacagataaaagtcaattatctattcaagatggacatttaaatgcgggtattttagaaaccgtacttaaaacgtttgatccctcaattgtttcagttaatgaattacgtaatcaagatgaacttgaaggatatagtattcgttttagtaataaggatagtgtattgattgataaaaatggtgatattcccaataaagatcgtttatcaaaagggacgtttgatgcaattcaagttgctgattttatcgcttttatattacagaatgcagaacaaaataaatcattgaaatctgtttgtgcaatctattttcttgatgaaaaaatggcatatagtcattctgaaattgaacaagcgattgtgaatttaatttcacaaaaaatgatgcgttatgctcaatttatttatacaacgcataattacgatgttttagatttgaatctaccaatacattcatttgttttcttacataagactggcgataaagcagagtttattcaaccagaacaaaaatttaagaaaaatgatcgttcattgcttaattatgttcaaaataatgtattttatactattcctgatacgtcattattagatgaattgttatagggtcttgcggatgaaaaagagaacaacgatccaatttttagtagaaggtcaaacagaacgagaatttattaaagctttaaatttgttaggtaaagtgcagcttattaatttatgggataaggatatttcttctatcttagcgagattaagagctgatgaaatttatattatttatgatacagatgttattcataatatagaacgttttactcgaaatctccgtgttctaaaacaacaaaaaataaagttctttttattacagcaaactaaaaatcttgaagatgagatagttcgttgttctaattgccaaacaattaaagatgtttttggtacgggaataaaagaatttaaagaacaatttttagcgtgcaataaccttgaatataaattagccgaaataggcattaaacatcttgatttatggcaaggtaaacaccttgaacaactttctgaatggaaaaatttaagaagaaaattttctgatttagcctcttcaaaataaggttgattatgacaaataacgaaatagtccaaaaactttggaatttgtgtgatgtgctacgtgatgatggcattaactacaacgactatttaaccgaattggtgatgttgctgtttattaaaatggtgcacgaaaaagagcaattatttattgaagagaaaacagaatttaaaccattattacccgaaggctgccgttgggaagatttaagcggtaaatcaggtatcaatcttttagataactatcgccgtatgttgcttgtgctttcaacgggtaaagaaaatgatgagatcgttcataataacccgttattgttagcgatttatgccaatgcaaaaacctcattaacgcaaccaaagcatttagagcaattagtgcgtaactttgatgaaatggattggttctcggcgcaaaaagatggtttgggcgatttatatgagggattgcttgaaaagaatgccactgaaacgaaatcaggtgcagggcaatattttacgccacgtgcattgattaattcgatggtgcgttgtattaaccccgtggttggagaggtaattcaagatcctgccgctggaacagccggctttttgattgctgccgaccaatatatgagcaacaaaaccgatgattattttgatttaagcgaacaagatcgtcattttcaaattcacgaagcctttaaaggggtggagttagtgaccaatactcgtcgccttgcgttaatgaactgtttattacacggtattgaaggtggttcagaaggggcggttattcaaggtaacagcttaggtgatgtaggcaaaaatttaaaacctgctgatattatccttgcgaatccgccatttggcaccagtaaaggcggtgatgcggcgataacccgtgatgatttaacctttgaaacgactaataaacagctggctttcttgcagcatatctatcgtaatttaaaagaaggtggacgcgcggcggtagtgttgccggataatgttttgtttgaagccggtaaagggacggatattcgcaaagatttaatggataaatgtcatttgcatacgattttgcgtttaccaacggggattttttatgctcagggtgtgaaaactaatgtgctgttttttgacaaagtcagtaacgatgcggaaaattcaactcaaaaaacgtgggtttatgatttacgtacaaatatgccgagctttggtaaacgtactccgtttacggaaaaataccttgaagcctttgaaaaggtatttaatccgaccgagcttgatgtcaataaggcgaatataatgacgattttgagtgctcgccaagaaggggagtggagctataccgaaggggaacaaacagcggaaaatagccgttggaaatgttttgatcgtacttatattcgtgatgtaaaaggcgatagtttagatattagctggcttaaagataatgctgctgttagcagtgaagatttgcctgagccagaagagctgattgcggaagcaaaagccgaattggaagcagcccttgcagggttagatgaactattcgcagaattaaccacaaaataggataaacaaaatgttagccaaattagaccgcttgctccgtcaagcaaacattcctttgaccgatcagcaaaaacagcagttggttgatttcgtgaaattattggataaatggaacaaggcgtataacctcacttctgtgcgtaatcctgatgaaatgttggttaagcatattatggatagccttgtagtaagccaacatttacaagggcaacagtttattgatgtgggaacaggtccggggttaccgggtattccgctggcgatagctaatcccgacaaacagtttgtgttgttagacagcttaggcaaacgtattacctttatcaaaaatgctattcgagagctaaaactgactaatgtaacgcctgtgttaagtcgggttgaagagtatcaagagcaacaatttgacggcgtattaagccgagcttttgcctctctaaatgatatggttgattggtgctaccatttaccgaatacaagcggtcatttttatgcgttaaaaggacaatatcagccagaagagttggcagaagttagcaaaccgattgagttagtggacgtaattaaattgaacgtacctgagttagtcggagagcgacatttggtggtattgaatagataataataggtacagtggtagtgtaatagacaaaatagtttttaaaaagtagattaattccttgtaatatagtgctaattcaacttttagtaaccattttgtctactatgttttttcttccaacccctatcttcctgccctcgccacaaacgctgaatattatcgtgatggcgatagactaatagacaacaaactaatgcgacagggaatgttaattcagggctaaaccaccaaatataaagtggaacgatcaatgctgtaataactgcacttagcgatgaataaccagaaatcaaaaaaacgaacaaccacgttcccaccgctaatccagcaactgaatagcccattggaatgattgctccaaaggcagttgcaacccctttgccaccttggaacttaaagaaaacggggaaaatatgtccaagacaagctgccaaagcaataaagccaatcaccgaaattggcagttctaaataaaaaccaagagaaacaggtagcataccttttaatatgtccgccattaaaacacctaatgccgataactttccgcctatgcgtaggacgtttgttgcccctgggttatgtgatccgtgttctcgtggatcgggtagtcctgctaatcgacaaaaaatgacggcacttgaaatagaaccaagcaaatatgcccctaaaatcagtaaataagcaataacgctcattttttccccttatttgttgcttactttgtgctatattttaccttaactttcaaaaagaaaaacaaggaaagatccgatgactgataaagtttttattcacgaactcaccgtttttgcatctattggggcttatgagtgggaacataccattaaacaacgtttagttttcaatattgaaatggcgtgggattttagccgagctgtcgcagatgatgatgtacagtactgcttaagttatgcggaagtttcacaaaagatccttgattttgttgaaaatacaccgtttaagttggttgaaaccgttgcttatcgagtggccgaactactgcaacacgagtttggggtgaaatcattacgcattgaattacacaagcctaaagcagttgctcaagcctcaagtgttggtgtaattgttgaacgataaagcgtactattattactaaatgcgatctagatcacagttatcccattgatttctcattataattttcgcccctaatttttagcataaaggagcattctatgtctacaatgatcgatatccaagaacgtttaatcgaacttgttgcagaaaaacaaagccctgttgttcaagcggttgtggagcagttaattcgacaaaacaataaagcatacttttctgcagaacaggtcaccacattttgtcaaacattcaacctatcccctgtcgaacttgctttagaatgcttacctattgcggcttgctacgctagagtgcctgtttctcatttttttgtaggggctgtggcgattggcaaatcagggaatttctattttggggcaaatcaagaatttgagagcgatgcgatgcaacaaactgttcacgcagagcaaagtgccgtttcacacgcttggatcgcaggggaaactgcattaaccgatatggtggtaaactacactccttgcggacactgtcgccaatttatgaatgaactcaatagtgctaaacaactaaaaattcatttaccacatagtcaaaataatttattacacagttacctgccagatgcttttggaccaaaagatttacagattgacaaggttttattcgatcctcaacaaaatggctttgaagcaagtggcgatgcgttacaacaagcggcaatttcggcggcaaatcttgcgtatgcgccttatagtaaagcggtgagtggggtggcattacagtgtggtgaacagattatcacgggacgctatgcagaaaatgcggcattcaatccaagtttcttgccgttacaaagtgctttaaatttccgtcgaatgcaaggtttagaaggtgtgacaatttcaagggttattcttgctgaaaaatatgcggtactcagccatcgagcaatgaccgagagtttggtaaaaaacttacttaacttaccgcttgaatatgtcaaactttaacaataatgttaaaatcatcgcgaatatttcttagcagattttgattgaagctaaagaaatgtaaaataatgtatttatgatgctaaaaaacagagataaaatactacaactttgcaacatttgttcgctatcgtagtcatagtagcagagcaattcaaacaaactgaaggtaatctaatgcaaaatccacaaattcttattgttgaagatgaatctgttacgagaagtacattaaaaagcgtatttgaagcggaaggctatgatgtatttgaagccactgacggcaatgaaatgaacatcatcttagataatcacgaaattaaccttgtgattatggatatcaatttaccaggcaaaaatggcttaatgcttgctcgagaacttagagaaaacaccgatattgcattaatgtttttgactggacgtgataacgaagtggataaaattttagggctagagatcggggctgacgattacattactaagccgttcaatcctcgtgaactcaccattcgtgcaagaaatttactacaacgcacaatggaggaaaaagacaaaatagtcaaagatccacatcataccgaaagttatagctttaatggctggaccttagatgtaaatagtcgcagtttgattaaccctgaaaatgaggtaattaaacttcctcgtagtgagtttagagccttacttcacttctgtgaaaatccagggaaaatccagacacgtgaagatctgttaaaacgaatgacaggacgtgaattgaaacctcacgatcgtaccgttgatgtgacgatccgtcgtatccgtaaacactttgaagatcacccaaataccccagaaattatcgtgactattcacggtgaagggtaccggttctgtggggagttcgtttagttagtaaaaattaaaaatacggtcacacgtctaatatataaacattttaatagttatggaaacttagagagaatgcaataggaatagtcttattgcatttttagcatcatggctagttagtcttacatattattagaccttccttaagatattcttcgtcattattaaatttactccataaatgagtaaaatcgttaaaaatcataaagacttcttttatacccatgaatcattaggtgaaatatttatttgataactgtaatatatctcttttagagattatcatatataaattagttaataagtatattataaataattaagatatttttatggaaaaaatatattcagcccccattaccgtactcggtgccggttcatacggcactgcattggcgattgcactttctcgtaatgggcataaaacatacctttggggacataatccgcagaaaatggctcaaatggctgtacggcgtatgagtgaagaatttctacccgatattccatttccagaggcattagagattgaaagcgatcttgcaacggcattaactcgctcgaaagatattttaattgttgtgcctagccacgttttttctgaagttctacaacaaattcaaccgttattaacttctgaacatcgtattatgtgggcaaccaaagggttagagcgagacacaggaagattgttgcaagaagtggctttgcaaattttaggtgatcgctatccgctagcggtgctttctggaccgacttttgcaaaagagttagctcaaggattaccgactgctattgctctttcttccactgatcctcagtttgccgatgaaatgcaacagcgtattcattgctcaaaagcctttcgggtttatttgaatagtgatatggttggcgtacagctcggtggggcgattaaaaatgtgattgcgattggtacagggatttcagatggaatgggctttggggcaaatgctcgcactgcattaattacacggggattagcagagattagtcgtctagggctgtctttaggggcaaatcccaccacctttataggtatggcagggcttggtgatttggtgctaacctgtaccgacaatcaatctcgcaaccgccgttttggtttaatgcttggacaagggagaaatgctcaagaggcgatggctgaaattgggcaggtcgttgaggggttttataataccaaagaggcctatttactggctcaaaaacaaggcattgagatgccgattgtggaacaaatttatcagatgttgttctgtggcaagcacgccagtgatgttgctaaaacgcttttaggtcgtgaacgaaaaggggaataaagatgacaaaccaaccgcttgatcttatttggcagaatattcgtaatgaagcacaagagcttgcaaatagtgagccgatgcttgccagtttttttcacgcaaccattctgaaacatcatcatttaggcgatgcgttaagctatattttggcaaacaaactggcaaatgcgattatgccagcgattgcattgaaagggatcattgaagaagcctatcaagcaaatccgcaaattattgccagtgctgcctgcgatattgaagctgttcgtactcgagatcctgcggtcgataaatggagtacgcctttgctttatctcaaaggctatcacgctttgcaaagctatagagttacccattatttgtggcaacaagggcgaaaagcgttggctatttatctgcaaaatgagatttctgttgcttttgatgtggatattcaccctgcggctcgtgttggttgtggcattatgttagaccacgccacggggattgtggtgggagaaacggcggtgatcgaaaacgatgtgtctattttgcaaggtgtaacgctaggtggtacaggtaaagaacacggagatcgccacccgaaaattcgtgaaggcgtgatgattggggctggggctaaaattttaggtaatattgagattggtcgttactcaaaaattggggcaaattcggtggtattacaagcggtgcctgaatatgccactgcagctggtgtccctgctcgaattattgggcattctcaacaacaaaaacccgcttttgaaatgaatcaatattttgatgataccaataaagagatcaattgagatagatattaaataatggggctgacctagattagtatgctagctaatctaggtcagccccttaaatttggcatagtagacaaattagcccactttttatcaacacttttgtctactatacctaattataggtgctagattaccacacaaaacctacccctcctccaatcatagtatcccgctgagtattactgctaacagacgctcgaataagccatttgccattatcagaaattttggaataacctatagcataggcagattgcccgcgatattgtgcattagaaacagaaatagcacttttacctggtaaagaaatttgtggcaaattagccatcgccccagcagaagcaatacccgctcttgcattaacaatatctcttgataattgattaaatcctgtattcacagaagaaaccactttgttgagctgacgaacattcacaatatcgccctcagcactaccatctccaacgttggtaattctggcgccattcatatttacaactggatttccttgcttatctttacctaaagatactttcgtatcgccattactaattgaagtaatgtcgcttaaatctccaaacacgctcacattgtaaatattctgaccatttgcccccgtttttgaagtcactttcacatttttacccgcttcaacttcggttcttgcggctgctgttgcggtattaattgctactgcgacttcatctcctgtcgcaaaatggttgcctttatctgctgcactaatggtgcgtttatccttagaggcagtgagtttcgttttagcaaccgccaaatcatacacgatttgctgattatcgccctgacgctctttaatcaccacactgtgatcggtagattccacttcagttttcgcagatttcaactgtttcacattaacagcgtccgtatctgctaccccttcagcgacattacctaataccatcggagtttcatttgccaaattcacttttactgctaatgacttaagcgtaatactgccatctggattttgcgttttggttgagaatttacctttaacattcaccactggaattaacttaatcgaaccatctttagcaggttcttccaaatagaaattaccgcccatattgataattgatttgccgtcttccgttgcatactcgatcggtaaaccgctgacactcacatttcctcgctcacccttaggtccctgaatacccgctgttccctgcggtccttgtggtcccgttggacccgtaggtccttgaataccttgctcacctctaggacccggttcacccttagcccctgctggacccgctggacctgtatctcctttttgacccggttcacccttagcccctgttggacccgcagggccagtttcacctctatcgccttttagacctttttcaccacgatctcctttttcacctttctgaccagtatcacctttgtcacccttaggtccagctgcacctgcaggtcctcgtggtcctgctggacccgtaggtccttgaataccttgtttaccttcaggaccctgttcacccttagcccctgttggacccgcagggccagtttctcctcgctcacccgcagggcctcgctctcccgctggacctgctggaccagcagcccctgctggacccactggaccaatcggacccgcagggccaggttcacctttctctcccctaggacctggagctccattatctccttttggaccttgtggtcctgttgctccagcaggaccagcttcgcctctaggaccagcttcgcctctagggccagtttcacctctatcgccttttagacctttttcaccacgatctcctttttcacctttctgaccagtatcacctttgtcacccttaggtccagctgcacctgcagggcctcgtggtcctgctggacccgcagggccagttgcaccttgttcccccctaggaccctgctcgcctcgctctcccgctggtcctgctggacccactggacctgttggaccagtttcgccttttggtcctggatcacctttctcacccttaggtccagtttcacctgcagggcctcgctcacccttaggtccctgagcacccgctgttccctgtggtcctcgtggccctactggacccgcaggtccagttgcacccgtaggaccttgagggcccactgctcctgctggaccagcaggaccagctgcacctgcagggccagtttctcctcgctcacccctaggccctgctggacccgcaggtccttgaataccttgtttaccttcaggaccctgttcacccttagcccctgttggacccgcaggtcctggatcgcctttatcccccttctgtcccggagtacccggtgttccttgcggtccttgtggtcccactggacccctaggacctgttaaaccagtttcgcctctaggacccgctgggcctcgttcacctcttagaccttgctcacctctaggaccttgagggcccactgctcctgcttcaccacgggcacccttatcgcctttttctcctgcatctccttttggacccgcaggaccaggtgcacctcgctctcccgctgggcctgctggacccatcggacccgcagggccagttgcacctctctcacctgtatcaccttttggacctctatctcctttaggaccccgctcgcctcgctctcccgctgggcctgctggacctatcggaccttgagctcctgtttcacctttcggacccactggacccctagggcctgctggacccgcaggaccaggtgcacccgcaggaccagtttctcctcggtcacccctaggccccattggacccacagggcctcgtggtcctgctggacccgtttgtcctggttcgcctcgctcacccctaggccctgctggacccgcagggccaggtacaccttgtggtccaactgcacctgcagggcctgtttctcctcgctcacccttctgtccctgagcacccgcttttccctgcggtccttgtggacccactggccccctcggacctgttggaccagtttcgccttttggtcctggatcacctttctcacccttaggtccagctacacctgcagggcctcgctcacccctagcacctgctggacccactggacccgcagggcctgtttcacctcttagacctcgctcgccacgatctcctttttcacctttcttgataatgttatgcgaattatctgtatagataatttttagatcgccattttctaggctttcagtcgttttaattaacttaccaatcgtagaaatcgtaatatttccgcccgcttgttctaatttaatattatttccagcggtaaaggttacggtatcgtttattttgataagatgtgccccaggtggagttgcttgaccccccgttcccggagcaattgcaagtttccaaccagcatttgaaaattgcatgtagttcaccgcatcgttattttgtgtaccttgtgctaaattggtgatcttaactggggaagtgccgtttgtacctgttacttttagattaccgtcagtggtgttggtaatcttaggtccattatcgccatattgaacgctgctgaatgttggtgcatctttcatcaacacatggaattctagatttctacgataaatttcaatgttatcgcctttgtatcgaacaccaccgtttaggtatgtttcgtcacttttaatggtaacggtcttatcttcgttggctttccatttttgacccgaaacatcatttgttgtaccgttatctgttttttcgcctttgaatatcaaacttcctgctctggcatcagctaatttatttttaatcgtatcgtctagtgatattgtaatggttgagccagacgcattggtcttgatttcgccatttgtgcctagcactgtaagcgtaccatcccacaaccccacttttggctgtggattagcattggtatcaccaccaattttcatcgtcaaagatttaagctgtgccacgtttaccgcatcggtatcttgtgtaccagccgccacattgacgatttggcgtttgatggttgtaccacccacagaaactgcaccaatattattaccatcaaccttttgtgtggatttaaagccgttagcgtcagtgctttctcccgttgtgacagaatgagcttgttttaaccccactacaccgccagctgtatctgccttagagccataacccaatgccacaccgccacccacggtgacaacggtattatgaccaagtgcggttgctctagcagcatttacatttatcatggcattttcacccacagcaacagagtacgtaccactggcagaggccatataacccaaggcagtagaataatctctagcatttgcttggcgtccaactgccactgatttttgacctgtcacattgatatgggcacccacaacaacagagtctacccctgttgttctcgcaagattacctatcgcaatggaatctgccccagcacctttcgattcactaccaagagcaacagcataagcactagcattactcttataccccatcgcaataccataatttccagccgcagaggcatttacccccgctgttattgcataggttcctgtagctccagctttgtcagtaattgtgccgaaattagtcgtaggatctcccagaccttgagactgttcgttatagttagtatgaaaatacgtttttgagccagtaatggtaatttttgaattgccatttccctgctcaactgccgtactaataccatcagcccctacaattgagagcgtttcgttataaaatgttgtgtgaccctgcgtatttctatcgccactgatctttaaagtcagtgcttttaattgcgccacgtttgctgcgtcagtatctgctgtccctgcagcaacactggtaatttgacgagtgacggtgaggccatcacctactgctaccgctgcatgcgtagcagataatgtacttccgttaatagaataatttgtattatctggtttccaacctgcttgccctgactgacgactagtcttggatcgataacctagagcaacgccatcttgcgtttctgcttccgcataactccccaatgctgttgtaaactgtccgattgctcgtgcctcttcaccgaatgcggaagctcctctttgacttgcagtagcacgtttaccaacagcaatggagtgctttccagcaaatgcaccaccaccaaccgcaataccgtactcattgttagacctacttctcgcaccgatagcaatgccttcagcatgagttgcagatgctaaaggacctacaacaatagatccgtcgccactagccgaagatcgacccccaatagcaacagaggcatcacctctcgcaattgttgtttgggaatagtctcgatcattagcttgatatttcgttgtagctaaatcatctccaccgattgatatggagccatacccctgcgcttgggtatttgccccgatagcaacagattggtgcccacttgcactagcacgtgcgcctattacaattgtttgagtacctgtcacattggcccctgtgcctaagacaatagattgttctccgctcgcttttgactgactcccgatggcaattgtttgattatttgtcgaattggcttgtccgcctaaggcaatagattcatctccgctcgcttttgaatcactcccgatggcaattgtttgactatttgtcgaattggcttctttgcctaaggcaattgctccactcccacttactgtagtgcggtagcctatcgcaagagagtttatttgtgttcctgaatctgctccataacctatcgcaatattatgcctagcttcagcttttgaatactgaccgaaggcaatagcaccatacgaagccttactcccttgaccaataccaatagtaccgtcgtcagttcctatattcgatccctcattagcaccatcttgaagatatgcagctgaacctacggaactaaaaaatatacctagtaatactagacttaaaagacttaatttaaatttatcttgctgtttatctaaaaaataatctgaggtgcatacttgagctcttttatccgtgtaagcggatgttttggtatgagactttactaactcagatacaactacccaagcctgttgagcatgactccaaataactctaaatattttattcataataatcttctctaccgcttttcctaataaagcatcgtaaacctttatttacattttcaggatgcacaaatgcccccatcgccctcgctttcgctcgggcacttcccccgcaagcgggggaagttaactccttgacaaaccatatattagatggcttgaatattgtagggtgggttttaacccaccaataaaatcaatatgttacggctacatggtgggtcaagacccaccctacaagctacttcccccgcaagcgggggaagttaactccttgacaaaccatatattagatggattgaatattgtagggtgggttttaacccaccaataaaatcaatatgttacggctacatggtgggtcaagacccaccctacaagctacttccccctccccaattgttaaaaaaaaaaaaaaaaacaatgcgttgcacaaaactaagaataaaataacaaggatttttcaacttttatcaataaaagctagaaataataggcggaaatctaatgaaagcggtgatttagataaggtatctattaaaactgatacaccaaattcacgaccaaagaaggtcacgtctgcaataatattgagataggtttgttgtaaaggaattaatttagctttgggggatttttcaatataacgttgaatagttctaatggaacagtgatacttttggatattgttcttaaggcaaaaaggacagttttttgttcatatttcaaaaagtgggcttaaagccttgtgttataaggctttagcccactttttaccaacacttttatctactatgccttaaattttatatgctcattgataacataaagagagtacctagtagctttttcatagtttagtccttgttataaggttgaagtaaaagctggaagccattcttccgcacttccatcgtggtcaaaattattcaccacgtcaatgcgtagagattcgcatacttgtgtcgcccctttggcagttaagccttgttcaacaagattgacggcattgcagaaagtgtcgtaatcggaactgcctaatccgacaaccccaaatttcatctggctgagatcaagattgctttcggcaagttgttggaaaaggggttggatattttcaggcagttctcctgcaccgtgtgttgatgtgacgactaacagggcagtttgatgttgaatatcggctaattcggcttggttaaacagcccaacctgatagccttgttcagtgagaacatcattgagatgatcggcgacatactccgcaccgcctaaggtgctaccggtgatgatacaaatagatttcgacatagcatactcatattgtaaaaaaatcgacttattctagaagaattgttataaagaataaagcagttttacatcaaggaaagagaagttgtatattctgccaaatctcccctaacctctcgaagctcaaagaggggaactggtacaaacgaaaattcaacatcgaagttctttaaaaagattttgagttttctgatgaatgtataactttctgtgatctaatccccctctttcgttctttttttgtataatgccaacatttcatccctgacttcctttccctcgcaagcgggggaaggtgccgaaggcggaaggggggatacaagcggtcagattaagccaaaattttgcaaatagagaaaagattatgtttgagaacctatccgacagactatccaaaaccctaaaaaacattacggggaaagggcgtttaaccgaagataacattaaagataccctgcgtgaagtgcgtatggcattgttagaagccgatgtggctttgcctgtggtgcgtgagtttatcaataaagtcaaagagcgtgctattggcgaagaagtcaataaaagcttaacaccagggcaagagttcctaaaaatcgtgcaagctgagcttgaaaaagcgatgggcgaagcaaatgaagggctgaaccttgccacccaaccgccagcggtaattttaatggctggtttgcagggcgctggtaaaacgacctctgttggtaaattggcgaaattcttaaaagaacgccataagaaaaaagtgcttgtggtgtctgctgacgtttatcgtccagcggcgattaaacagcttcaaacgttggctgaagcgttaaaagttgatttcttcccgacagaaacgtcgcaaaaaccggtagacattgccgaagcagcattgaaacacgccaaactcaatttctttgatgtgttaattgtcgataccgcaggtcgcttgcacgttgatggcgagatgatggaagagatccagcaaattcactcggtgttaaacccaattgaaaccttgtttactgtcgatgcaatgacaggtcaagatgcggcaaacacggcaaaagcctttaatgaagccttgccgcttacaggggtgattttaaccaaagtcgatggtgatgctcgtggtggtgcggcgttatctattcgtcaaattacaggcaagccgattaaattcttaggggttggcgagaaaaccgatgcccttgagccgttccaccctgatcgtatcgcttcacgcattttaggtatgggcgatgtgctatcgttgattgaagacttacaacgttctgtcgatcaggaaaaagccgaaaaaatggcggcaaaattcaagaaaggcgatgattttacccttgatgatttccgtgaacagttagtggaaatgaaaaaaatgggcggaatgatgtcaatgcttgataaattacctggggcgaaaaacttaccagatcacgttaaaaatcaagtcgatgacaaaatgttcatcaaaatggaagcgatcatcaattcaatgaccctgaaagagcgtgccaacccagacattatcaaaggttcacgccgtcgccgtattgcgttaggttcaggaacgcaagtgcaagatgtgaataaactgctcaaacagtttgacgaaatgcaacgtatgatgaaaaaaatgcgtaaaggcggtatggcaaaaatgatgcgtggaatgaaaggtatgatgggcggaggtcttggtggtttaggtgcgctgggcggaatgtttaggaagaggtagtgtgattgaatagagaaaaatggtgccgactaccggaatcgaactggtgacctactgattacaagtcagttgctctacctactgagctaagtcggcattagataagatgtcttgaaaagagcgcgtattgtagttatttttgttaaagttgcaagctctacctgtctaatttgataaaaatcattcggatccccaacttgaattaaattagttttatttaaaggagtttctttattgtttggaaatgcataactattggatattaaaagcggtgtagtacgaggttttaagccagtatccaccaatagttttgtatattatgtttgttagtattatgtagaacttaattgtcacataatattaaccaaataaaacctcaagggaaagttgtgttattttgaaatcggctcaaccctcgccaacttcaccatattatcggatacttcaagtaccgtaacttttaaattaagtagggtaaattgcgtatcttcgtcagggattttttcaagatgttctaaaattaatccattaaaggttctgacttcatctaatggcaaattccaatcaaagagtttatttaagtcgcgtaaattagctgagccttcgatcagtacagagccatctgattgtggcttcacttcttcttccaatgatggtgcagttgaagtagtaaattcccccacgatttcttctaaaatatcttcaagtgtaatcaaccctttaatatcaccatattcatcaactactaaaccgatacgttttttgttatttttgaaattcatcaattgtgtatttaatggcgttccttctggaataaagtagatttcatctactgcacggataagttgctctttggtaaattcattacgctctaacattaagcgaaacgcctctcgaacacgcaacataccgagtaggtttttatccatatcgcttttataaatcacaacgtgagcgtgcgctgcccctgtgagctgacgcataatagatttccaatcatcgtcaatgtcaatgctaccaatatcattgcgaggcaccataatgtcatcaacagtcactttttccatatcaagaattgataccaacatctcttggtgagcggtagggataaatttccctgcctcaagtacaacacctcgtagttcttctgcacttaaccctgatttttcagacttgcggatacggaataatttcatcaagccattaatgatgaggttcataaagaacactagtggcatcaataatttttgtaatggcataagaatataactgacagtaaagccaactttttcaggatacagtgcggcaatggttttaggtaaaatctcagagaaaaccaacatcacaaaggtaagtaatcccgttgcaatcgccacacctgcttcaccggataattgcataccaatcattgttgcaattgcggaagcggcaatattgacaaggttattacagattaaaattaaacttaataaaacatctgttctcgataacagtttttcagcaagttttgcccctttatgccctttatcagcaaggtggcgcatacggtagcggtttaacgacattagccctgtttcagagccggagaagaatgcagaaagcaatagaagaatagctagtgtgatgaataaactactcagggggatcgtgtccaaaataaaagtcctatgttcgttagtcacaagcggttagatgaataaaaaatttgcaacacagagaacaaatctaaccgctaccttagtggtattacaccattcgactgccaaaataggcaaccgaaagcagtatcatacctgaaattgaataaattagcacccgatttcctcgccagcggagtttccattgccccaataataagatgttatacacaatccacgcaatgaaagaaaaaatcgccttatgaatatgctctggtgcaaagaagttgtgtaagtagatcattcctgtgacaagggcgactgtgagcaatccttgagccaccattgttaaggtaaaaaagtgacgttcaacggtcattaacggaggtacgacgggagaaaatgccattttcttacttttaagatttttatctaaccatttaagttgagccgcataaagtagagcgataaaaaataacgcataagaagcaatggcaatgcctaaatggagcattaaccctagattttcggacagctgtttaataaaactgcctgcgacaaaggtagataaggtgacagtaacaataccaagcggataaatcacagacaatggaaaccacaccgttttccatcgagttaaagcgaaagtcgccacagcactaataatcacactgatcagagatgcaacatttacaatggtaaaattttgtccaccattgacaaccagatgttgagaaatgctaataatatggcaaagtacagcagctaagcccaaaagcaatactgcacggatattcggttgtttatccgtatcaagatgagcaagtgttggcataatccataataaagcacctaaataagccacaatggtcaataccgcaaataacatttcaatttctctctcaattaagaatggttttcaataggtgtaaattagcagttttatcgccgttttgctatggaaaaatagaaatttttcagtgttcagcctaatacttcaatctcttttggaatgagcttcggttcaggcacaaaaatttgcttatggcgttgtagttcacccttttctaacacgatactgcttttcgggactttaaataacttacttagatatttcagcaagtgagcatttgcctgcccatcaatagggggagcggtaatagcaattttgagttcgttatcgtgtaaaccgacaatctgatctcgacttgctttcggttgtaaaaaaatccgcaagcggataccttgcggattttcacaaaattcgaccgcttgcattacgccacagcccatagttgtccaaagacttggtagaacaagctattaataaagagcaacgcaaaaccaagcaccattacagagaagtctaacattcccgttttcggtaaaattttacggataataccaagtacaggctcagtaatttgagcaacggtataatctaacgggtggtttccctgcgttacccagctcattaaagctcgaattaaggtggtaaaaaagagaatttgcccaaaggttttgacgatacttaataagccgataagcacagctcttggtacatcaacaccgaataacacaaattgtaatgccacaatccctgcagctaaaagcaacgcagcaaaattaattccttttaccgttgggatcagcttgcttagcgggtttaacacagggttggttaaacgcattaacgtttgtgaaatcggcatataaggatcaactcgacagaactgtagccaagttcgcaacactaacataaagctaaaaaagccaaccacaatttgaataaatggggctaagtattccattttatttctccaaatataactacatctgaagttacaatctcatcggcataatcacatattccgccgtagcattatcgcaatcttcaattaaacagcttgaacttgcatctacaaggctaatacgcacacgctggcattttaatgtgttaagcacatctaacagatagctcacattaaagcccacttccatctctgcactttgataagagacatcaatgatctcttctgcttcttcttgctctgggttatttgccgtaatttttaacagattttgatttaaggctaaacgcacgccacggaaacgttcgtttgacaaaatcgctgcacgcaccaaagcacgttttaacacctctgcatctgcctctaaaatacgatctgcattgcgtggcaacactcggcggtaatcagggaaacgtccatcaatcagttttgatgtaaacacaatgccgttcattgatacacgcaggttgcttgtaccgatttctaagcgaacgctttcgttattatgccctaccaagcggactaactctaacactgctttgcgtggcacaatcacagaatgggttaaaagctcttgatttaatgccattgtgcagactgcaaggcggtgtccgtccgttgctactgaacgcaataagttgccttcagtttcaaacttcataccgtttaagaaataacgggcatcttggtttgccattgaaaattgagttgcttcaattaaacgtgctaaagtcgcttgttcaatcgtgaaatctacttcaggtttccagtccattaaacttgggtaatccgaagcaggtaaggttgctagattgaacttactgcgatctgcacggataaagacacgatcttcatcaaactgcaccgaaattacgctatcatcaggtaagctacgacaaatatctaaaaactttttcgcaggaatagtaaattttcctgagaaactgaccgcttcaaacagctccgcttgggtagtaagctctacctctaaatcagttcccgttaaagataaacggcttccttcaatttctagcaaaatgttgttgattacaggtaatgttggacgactggttaatacgccacaaacctgttgtaacggcttgagtaactgctcacgggtaatagtaaattgcataacaattccttaagacgataatttgcgtgttaaattggtgtaatcttcttggatactgttatcagtatctctcagctcattaatggttttgcaggcgtgcatcaccgttgtgtgatcacgtccgccaaattcacgtccgatttcaggcaaactgtggttagtcagctcttttgctaatgccattgccatttggcgtggacgagccacggaacgcgtacgactttttgattttaaatccgccattttgatattgtaatactcagcgacggttttctgaatattctcaatggtaattaagtgatcgtaagaggcaatcagatcttttaaggcttctcgtaccgcatcaattgtgatctgacggctggtgaaattgctccacgcaattgcacgatttaacgccccttctaattcacgcacgttagttctgagtttttgcccaaggaaaaaggcgacatcttcacttaactcaatgcctcgttcttccgcttttttcattaaaattgccacacgagtttccaactctggcggctcaatcgccgcatttactccccaacttaaacgagagcggatacgttcttctatattttcaatgtttttcggaaatacatcggacgttacaataatctgcttgcttcgttcaaataacgagttaaatgtgtggaaaaattcctcttgcgttgcctctttgttcgcaaaaaactgaatatcgtcaatcatcaacacatcaagagagcgatagaattttttgaaattctcaatggtgttcgctttaatcgctttgaccatatcctgcacaaaacgctctgagtgaatataaaccactctcgcattcgggttttgctttaaaatttcattaccgattgcgtgcaacaggtgcgttttaccaagacctgttccgccatataacgaaaatggattgcagtggctttcaccagggttacttgcaacctgttgagcaacggctttagcgagttggttagacttcccttgaacaaagttatcaaaggtgagcgtttcagtaagtccagaacgtaatgcagtagcttgcgtttcttgcggtggcgttgcagttggtgtaacagaagtcaccgcttgttctgctggtttgatccctactcgcatctccacttgcaactgctcatttttgcttaaagatcgagcaagggtaacaatctcccctaaaaatttatctttcacccaagttgctacaaactgattatgtgcgtacaacactaattcagagctagttgcactcgcttgcaacggacgtagccaagtgctgtaatcagttggcgatacttttgcttgtaagtgagttaaacaatcagaccaaagggaagacacagtttgctccaaattaatagggttgagaagatcgttatcatacccgaaaaaatgatcaagatcttgaaatttttatggattaaataatttatttctcaaatacttgtagatttttctggccaaaatagattaaaagagaaccgatgaatttatgttttttgataaaaataggcggaatatataatgcatatattccgcacgacttctcacattatgtaggattaaataactacattcgcaattgccacgcctacacaacaagcgacaagtacaccaattaatcctggaaccataaaactatggttgaagtagaatttaccgatcttcgttgtacctgttacatcgaagtttactgtcgcaatatctgacggatagttaggaatgaagaagtaagcgtaagttgctggcattaaaccgactaataatggagcaggcaaacctaagccgataccaacaggtaacatcatcactgcggttgctgcttggctattaatcaccacagatactgcgaaaagagctaatgcaaaagtccaagggtaggtttctaccatttcagtaatacctgctttaaattgtggcattgcatattggaagtaagtatcactcatccacgcaataccaaagatagcaatcgctgcaaccatacctgatttaaacaccacaccatttggcacagtttgtggattagttcttgttgcaagaagaataataccaccaaagcagagcatcatcatttgaatgataagtgacattgaaattggttttactttctcacctgttgccacagtacgaatttcagggaacattgcgattacaacaatggtgattagtgaaagtaagaataacaatactgcggttttagcaccagctggcaatacatcatttaaagttgtacttgttgtacttagaatacgttcacgccagattggatcttgtaaacggcgttgatattctggatcatcttccaactctttaccacgacgtaagctatatagtgataaggcaattgtacctgcaaaagtcgcaggaactgttacagaaatgatattaagtaaggttacattttcaaaacctggtaattctgtaatccgtgcaagatagaatactactgctgcagaaagtgggcttgatgtaatagctaattgcgatgcaacagaggccgcagccattggacgctcaggtcggattttattttttaatgcaatatctgcaataattggcattaccgaatatacagagtgtccagttccaagcataaatgtcatgatataggtaacaattggacctaaaagtgtgatacgttttggatttttacgcagaatacgttctgcaatttggagcatatattttaaaccgccagccgcttctaaaatagatgcacaggttacaacagctaagataattaacatgacgtccacaggtgccttacctggtggcatacgtaaaataaatacttcaacggctaaaccaattcccgaaacaacccctagaccgataccgccaaaacggctacctacatagagaaacgctaataatagtaaaaacttaaaatagagcatacaaacctcgttaagtaataataaaacaggataaattctatctagttgaatttgaagatggaagtggtaggttttaactagatcaaatttttgttatttttataaagaattaaccctttgtttttattataaaaagaagaacagagaactttttcgtacaaaatctcttctctgtgttaaaatccccccagtcaagttatctgatctaaattcatttcccaactgaacctacttctgaatttacatttcaataataaaaacaataagttatataattttataaagagaataatagaatgatcgttgatccaaattaccaaaaagaactcgagaaatatgagaaccctgtgccgagcagggaatttattttacaaaccattcgtgactatgacgctccgatgagcagagaagagttgcttgaagcgtttcatctttatgatgaagaacgtcaagaagcggtgcgtcgtcgtttgcgtgcgatggaaaatgatgggcagttagtctttactaagaaaaaacgttatgccttacctgaaaaaatggacttaatcaaaggcacggtgattggacaccgtgatggctacggctttttgcaagttgaaggcgatgatgactggtttatcccgaatagtcagatgatccgtgtgatgcacggtgattttgtgctggctcaaccgaatggaattgaccgtcgtgggcgtaaagaagtacggattgtacgtgtgcttgaagcacgcaaaaagcagattgttggacgttttttcactgagagcggtatcaattatgtggtgcctgatgatagtcgtatcaatcaggatattttgatccctgaagaacatcgtctaggggcgagaatggggcaagtggttgtggttgaacttcagccacgcaaagcagatttcaaacgccctgttggtgtgattacggaaattctaggggataatcttgcaccaggtatggaaatcgaaattgctctgcgtaaccacgatattccgcacgtttggccagaaggtgtggaaaaacaggtgcgtcaatttaacgaagaagtgcctgacgaagcaaaaataggtcgggtcgatctgcgtgacttgccgttggtgacgattgatggcgaaagtgcgagggattttgatgatgcggtgttctgtcaaaaagagagtaacggctggcgtttgtgggtggcgattgccgatgtcagttactatgttcgcccaaaaactgcccttgatcttgaagcacaacagcgtggtaattcggtctatttccctaatcgtgtgatcccgatgttacctgaagtgctatcaaatgggttatgttcattaaatccgcaagtagatcggctctgcttagtggcagaaatggtggtgtctgaaagcggtaagttactgggctataaattctatgaagcggtaatgaactcgcacgctcgcttaacttatacaaaagtgtggaacattttggaaggcgacgaagcacttcgtgagcgttatttctatcttgtgccacatttggaagagttgcacgcaatgtataaggtgttgctgaatactcgtcaccaacgaggtgcgattgagtttgaaactgtagaaaatcaatttattttcaatccgcaagggcgaattgaacggattgagcctgtgatccgcaatgatgcacataaaatcattgaagagtgtatgattttagccaacattgcttccgctcgttttgtggaagaagcgaatgaaccagccttattccgtattcacgctcaaccgagcgaagagaagctcaccagtttccgtactttcttaaaagagcgtggtttattcttaaatggcggtttgcgtccaacaccaaaagattacgccgaattgctagaacaggtcaaagaacgtcctgatgccgaattaattcagacaatgttacttcgctcactcaaacaagcggtctattctcctgataatgaagggcattttggtttggcattgacggaatatgcccatttcacttcaccgatccgccgttatcctgatttgttgttacatcgtgccattaagtatttgattgagaaaggaaaaggcaataagcgtcactataccgatggcggtggctatcactatcagctcgacgatatggatattttcggtgaaaaatgttctgcaacggaacgccgagcggacgaggctacacgagaagtggctgattggctgaaatgtgaatatatgcaagatcatatcggcgaagtgtttgacggtgtgatttccagcgtaacgggttttggtttgttcgtaaaactcaacgaactgctgatcgacggtttagtccacatttcaaccttagataacggctattaccatttcgacagcgaccgtcagcgtcttgtcggcgaaaacggcgtaatgtaccgcttgggcgatcctgttagggttaaagtgatcggggtaaatcttgacgataaaaaaattgattttgttttaatgaccagcttacgcaaagctcgtggtgaaggcaaaacggcgaagaaaaaagcgaaagcggaaaagccggtgtttaaggaagttaagataaaaaatgcgagaaccaagtccataaatagaaaatcgagtaaaagtaagtattgagcgagggtgaatatgcgttttttcgacactcacacacatctagactatctcgctcaagatcttaatatgtctgtttcgcaattaatgcataatgctaaagctcaacaggtggaacgaattttggttgtagcaatttctgcaaaaatttttgagcaagtgtccgcttgtagccaagctgaaccaaatcatattgtgtatggcttaggcttacaccccctttatattgccgaacatcaaacagccgatttggatttacttgaaaactatctgcaacgccaagatccgcattgcacggcaattgccgagattggcttagagcgagcagttgaagcggtttgtacgcctgagctgtggcataaacaatgtgcatttttagaagcacaattagcttttgccaagcggtatgatttgcctgtgaatttacactctcgcaaaagccacgatcagctttttacttttttgaaaaaagcacaacttgctcgaacaggtgttgtacacgggtttgcaggaagttatgaacaagcgaagcgttttgttgatttaggttataaaatcggggtgggcggtacgataagctatcaaagagcaaataaaaccagagaaacaatgcgtaaattgcctttggaaagtttgttacttgaaaccgatgcccctgatatgcctgtctttggttatcaaggcgagccgaaccgtccagagcgtttagttgtcagtttcaacgcattatgcgaattacgccgtgaaacgcctgagcagattgccgaaactatttggcagacaagtgaaaggttattttggttaggctctcgctaacgtccacacctgaatttcctttaccccctgtttgagtaattcagcacagatggcatttaaggttgagccagtcgtgaccacatcatctacaatcgccactcgttgataaggctgtttcggttgataaataaaagcccctcgtagatttttacggcgttcttggcctgttagctctcgttgcggttgggtggctcgaatacgttgtaaactctctttatccattggcagaagaagccattttgctaaatgttgggctaaaagcaccgcttgattgtagtctcgttgccattcacgttgccaatataacggcacgggtaaaatcacttcgggtaatgtgagctgatgtgttcgtctagcttgataaatagcaagtagtagcagccgtgctaacggttgatcaagccaatattgctgttgaaatttgaagcggtggatccattctgcaagcggtggtttatattgggaaatttgcacgatgcgatgccatttaggttcattctttaaacaatttccacagtaattgtgatcgcttagcagaaaacttccacagccaccacagtagcagtggcgttttagcagatcattacaacggctacaaataccgtgcgatgcaatggcaagccgtctgtcgcaatgtatacagcgaaatccccagtcgttcatcttttcctcaataacttttttctttgaactctatcaagttttttaagagaagtttggggaatttttgtgacgcagatcgaaaaaagagtaaaatttcacagattaaacataaaaggagatattatgcaaaagccaactgccccaatcaaaattgtgttttttgatattgatgaaaccttatattacaaaaaagaaacccgtattccgctgtctatttcagagcaagtacttcctcgtttacgagctaaagggattatccctgcgattgccacgggcagaacttacggggcttttcctaaagcaatcaagccgttaatgaatgaaaaaggttttgatctgtttgtgacgacaaacggacaatataacctttatcgagatcaggttatcagtgaatatccgctaacaactgaacgtattgagcgtatattagccaaactgcaggcgttgcagattgagtatgcctttgtgacagcagaacaaattgcggtatctaaaaatacagcagaagtggaagagtcgttgcgcccaattaaagaagattatattgtcgatccgaatttttatttggatcactcggttattcaactattggtgttttttccacaagaacgcacggaagaggttattcgctctggaattttagaagatgatttaaaagaagtgcgttggcataaatattcggtggatttgttaaataaaaataactcaaaagcacgcggtattgaagatgttctcaaccattttggtttcggtattgaaaatgcgatggcgtttggtgatggtttaaatgatttggaaatgattgctaccgtaggctttggggttgcaatgggcaatgcggaagatgaactgaaagctgtggcagattatgtcactttgccgattgaacaagatggcattttggtggctttagaaaagttaggggtgatttaacttgctgagagtgtttaacgaatgtaaacaaaaagagtttgtggtaataaagaaaacaattaacacgaactcttttgtctattgtgcttaactagaaatattaagctgaccttgcggagcagttaagcaatcataattttgaaaagaatttataggacggaataaccaacaagctagcaagtacagccttaataactccgctaataatgaatggatataaaccgaattcaagcactttatcgcttggtacaaaaagtgaaagttgagctagtccaaaaacgaaagtaataacagtcgcagctaatgataccacaacacttttccagaaagattttaaaatacctttatcactaaagtatcctaataaataagctgttggtacaaaaccaattaaatatccacccgttgggcctaataacgtttgaaatccagatccaccattagcaaatactggtaaaccaatcacaccttcaaataaataaagtaatactgcagaaacagcagctttacgccccaatgcaaaaccaactacggttaatgctagcgtctgacctgtaattggaacgggatacattggcacagaaatttgagcaaaaatcgcaataagatttgcaccaataagagatttcaaaataaaagaaagagattggtttgcctctaaccattttttagcttgagaaagttgtgttatgaacatagttactcctttgaattggaaaatagacgtaaattatactagacttgtcttaaaaagtaactgacttagagcgataagtaaaatggtaaaaccagtttatatctatgcagatgagggaacaagtgatgtgggagtagcatctttgcaacttgcaattgctacaaatcttggtttacccacaaaaactattactgcacagcatattattgataatgagctagaacattgtcaaatgttgattatgccaggcggcgctgatctcccttattgtgcaaaattaaagggaaaagggaaccaacatattcggcagtttgtacaatgtggtggtttttatcttggaatttgtgccggtgcttattatgcaacaaagaccatcgaatttactggagatggttatcaaatttttgagaacagggaattagcgctttttaacgggaaagctgttggttcattgccggatttgactaatcagtactactactacgatggaacagccgcatcaaaaacctttgccacattaacttttccaaataacacccaatcaaaattttactatcatggcggtccaatgtttttgagtgaagtagaggatgcagagactgtggttgcttgctattctgcaaatcgcccagccattgtttgtggatcttatggtaaaggtaaattcttgctctctggtgttcactttgaattacagcccgaaatttatgagcaatatatcataagagatactctacactcatcagaatacattctagaacaatctatctataaccagattaaacaaatggatagcaattatatctggaaaaaaatcagggagttgttagatgaaatatctacaaaatgccaaggaactaaaacttgtgaataatcgcatagagttgtttggaaatcttgccataggttgttaaaatgctattttagattgcaatataaggaactgcctatgaatatcccattctgcttacctgaaaatatttctgctgaagactttttgcaaaattactggcaaaaacgaccgcttttaattcgtaatggattaccacaaattgtggggctgtttgagcctcaagacattattgaattagctcaggaaggggaagtaacttctcgtttgatccaaacacatcaaacagcagaaggtgagaaatggtcgctcaagcgtagtccgttatcggctgaagattttgaaaatttacctgagcagtggtctgtattagtgcaaaatcttgaacagtggtcgccagaacttggtgcattatggcaagcatttggctatatcccacaatggcaacgtgatgatattatggtttcttacgctcctgctggcggttctgttggcagacactatgatgaatatgatgttttccttgtgcaaggctacggtcatcgtcgttggcagttaggcaaatggtgcgacccaagcactgaatttaaaccaaaccaaccgatccgtatttttgatgatatgggcgagttgatttttgacgaggtgcttgcaccaggtgatgtgctttatgtgccgtcacgcctttcacattatggcttagctcaagatgattgcttgaccttctcttttggtttacgttttccaaatgcaacggatttactcgaaaatctatgtagaaccattgagcatcaaggggaaatcattccaaattcacaatttgcaatcccattccgtttgtcgccaaatgtgcaacctaatgccttactcgatccaaaaatggtcgctacgttaaaagcacgtttgatcgacttattgcaaaactcgacgcagtttgatgaaatctttacgcatagtgttgctactgccgttagtacgcgtcgttatgaacaattaaccgaagacaacgagttttatcctgatgaagtacaggaggtgctagaagcgggtggttgggtacaacaagatgcgaacgttaaaatcctttatactgagaacccgttacgcgtttatgtcaatggtgagtggattgatgaactcaatgaggccgaggctaatttgttaatccgtattgccaatggtgacgctatttcgtggaataaacttgcttctaaggccgaaaatcaagatgaattagaactcttactcgatacactttgtgattggttagatagtggttgggtagtgttgatggataaagaataatttctttctctattcatactagggactatctttattttttgtccctaagggctactttagccctctctatgtagcatacaatcaagcggttattttccacaaccattttgcaatgaaccaacaactattagacggtgtaccgctaaccgccctttcgggtgttggggcggcgatttcagagaaactcagtcggatcggcattaataacgtgcaagatctgctattccatttgccgctacggtatgaagaccgtactcggatcacgccgattgccgatgttcgtcctgaaagttttgcgacggttgaaggctttgtgcaactgacggaagtacaattcggtcgtcgcccgattttaagtaccacgatttctgacggcacgagcaaaattactctgaaattctttaatttcaatgcgggaatgaaaaatagtctggcgactggcgtaagggtcaaagcctttggtgagattaaacgtggtcgctttatggcagaaatgcatcaccctgaatatcaaattattcggggaaatcaaccgcttgagctggcagaaacattaacaccgatttacccgacaaccgaaggcttgaagcaagcctctttgcgtaaattaaccgatcaagccttagcgttacttgagcgtgtgcaagtggcagaattgcttcctgatgaatttaatccacacaaatatagcttaaaagaagccttgcagttgttgcatagaccgccaccgagtgtgtcgtccgaattgttagataaaggcgaacaccctgcacaaaaacggctgatttttgaagagctgttggctcataatttggcgatgcaacaggtgcgaatgggggtgcaacaacattttgctgaaccgctatgttatcaaaccgatttaaaacaacgctttttagccactttgccgtttcaaccgaccaacgctcaaagccgtgtgactgcggagattgaacaggatttggcaaaaccttttccgatgatgcgactggtgcaaggcgatgtgggttcaggcaaaacccttgtggcagcattggcggcactgctggcgattgacaatggtaaacaggtggcgttaatggcaccgaccgaaattctcgccgagcaacacgcccataattttgccaactggctacgaccttttgggatcgaagtgggctggttagctggcaaagtgaaaggtaaagcgagaacagcccagttggaagcgattaaaaacggcgatgttcagatgattatcggcacgcacgccctgtttcaagatcaggtggaatttcatcatcttgctcttgtgattattgatgaacagcaccgctttggtgtacatcagcgtttaaccttacgcgagaaaggggcgaagggcgatgtgtatccgcaccagttgattatgaccgcaacgcctattccacgcaccttagcgatgactgtctatgcggatttggatacgtccattattgacgaacttcccccagggcgaacgccgattacgacggtggcgatttcagaagatcgccgagatgaagtggttcgccgtgtttatcaagcctgtaaaaatgaaaaacgccaagcctattgggtctgtacgctaattgatgagtcggaagtattggaagcacaagcggcagcggcgattgccgaagatttgcaacgagccttgccagatttgcggattggcttggttcacgggcgaatgaaaccgcaagaaaaacaggcgattatggcggaatttaaggcggcagatattgatttgttagtcgcaacaacagtgattgaagtcggcgtagatgtgccgaatgccagtttgatgattatcgaaaattccgaacgcttggggctggcacagttgcaccaactgcgtgggcgtgtcgggcgtggggcgacggcttcccattgtgtcttgatgtacaaagccccattgggtaaaatttcaactaagcgtttacaggtgctgagagatagccaagatggctttgtgattgctgaaaaagatttggaaattcgaggaccaggcgaagtgctaggcacaaaacagacgggaatggcagagttcaagattgcaaatttaatgcgagatcgtaagatgatcccgttggtgcagagctacgctaaacagctaacgttaaaatatcccgatacagctaaacagctaattcgccgttggcttgatgaaaagacggtttatagtaatgcgtaacttgattttattctatttattcaatactaaaactttatttttctccctttattgggcctcaaaaaggcaatagtagtattcttctagtacttttgtatatcatttctctagtcgattccaattcataatgtaaatagagattagatatctttattatcaataaatatataaaaaattttttacttcttaagaattttttaagatttacttgctttaatactctcaacgaaaggcaagagccttcgttattcatacttattattttaactattcggagtattctatgaaaaaagcaattatcttaacaatattattagcggtatctactgtatcaatggcaaaaggtgatgatgattatcgtcacggtggctatcacgatggcaaagcaagaacacatcaatcacaaggtttctttgatgaaagtattgcagtgaagagcgtagcagatgcacttaaagcggcggatgacacccctgcactacttgaagggcaaatcgttaaacaaatcgacaaagatgagtttatctttaaagatgcaacgggcgaaattgaaattgatgtaagcaaacgtgcttggaacggtttaaatatcggtcctcaagataccattcaaattcgtggtaaagttgataacgattggaacaaagttcaagtggatgtaaaacagattactaagaaataatttatcctcactagcggtctgtttttgtaaaaaatttgcagaagctgaccgcttttttatgcctgattttcggaaatcctttctatgaacaaaattaaacttatcccttggctttattctattgcacctgaatatcaaaccaaagtcccgatgattatatggttttcaaaagagtggattaaaaacgaaccttttgatctaaattgcgttagagaaaatgcgaaaacaaaaacctattctcatgacaattattttcattctgtgataggtatgatggatatggatttatcgctctctgtttatcagaaagagttagatattttaaatcagtgtcgtaaataatcttgaatataagagcaaaaagttggtaataggtatttcaatgataaaaagcagtttaagttggtatgtttcggtagtatgcgaaagacaagcgagggcgggagaagttgtggtattcaagcatatcaattattgtaatggtaaggtttattctgttgttgtgctgaatacccaatcggcaacatctctcttaaaagattttgcattttatactattctaacgtaacatttacccaacgtaattaacaatacatacataaataatgaaaaaactgatatttatgctcttcctgataataatcgggttaacatcttgtggagtaaaaggtcctctttatattctggcttaatatttggtataaaggtttatgttataagagagtgtttgtatttttttgaaaatgcactcattgcataaatttacgctggagctttatgtcatttaacacggaaaatagttggaaaagtgcgttcaaactcactataccaatatttatgggataccttgcggcaggtattgcctatggaatgttagcaaccaatgcaggaatgcctgcgtggtttacaattgtgatgtgttttaccgttttttcaggcacagcacagtatgcagcaattcccttttttgtttctggagcgggagtagtttccgtttttctcagtactttattgatgagcttacgttttattttttatacacttaatatgcattcatcattacccaaagaaaaactcaaccgcttttttgtattaagctatctgacagatgaaaactttggcgtattaaccaccttaccacaagaaactcgtcaggcgatgatgttcaaaatcagtatcttaggaatgagttattggacatttgcaactattgttggcattttattgggtgattctgtttcccaatatattcccaatttagattttgcactgccttgcttattcgctattttagcttatgaacaatacagtagccaaaagcagtggaagccaatttttattgcattgattggatttttacttgcagggcaaatcacacaaacaagcgtcttgcttgtggcaatcatcatcgccattatcattgtcgctttcttaccccaatcattcactgagaaaaaaggacaagtttaatggaaacgcaaaatattatttatatgttgattgcattggcattaggcactcaactttgtcgctttttgccgttatttttgccaaaaactgtactatcttcgccaattttgcaaaaattaaacaaaatgttaccgcttgtgattatggtattactggtactcaccagcttaagtttgccgaaaagtaatgaaggttataccttatttatcgctcaaataatagcattagtaggagtagtagtgagctatgtatggttaagaaatgttctatttagtgtgggtattggtattttaggtttcaatctattcctttacattttatagatgcaagatatttgttaattatagatgttacagtgttctcccattcagaatgatgctacaagttttacttctcttgctaattattcctctatataataatcatgttttgaatcgaaagatatttggaaaatttaagtgtcaaaacgaaatacacaacaacgccgtcaaattattgtaggtcttgttcaagaacaaggcgaagtaagtgtggaatatttggcgcacttatttgaaacctctgaagtaactattcgtaaggatctaaccgctcttgaagaaagcggttttttattgcgtcgctacggaggtgcaataaaattaccaacagagatgaatgaagaatcgcaagagcaactttcgaaacaaaagttagctattgctagtgcggcagcaaatcaaattcgagatcataatcgcattattattgatagcgggagtacaacaggaacgttagtcaaagcacttcatcattcaggcttggttgtaatgacaaattcgcttgctcttgcaaatgaattaatcgccttagagtgcgaaccgacagtcctgatgacaggaggaacttgggacgctcgttcggagtcgtttcaggggaaagttgccgcaaatgtattgcgttcttacgacttcgatcagctttttattggtgctgatggactggatttaacccgtggcacaaccacttttaatgaacttattggcttgagtcaagtaatggctgaagtatcaagagaagttattgtgatgattgaatctcaaaaaatcggacgcaaaatgccaaatcttgaattggagtggcaacaaattgataaattaattactgacgatcagcttgatccaaacgtcaaacaacaaattgaggcgttaggggttgaggtgattgttgcaaaataaacaacataagcaacaaaataggaaagtaaatttatgtgtggaattgtaggtgtagtagcacaacgtgatgtcgcagaaattttagtcgatggtttacaccgtttagaatatcgtggttatgactcagccggtgttgcagtcttaggaaacgatcataacttacagatcgttcgccgtgtgggtaaagtgaaattcttagatgaagcacttgaagcaaacccacttttaggtggaacagggattgcgcatactcgttgggcaacccacggtgagccatcagaagtgaatgcgcacccacaccgttcaggcaaaattgccgtcgttcataacggtattatcgagaactacgaagaactgcgtgctgaattacaacaacgtggttatgtattccaatcacaaacggatactgaagtgattgcacatttagtggaatgggaattccgtacaacgccaaatttactcgatgcggtaagaaaagcggtcaaacagcttcgtggtgcttacggaacagtggtaatgaatcaagatgaacctgagcatttagtggttgctcgttcaggtagcccgttagtgatcggtttaggtgttggggaaaatttccttgcttctgacccgcttgcattattaagcgtaactcgccgttttatctaccttgaagaaggcgatgtggcagaaatcactcgtcgtactgttgatatttataaccgttcaggtgaaaaagtagagcgtgacgttcacgaaggtaactttgagtctgatgcagcggataaaggtcaatatcgccactatatgcaaaaagagatttttgaacagccagtagcaattatgaatactttagaaggacgtattgcgaacggtaaagtaaatattgaagcaatcagcaacaatgctgaagagatcttaaagaaagttgaacacattcaaatcgttgcttgtggtacgtcttacaatgctggtatggtggctcgttactggtttgaatctattgcaggcgtggcttgtgatgtcgaaatcgcttctgaatttcgttaccgtaaatttgtgactcgtccaaatagtttgctaattaccatttctcaatcgggcgaaactgcagatactttagcggcattacgtttagccaaagaatctggttttatggcggcaatgacgatttgtaatgtggcaagctcttcccttgtgcgtgaatctgactttgcttttatgacccgtgctggtgtagaagttggcgttgcttcaactaaagcatttacaacacaattaacctgtttactacttttaacggcagcattaggacgtttaaaaggcaatgtctctgctgaacaagaaacggaaattgtgaaatctttacaacgcttaccagcacaaattgaaagtgcattagtatttgataaagagattgaaaaattatcagaagactttgcagagaaacatcatacgctcttcttaggtcgtggtgagttctatcctatcgcaatggaatctgcattaaaattaaaagagatttcttatattcatgcggaagcttatgcggcaggcgaattgaaacacggcccgttagcattaattgatgcggatatgcctgtgattgtggttgcaccagaaaatgatttactcgaaaaagtaaaatcaaatattgaagaagtgcgtgcacgtggcggtcaaatgtatgtctttgctgatagtgaagcagggtttagtagccaagaaggttatacggtattaactttcccgaaagtagaccatgtgacagctcctattttctacgctgttccattacaattactttcttatcacgttgctttgattaagggaactgatgtggatcagcctcgtaacttggcgaagtcagtgacggttgagtaacaaatatagatattcattaaggtaatgcttacttatatggagtgaattatttggctaaagaggatataatttattttatttaattgtagagagatgtaaaaatgaagaatatacctattcgttcagaggcagagattgaaaagttacgtattgcctgtaagttagcttctgatgttttagtgatgattgagccctatgttaaagaaggaattagtactggagaattagatcgcatttgtcatgaatatatcgaacaagtacagaaagcaattcccgcatgtttaggctatcatggctatccaaaagcaacatgtatttcattgaatgaagttgtgtgccatggcataccaaatccagaaaagaaattgaagaaaggagatattctgaatattgatgtgactgtgataaaggatggctattatggggataattcaaaaatgtatgctgtaggagagccaacgattaaagataagcgcttgttagaggttactcaagaatgtctttatattggcttacgtgcggtaaaaccaggtattcgtttaaatcaaatcggtaaagcaattcagcaatttgcagaaaaagagggattttcagtagttcgtgaatattgtggacatggtattggcgatcaatttcattgtgaaccccaagtactacattatttttcagatgatggcggagtggtattacaagaaggtatggtgtttactattgagccgatgattaatgctgggaaaaaggaaatacgcctgatgggagatgggtggacggtaaaaactaaagatcgtagtcattctgcacaatatgaacaccaaattgttgttacaaaagatggctgcgaggttatgacaatccgtgatgaggaaatttttgaggggagaatttcacgattgatgaaaaatacgtaataacatcaatatgtgtgagaaaaagttgctagcccttgcttttgcagtggttagcaacttttagtctatttaaaatacgctattttgcaatactatccgcccacttaaacaactcatctaaatcataatcccctgcgtgtggaacgccccaaggggtttcataatcgacctgtttacctgccatattgagcttaatggctaaaattgcactgattgcgtgagaagtatcgcgatctgaagtgcctacacgaatacgccaatgttctgcggctttagggttttcaacgtagttcattgcgttcatcattttgatgatatgtgcatctgccataccgccttttgcggtactgcgttcaagggcgtaagaggtaaaatgttgattattaacggtttccgttccaaagagattattttcccctgagcttaaatcaaaggcatcaaatgcaggcggtgatttcattcgtttttctgaatgaatataaccgttccaatccatatcagccacaccatctttactcaaagtgagccacgacttatcacttaaattcgtaccatttttatgagccgtatcagctgctctcactatcacctgtttgacatactctttaaaagagccgtttccttctttatcaagggtaagcaaattgcctttttcatctttcaagttcaggctattgatataagctggaaatgcggcttttagttcgtgagaagttttgatctgatctgcagttaattcaccttcaatgcgaggttttgactgagagcgatcattgtaacctgttgcggataaacggctcatatcaatgcgactaaattgatttaagccattaaattcccattcataagcagtatcggcattttctaagttggtaattgggcagtaagctgatacagcaaaaatcgcatcgctcgcttctgctgcctcaacttgtttgaagtattccgcataatcgcgatgatcgccacttgcccctaatagagccgacaaggcaccgcctgcactggttccatttgagataattttattcgcatcacctgccattcgttgatcgttaaaatgcaagtaacgaaccgctgattttaagtcaatgattgccgcaggggcttttcctgtatatttgccgtctttctcaagggttcgaccacgagcaccaacacttgccaccacatagcctttagagagagctgttacgattgcattcggtttatctgcattcgagccgaaaccttttttatcataggttgctgctttggcaggcatatagcctccgaccgcattaggtaagaaaatcggtgcggcgttagccgtaaatccattgattgaaccgccgttaaaataggcttctggcacataaaaattgatggtttgtaagtgtagtgcgtttcatcatgctctccaaaaataaaagatatgctgctaagactgtaatctaggaagaaaagttcttttattttaatatgatttttatatagcgaagcaatagaacgaaaaatataagcggtcagattatgacaaattattgcaacaaactgactgcttacgagggttatatgttagtttttactatccggcttcgccatattattcggcgcgcctttctgtacagggaaggttgagtccatctgccacgcattctaaccgccgtcataaaccgccgtattttgccagccgagaagctgggtcataaaccacggcacggacgctcgccagcctgttccacaatagaacgccagttgatcgccctgttgaatatgctgtccttgccacagtgccacgatctctttcgggttacgcaaggtgtcatcagggtcgtaaaaatcggcgacatttgacggtgccgatcccgaaaagccccaaattgctccctgcggttcacctgttgcttgaatatgttcatcaccgctcacttcgccgataaactcttcccacgcccttgtgctaacgagcttcaagccttgttgcagacgggcgtaagcctgctcaggttgggctgatgttgatctgcggattagccggaatggttgtgccgaacgccgttttaggcagtggctgattgactttggtttccgttggaaaacctgcgtctatccaagtggcaagattgccgtttaacactcgtacatcttctacaccagcccatttcaacgcccaaaacacacgataggcggcaagcggattgtcggaataaagcacaatagttttatctttggtgatcccgtgttgtaacaggttttgttcaatttgttgcggattggcaaggttatacacaggggcctcaccctcccccgtaaacgggggagggaatttaggctggtttattaaattaaatacgacattgcgttggcttaataaagtaagttgcagtccaacagccgagcataatcatcagcgtagcaagccaaccttgccacgaaaaataagcggtcgaaaccagtgagttggtgatcgtacaaccgcctgcaaggctggcaccgatccccatcaggataccgccgaacattcgttgcataatcgctttgggttcaggcacgcggatttcaaattccccactcaattttgcggcaataaaagagccgagcaaaatgccgagaacgaagtaagttccccagttgagataacgctgttgcccgatcacgatatattgcaccacattggcggtcggcacagcgacaccatagccgtaagctctgccgtactgctcactcacaaaccacgccaacacgccgagcagaccgatacacacggcggtagcaaaagggtgccagtgtttggtaaaagttcggtgcgaaaccaaccaccgctggcacagcaatttgccaagatcatcccgataccaaatacaaaaccgcctaacaccgttgctaacagaggcattggggtattcggaatggtgatcagccctaattcacttaaactaaaaaatccgatggattgaatggacaccgcaattaacaatgcggtaaaaaagcgaaagttttgctgggtataaatgttgcgaaaatcggacacgaagcaaaattgcccacgttgtaagaaaaaaccgagaagtatcccgataaaaagaccactgaacattgattaaaccttaatacaaatgttacggaaatgttgttgggggtattagaacatagtttgggagaaaataaaatggataaatgaaataatttgttattgtagagatttaatatttatttgtacttacatgaaacgcaataaactccatttttgaaatatctttagctattgaaaatagacttttcttgggatgtgagtaaattaaccctaagggagatatatcatttattgtgcttatttctctttagttagagaaatagtcggtataaagaatttgtacagtatgcttattggtaagcatatgctttattcacattgaataaattattcctacaataaaagtatattaattattgagtattcgtatattttatttcaatcactaaagttctcgacattgtgtttacaggacgttacaattgctatctatttgtattttataatcaaatcctttttaatactgaggtttaagaatgtcaatttctattgaaacattagaaggcttacaacgccgtgtaacagttaccgtagctgcagataaaattgaagcaggttacaaagaacaattaaaaggctatgcgaaaaatgctcgtgtagatggtttccgtaaagggaaagttcctcactcaatcattgaacaacgttacggtttagcggctcgtcaagatgtattatctgaagagatgcaacgtgctttctttgatgtagtgattgcagagaaaatcaaccttgcaggtcgtccaacattcacaccaaacaactaccaaccaggtcaagatttctcattcgtagcgacttttgaagtattcccagaagttgaattaaaaggtttagaaaacatcgaagtagaaaaaccagtggttgaaatcacagaagctgatttagacaaaatggttgatgtgttacgcaaacaacaagcaacatttgcagaaaccactgaagcagcaaaagcagatgaccgtgtaacaatcgatttcgttggttcagtagatggcgaagagtttgaaggcggtaaggcttctgacttcgtattagcaatgggtcaaggtcgtatgatccctggttttgaagagggtatcgttggtcacaaagccggcgaacaattcgatatcgatgtgatattcccagcagaataccacgctgagaacttaaaaggtaaagctgcaaaatttgctatcgccttgaaaaaagtagaaaacatcgttcttcctgaattaacagaagagttcgtgaaaaaatttggttcagcaaaaaccgttgaagagttgcgtgttgaaatcaagaaaaatatgcaacgtgagttaaaaaatgcattaactactcgtgtaaaaaaccaagtgatcaacggcttattagcaaacaacgacattgaagttccttcatcagcagtagcggaagaagttgatgtattacgtcagcaagcagttcaacgtttcggtggcaagccagaaatggcagcacaattaccagcagaattgtttgaagtagaggcaaaacgtcgtgttcaagtaggtctattactttcgagcgtgatcacatctaatgagttaaaagtagatgaagctcgtgtgaaagaaaccatctcagaattagcatcggcttacgagcaaccagcagaagtagttgaatactatgcgaaaaatccacgtttaaccgataacattcgtaacgtagtattagaagagcaagcggttgaagctgtgcttgcaaaagcaaaagtgacagaaaaagcatcttcatttgatgaagtaatgtcacatcaaggctaatttctctaattaataatttggcacgcattagcgtgccttatattaaatgtcgctggcgagttactttcgctaccattattcatttacattagagagaaacctatggaacaacttacttttgcagaacaatttcagcagttcaccgctaaccacaccattatggttgtagcgtgggtggcactttttattgcggtaatcatcaatttctataaaggtgcaaccagcaaattcaagattgtggataatgctcaagcaactcagcttatcaataaagaagatgcagtgttagttgatgttcgttctgatgatgaatttagacacggtcatatcattgagagcgtgcatttaattccaagcgacatcaaaggtaaaaaaacacaggctatcgaaaaatataaagatcgtcctgtgattgttgttgatgcgaatggtttaagtgcaagtgggcttgcaaatgaacttgtgaaacagggcttcgataaagtctatgtattaaaagaaggcattgcaggctggcgtacggctaacttaccgctcgtaaaaaagcataaataattcaatacattaaaattaaggaatgactatggctgaagaaaatcaagttgctactgaagagcaacaaactccgtttgaaatgcaaattcaacgtatctatatcaaagatgtttcttttgaagcgcctaatttaccaaacatttttcatcaagaatggaaacctcagttaggttttgatcttgatacagaaacgcgtgaaattggtgaagatacttacgaagtggttttacatatcaatgttcaaacaactttggaagacagcaacgatgtcgcattcatctgtgaagtaaaacaagcgggtgtatttaccatcaaaggtattgaaggtatccaattggcacactgtcttgcagcgaaatgccctgaagtgctttacccttatgcacgagagttaatttcaagtctagtaaatcgtggtacattccctgcattaaatctttcaccagtaaactttgatgcattgtttatggactatttagctcgtcaacaagcggaagaaaacggtgagagtactacaaatactacactaaattaatcaatattatggcaatgtattagttctaaatactatactgatcacataacatttcatcttacaaagtcaaaagagctggttataatgatctgccccccaaaagttagactgatttagttcaaggactgagttctgtattccacagggcttagtccttttaattttacttgaatacgcccatgattgtaataatgaatatattcgtgaatagcttgttccagttgctcaaaggtctcaaaccgtttgccaaagtaacattccgtttttaaacgcccaaagaaactttgatctgcaccttaattagttggttgtttagtccaacttttggggtgcagatcataatcaccagctctttttttaatgatattgtgacatggttaataaaaaggtgtaatagacaaaatagttgctgaaaagtggcttaaagtacttatagtacaaggctttaagccctatttttgaaatatgaacaaaaaacttcccattttgccaaagtctgaaaataaagaaacatggtacatcaaataatattcaacgatatttttgtcataagtgtcataaaacatttttccttgagaataaattagatccaataaaaatttggactgattacacatccagaaaacaaacctatcaacaactcgccgttaaatatcattgttcagtcagaactattcaaagatatatcaataaagtccctaaaacatctttaaaaccgccttcaaatcgatagctgaatatcattatggatacaacgtttttcggacgttattttggcgtattagtgttaatggatacgctttcaaataatgtcatttcccattattgtgtgcgaaccgaaaaagatatttactataaacttgccctgaataggttaagagaaaaaagctatataattcaatcggattacctgcgatggcaaggagtggtttgatgaaagatttatttaatacgccagtacagatgtatcaatttcgtatggtggcaatgatatccatatgtaattcatgtgtatagagatgcgttgatttagtaataaatcactggagtaaattttaaaaatatacatttttagaccaaaatattcgatcttgttattttcaaataagatacattatttagttctatttggattaacttatacttaatcttgtatgctcctgctatgcaaggctataatagtcattttattaaaaaatgaaggaaaacaaaatggcttgggtacaaattcgtttaaatagtacagatagagaagctgagaaaattagcgagtttttagaagatattggagcagtgtccgtgacttttatgaacagccaagatacgccaatttttgagccacttcctggagaaactcgtctttggggtaatactgatgtcgttgccttatttgatgcagaaactgacatgaaagagattgtttctacattagtaaaaagtaaacttgtagctactgactttccatataaaatagaacaaattgaagataaagattgggaacgggaatggatggacaatttccacccaatgcaattcggtaaacgtttatggatctgcccaagttggcgagaaattcccgatccaaatgcagtcaatgtaatgctagatcctggtttagcatttggcacaggaacacacccaacaactgcactttgtctagcttggttagacagtctggatttaacagataaaacggttattgactttggctgtggttcgggaattttagcaattgcagctcttaaattaggtgcaaaaaaagcaataggtatcgatattgatccacaagcaattttagctagtcagaacaatgcggaagtaaatggtgtagcggatagattgcaactatttcttacaaaagatcaaccgcaaaacctaattgctgatgtcgttatagcaaatattcttgcaggcccgttaaaagaacttgcccctcaaattatcacgttagtaaaaccacaggggaatttaggtttatcaggtattcttgctacacaagcagaatccgtttgtaaagcttaccaaaatagctttaaacttgattctatcatagaaaaagaagaatggtgtcgaattacagggattaaaaaacattgagaaaactcgtatttaacagtaagctgttgataagtctgttttctagatgtgccattcgtccaaattcatatttcaaaaaaagagctttgatttctgtacttatccagtattatatagcacttgcacaaacacttaattttttcgtagcaactgtgttcatccacaaaaataaggggcgaaaattcgcccctatagttcaacaattcaatgattatgctttagttgtatcatcaatataaacatccaggtcttcttgaccttcacgtttaatcattgtgaagaatgcaactaagcacgctgctgctaatgctaaaccaatgtataccgataattggtaatctaaaccgaaaccaatcttattgtacgctaagaaggtaaatgatacggtactaataaatgccgcagggattgtacatacccagtggaatttattgtagcgatataagtaagccgctgctgtccataacattaccattgctgtcgtttggtttgcccaagtgaagtaacgccataagatactgaagtcgatttttgaaacgataaaaccgatagcaaataatggaagacaaatcattaagcgttttactaaagttctttgttcaatattgaagaactccgcaatgattaaacgtgctgcacggaatgcagtatcgccagatgtgataggtaatacaaccacacctaatactgcaaagataccgcccacgaagcctaagaagtaaagagaagaatcatataccactttagacggtgaacctgctgcgattgcatcttgtaaagcttgtgggttttcatagaatgctaaaccaaccatacaccagattaacgcaataacaccttcagcaatcattgcaccgtagaaaatgaagcgaccttcgctttcgttttctgcacaacgagccattaatggagtttgtgttgcgtggaaacctgataatgcaccacaagagatggttaagaagagtaacggccaaactggaacatcgcctttaacttggaagttttggaagaacttctcagcactcattccatcaatagtacggaagaaatcgacagggtctgttgcactgaagtgacttgtgactaaaccatacaccatacctattgacataaatagcaataacgcaccgaagaatgggtagatacgaccgatgattttatcaactggaagtaaggttgcaagaatgtagtaacagaaaatgatggttgtccaaactgcaattaccgttggtttatccataccccatacagtaatgtcgcttgctgccgttgccgttttcgcaatttcttcagcgttatctaaagagagtgcgccacctgctgaaccaaatacgtcaacagtaattgtacttaataattgagcaggacttgctacgaatactacccctactagaagaagtaatacaacggctaaaaggttaataaaggctttaactggacgacctaagtatttaccagctaagttaggcattgatgcaccgccgttacgcacacttaacataccacagaagtagtcgtgtactgcacctgcgaagatacaacctaatacgatccaaagcattgcaactggtccgtataacgcaccaaggataggaccaaagattggacctgttcctgcaatgtttaataactgaatgagccaaatacgctttttagacattggtacgtagtcaacaccgtcttgcattgtgtaagctggcgttgtttttttcgggttaatcacgaaaattttttcgatgattttaccgtaaacgaagtagcctaggattaatacggctacgcaaaataagaaccacaacataatggagatcctgtgaataaaaagttgaatataagttaaacctaaaaaggcagtgtattctattaatttgttaccttaaggcagggcaaccgcatatgttgtccatttttcaacctacacaccgagcaacagctcatctcgaaattcatctgaccaaccagcagcggtcaatttccctttcatactctgctttttcgggtgcaatcgagccaagttcaacgctaatcgacgcaaaattgccagattttccgcaccccattcatcggtcacagcacattcgtcttctttatagaccacatctagcacccaatgggctttgttttccacttcccaatgccctcgcacgcacttcgccaatatttgaacatcaacatccaaactactgatataaaagactttttcttgtgattctttgccattatctgaccgcttgcgacacacctccaaccaccgattttatccccttccattcctccgctttgctcagccaatcactcactttcagcttacggtagtaacgctcatcaattcgactacgttccgcatttacctcctcatacgtctcaagcatttcggggcaatctcggcggattttgtgaaaatacgcctccacttccgactgaaattgacggtgatttttcttcaacggcatcacataatcccctttcttttcgatgattttctccgcaattttcttctgtgtattcatcgcatccaccgttataacggcattttttaagcaaaaactatcgataatttccatcaccgcctgctgctcattttgcttacccgaggattttttctgcgataaaatcaaaccacgagactggctccacaccgtcacactgtgcaaagcactttgggtttccggattgaaactatgacgaagtgtcttgccatcaatcgcaatcacttcacgtccttgttgtgtgcgtatctcattgataaaattaagaaaaacctcattaaatgcttgtggctcaatgcgttttattacacgggcgatagtatcatcgacaggaataccacactcaaaaggacgatattttcgcaaccaatccaaatgtaattcgccaaaaagtttgatttcagtccagctgtttgcccccgacatcacggcactgacgacgagaaaaacgatgtctaaaaagtggtgtttttgattataggctcgtgggtcggataaattttcaaaaaaacgaaaaacgctcattttacaacctgatttgatatggataattaaggtgtattagatcataaatttgagaaagatgcgatcttgccctgtaccttaaggtaaattagcctacaaaactttgtttatataaaatgtgaagtagttcacatttttgtaattatatcggtcaaatattgattaaaattagctgaaagaatgatttttaaacaattaaccacaaaactgagaactgacaaataaaatcagagtcaaaggcaatacgaactcactgggtttgaaataagaaataatataaatcatgaatttagtaaggataatcaatgaaagcaacaatgaaaaaatcacttttaacctctttagtactcggattaggtgtgctttctgcgcctatggcggctcacgctacattgcctactgctgtaaacggacaagcattaccaagccttgcaccaatgttagaaaaggtacgtcctgcggtagtcagtattgctattgaaggtaaaaccaaagtatccgcaagacgtgcagttcccgaagaatttgaatttttctttggtccagatatgtttagagatggaggttctcctcgtcagtttaagggggaaggttctggtgtaattattgatgcgaagaaaggctatgtagttacaaataaccacgttattgataatgccgataaaattaccgttaaattagaagatggccgtgaatttaaagccaaattagttggggcagacccaatgtctgatgtggcattaatccaattagaaaatcctaaagatttaactgaaattaaaattgcagattcagataaattgcgtgttggtgatttcactgtggctatcggcaatccatttgggttaggtcaaacggtgacatctggtattgtatcggcattaggtcgttcaacaggcgatattgatgaagggtatgagagttatattcaaaccgatgcagcagtaaaccgtggtaactcaggcggtccattaattaacttaaatggagaattaatcggcatcaatactgcgattatttcaccaagtggcggtaatgcaggtattgcgtttgcaattccaagtaatatggcaaacaatcttgttcagcaaattattgagtttggagaagtgaagcgtggcttacttggtattaaaggcggtgaactcaatgcagatttagctaaagcctttgatgtcaatgcacaacaaggtgcttttgtcagcgaagtgatgccagaatctgcagcagctaaagctggcttgaaagcaggtgatgtgattacagggctaaatggtcaaaaaatccgtagtttcgcagaactaagagcaaaagtagcgactactggggctggcaaagaaattgaattaacctatttacgtgatggtaaagagaaaaatgttaaagtcacattacaatctgacgaacaaaccaaaacaagtgcgaaaagtttattaccaagtttaaatggtgctgagttttcaaactataacgaaaaaggaataaaaggcgttgaaatcactaaagttgaaaaaaattcactcgctgaggcaagaggatttagaaaaggcgatgtgattgttggtgtaaatcgtcgtaccgttgagaatttaggcgagttgcgtaaggttcttgattccaatccatctgccattgccttaaatattttgcgtaatggttcaaatttctatgtaatcattaattaaaaagttttgcgatactatcatttgtgatgaccgctagctaaagattctatactgattcagtatagagtctttagacttatctcacaattattgggttagaaaatataacctaagtataatcgggtactgtacctgaagtacgtcagtatttcattaataaggcacagtaccctagttctaatgagtagacttattggtaaatccaatatagagacagaaaagcagcccaagtccaaccccataaggtgtaaaggtggatatgcctgtacctgatgctgccagcgaaaagttatgagctgcagccgcacctaatagcattccgacaaggaaaagtgccgcatcattattaccttcacctaaatgcaccagttgtttacctgggcagcctcctgcgaaagaaaaacataagccgcacagtgtcatactcaggaagttccatacaacatcattatgggcaattggttgttgttcaaaaccaagtttgaactgacccagcattaggttggttatagacgtacataccaccaatgcaacaattccgtttagcagatagttgtctttggataagataaaattacggaatgcaccgattgaacaaaaacgagagcgttgcataacgataccgacaagcacaccagcacctaatgaaagccataggttggcatgttgggcagcaggggctttttcagagaagaaaatgggtaagttttcaccaaagcggaattgggtgatcagggcaataaacagggcgatcacaataaaaatagggactatgctggatgctgtactttgttcgccggacttaccgagcgaaaatccacgtttgaagaagaaaatccctgcaaaaacacccgcaagcagcccaacgataccaagtgcagcacctgcaaccacaggccaagttaagatgtttttcataataaggcccttgtgatatctgaaataaaataaattgtcattgcttaaaaaagctcagctattatacaagggtcgtgaaaagaggaaaagatgacttacattttatctaacacctatctcacattctaggtaaagccccatactaatttaaatgtgatcattcaaaaactcagtaaattcaatgataaaaaggcttagtgccgttttatagttcctgagcagttagaaatggggctttttattataatctccaattttgtctacattccaaggtgtctttattttataagtaacttcaaccgatacaacatctccaacgcctgtttcggtgtgagttcatcgggatcaatctctgcgagggcttgttcgactttggacggttcgataagcggtgagattggttcagcattttgcaaattcgccgaaaagagtaaatcttgctgttgatttgcgtctaattgtgccgtttgttgcgaaagtcgttcaagctgtgtgagtttctgtttcgcaagttggatcacctgctttggtacgcctgctagggcggcaacggctaaaccataacttttacttgctgccccttcttgtacgctgtgcataaaggcgatagtgtcgttatgttccaacgcatctaaatggatattggcaacgcctttgagctggtttggtaagctggttagctcaaagtagtgggtggcaaatagggtgagcgattgggttttcttcgctaaccattcggcacacgcccaagcgagtgataagccatcgtaggtcgaggtgcctcgcccgatttcatcaacaagaacaaggctgttttcgctggattggtgcagaatgttcgccatttcggtcatttccaccataaaggttgaacgccctgaagctaaatcatcagaagcaccgatacgggtaaaaatacggtcaatcggtccgatttctgcactgtccgcaggcacaaaactgccgatatatgccattaaagtaatcaaggcaatttgtcgcatataggtacttttaccgcccatattcggacctgtgacgatcagcaaatggcgttgtggattgagcagtacagggttggcgataaacggtgttttcagtacttgttcaacaacagggtggcgaccgcctttgatattcacgcctcgctgatggctgaaacttggcattacataattcaaactttcggcacgttcggcaaggttggtcagcacatcaagttctgctaacacaaagcttgccaactgcaattcacccaaacgtggtattatcagttcaaacagttcgtcataaagctgtttttcaagggcaagagatgcccctttcgctttcaataccttatcttcataggttttcagctcaggaataatgtaacgttccgcattctttaacgtttgacggcggacatagtggatcggagctttgtgagcctgtccttgactgatttggatatagtagccgtgtaccgcattgaatccgattttaagggtatcaatgcctgttttggctcgttctctcgcttctaaatcttcaaggaatttggttgccccttctgccaaacttcgccattcgtccaactcagcattgtagccttcggcgataacgccaccgtcacggataagttgcggtgggttatcaatgattgcttggtttaatagctcgaatagctcgctaaaatcggcgatctgctgcaaagtattgtctaaacaagcggtctgatgttgtgaatgttttacaatatcgggaatatgctctaaagctgtgcgtaaacgggttaggtcacgagggcgagcagtgcgtaatgcaacgcgagccaaaatccgttccatatcgcctacttgttgtagcaagggctgaagcggttcgatacgttcatttttttgcaatgccaaaatagtttgctggcgagtatgcagtttggctaaatcacgaataggttgatggatccaacgtttgagtaaacgactccccattgaggtgacgcatttatccaaaaccgatgtaagtgtgttttctgtaccgcctgccagattggtggttaattccaaatttctgcgagttgccgaatcaagtaagacagtatcgctattttgagccaaatgaatgctgttgatatgtggcagtgcggtgcgttgagtttcttgagcataatgcaagacacaaccagccgcacacaaggcaaccaccgccttttctactccaaaacctgtaagattttgtgtcccaaattggcgattaagcaactgaatggctgtaactagctcaaattcccaaacaggtcggcggcgtaagcctttgtaaccctgtaaaatacctacatcagaaaaatcttcaggatacaaaatctcggcaggttgggtgcgttgtaactcagcagacagtgcctctttgttaggtaattcgctaatcaaaaaacgcccagaagccatatctaatgtcgcaagggcgaaaacgcctttttcttgataaattgcggcgaccaaattgtcttggcgttctggtagcaacgcttcgtcgctgaccgttccaggtgtgataattcgtacgactttacgctcaacagggcctttactggttgcaggatcgccgatttgctcacaaatcgccacactctcacccaacgccaccaacttcgccaaataaccttcaacagcgtgatacggtaccccagccattggaattggttcacctgctgattgcccacgtttagtcagagaaatatctaacaacgcagccgcttttttggcatcgtcgtaaaataactcataaaaatcgcccatacgatagaacagaagaatatcgggattttgtgctttgagttggagatattgagccatcattggcgtgtgctgtaggaaattattttgatttttcattatgttattttgaatgttaaattagctatagaccatatctataatctatcctatgaatataggtaacatctttagcattgttaagatgtggaaaatcgcaacgaagactccaaataaggcaataaaccaaatcattggtgttccaccaaaagctttaaatccatatagtcttgttttttggcgttgtttatatattagtaacgcaggaataatacatgtccaaatagttgccacggctccagcatatcctattgcagtgataaatccaaatggaaagagtaaagataataggagaggcggtataaatgtggcaaaccaactttttgttctacctaatttatcgtttttgaattggaagagatctgctaaaaagtcaaaaactccaagtccaaccccaatgaaagaagataaaatagctgcgatagaaaatgcattgagtgcttgctttatacttggtgtatttattacattgcctaatgtatttaatagtacatcaatgtttccttcattttgaataacaggggtgaatttttctcttggaaggttgccaaatacgcaaccaatccatattagatagaaaaccagagcaatcatggttccataaattatggctttagatgctcttttttcttcaccgtagtatgccctcattgaggagactgaatgatggtagccaaaagaagtcagagctataggtaacatcatcatggtatactgtgcataagtattttgctctctattgacagtatcaaaaagataggaaaaattaatattagtagcaagcccccagatgctaaagatgaagctcaataccataaaaataattagaatgatggaaattctatcaacagctcgagttgagtgccaaactaatccgccgaagactaaaacgcaaataatagcagatagttgatttgtgatattaagcaaatcttgaaatagatatccaagagaggttatatatgcatatagcaaaatacctcccacaaagtagatagaaatgttgctaattatatttactttatttcccagtatatctttagtaactgtgttaaaagagactcgaaggtcataatttttatatgcttcaagtagcattgcaccagaaatcgtcataactatcattgtaattaacattacaactgcagtccatactgtccatgctcctgctccagcactcggtagtcctaacattccgccgccaacacatacacttgcaatgatacaggcaccgccaaaaatagatggttgcttttgcattaaatactccgaatgaaattaattacaaagaggcactatattctctaaacgccataaatcttcaaaacttgctctagctttaattaagtgagctttatcaccatcaaccatcacttctatagcttgtggacgtgaattgtaagttgaggacattgttgcaccataagctccggcagaacgcattgcaatcagatctccttcggtaattgcaagttctcgctgtttacctaaaaagtctgacgtttcacaaattggtccaacgacatcgtaaattgccttttcacgtacaagcgattggtttacttcaataatttgcatatacgcttcatataatgcagggcgaatcatatcgttcatccctgtatctacaatggcaaagcgtcgatcttcattttgtttaatatattcaactttagtgactaaaatacctgcatttgcagtaatcgctctccctggctctaaaatgatctcaaggtttgggtaggttcgaagtttatggagcaacgctgcagcatattccattgggtgtggcggtgtttcatccgtataagtcacccctaagccgccgccaagatcaaggtgatgcagttcgataccatcctgttttagctgttccataagcacaatcacacggtcagtggcatctaaaaatggctgtaattcggtaagttgtgaaccaatatggcaatccattcctgtaatttttacatgaggtaaggtagtagcaaaacgataaacttcacgagcctctttgacacttacaccaaatttattttcttttaaccctgtcgaaatataagggtgagttttagcatcgacatctggatttacacgtaatgaaattggggcaatcttaccaagttgtcctgcaacttcgttaatgcgttttaattcagaaaccgactcaacattaaaacaacgaatgccaacttctaaagcacgagcaatttctctatgcgtttttgccaccccagagaaaaccactttacttgcatccccccctgcagctaatactcgctctaattccccttgagaaacaatgtcaaagcctgagcctaaacgagccattacatttagcagggcaaggttagagttagatttgactgcgaagcaaattaagtgtgggtgatcaccaaatgccttatcaaaagcatgccaatggcgttcaagtgttgcccgagagtaaatataagctggtgtgccatgctgcgcaataatgtctgtaatggcgacatcttctgcgaaaagttgttggtttttatagtgaaaataatccatttaaaatatccttgttggatttacagcccgtagagaatcaggtgtaaataattccctgctcttccaacttcccaaggaaataaggcatttgcatacgccataaaggccagtcgtgtgccatatcgtgtccccagtagtcgaaccagccttgaatacctttgctagcaaaggcatcttgcagacgacgagtgtcttcaacatgttgagcttcccacgcaccttgtcctacggcaacgatataatgattttgacgataacgatctaagaaccagctatcgtgttgattccaaaggtaatcaatcggtgaattaatgtgaattgcaagatcgccgtaaaactcttttgtaaagaaacgagcatcgtaaacaccacttaaagcaattgcagtatcaaacaaatctgggtggcgtaatgcaaagttgatcgtatggtaagcccccatactgcaacctgttgcgatcattgctcccccccactgagattcgtggtgaattaacggaacaaattcattgatgatataacggtcgtaagcgttatgagcctgtgccatatcgtgtcccgatttccattctgcaagccaagattcgctgtcaaaagagtctggggtatagaatttacttaagccacgatcgataaaagaacggcaggcttcgatcataccaaaattgccgtattcgttttggttgccacctgatgatgggaatacgataactggtttgcctgcgtgtccatagacgttgaaatgcatttcacgtcctagttcaccactccagtggctacgtctttcaaagtgcattgattgttgtcctttatatatcagtagggacacactgcgtgtgtccgctactgtcaaattctaaaaatagagtggacacacgcagtgtgtccctacttgataattttccttaggaaaggaaaatatgagataaattactgcttctcttgggcaaagcgtgcaatttcacgcatttgttccattgtttcagtacgagccaaaataccgtgttcgcccataattttagcgaaaacacctggtacggtttgaacactgataatgttacccgcatatttttgacatacttcatcaatggtgtgtttgtagtttttattcgctttacgcgcaatataaaccacattccaagggtgtgtaatatttgagtagaatttgttctctttaacgatattcgcatactctctgaatacgtcaaaatcgtttgcatagttccacatatcaatggttaaaccacctggtggacgacagttgatttcaagtggcattaattcgccagttttcttcacacggaaatattcaaagtggaagaaacgttcacgaactttgaatgcgtccacacatttctgtccgagtttaactaaatcttctttgatttcgcgtggaatgtagtagaacatatcgttatctttttcgaccgtttctaataccacttcagaatactcaaggcttgagtagaacacgatattgccgtctttatcggttaaaccgtcaaaagtcacgatatcgccttcgataaactcttccataatgtattcaacgtgagcatttttatagccgaagaaagcttctaattcgtctgcagatttgattttgtaggtatcgctcgccccaacacctgagtttggtttgatgatcacagggaatttgagttctttagccagtttgcgtgcatcttcatcatctttaaatacacggcctttcgccacttttaagccagctttgcggaacacttctttcatctgatctttagttttgattgccaacatatcttcatttttatagccaggtacgttgaaatcggtacgcaattttgcgtctaactcaagccagtattcgttgtgcgactcaacacggtcaatacgaccgtatttatgcgcaaaataaccgaccgcacggtaaacttgctcatagtcttccatattatccacacgataatactcagtcagtgagttgcgtaagccttcgcttaattgctcgtaaggtgtgtctgcaattcccaaagtattaaacccactttcactcaatcttattgcaaaggtttcaaaattggttggaaagtgaggggaaatcatcacaaagttcattggtttggacatagttcttactctaaatttgaacaaattataataagaatgtgtaagcggtgagattctaatcgaaatttggaaatattgatagaataaatggcatttctatattggaattaatataaaaatgcctttaaaaatgttttaaatataaatttgctttaaaagcaaacccatgttatggaagcagttatttcaaacttcccaccatatcttcagggcgtacccactcatcaaattgttcagcggtcactaaacctaagttgatcgcttcttctttgagtgttgtaccatttttgtgtgcagttttcgcaattttcgctgcattttcataaccgatatgggtatttaatgcagtcacaagcattagagattgatctaattgctgtttaatgcgtggatagttcggttcaataccgattgcacagtgttcatcgaatgatacgcacgcatcgcctaataattgtgcagattgtaagaagttgtacgccattaccggtttatacacgtttaattggaagtgaccttgtgtaccagcaaatgaaattgttacatcgttacctaacacttgcgcacaaaccattgtcatcgcttcacattgggttgggtttactttacccggcataattgatgaacctggttcattttcagggattaagatttcgccgatacctgaacgtgggccagatgctaataaacgcacgtcgttagcgattttgtaaagtgaaaccgctaattgttttaatgcaccgtgagtttccacaatcgcatcgtgtgttgcgagtgcttcgaatttgttttgtgcggttacgaacggtaaaccagtgaatttcgcaatgtagtctgcgactttcacatcgtagccttttggcgtatttaaacctgtacctacagctgtaccgcctaacgctaattctgccaagtgcggtaacgtattttctaacgctttgataccgaaagctaattgtgctgcataagcagagaactcttgacctaatgttaatggtgttgcgtccattaagtgagtacgaccgattttcaccacatcttggaatgctgctgctttgtcagctaaagttttttgtaaacgttttacgcaaggaagggtatgttcaaccacttttttgtatgcagcaatgtgcatcgctgttgggtaagtgtcgtttgaagattgtgatttattcacatcatcatttgggtgaataatcgatttctcgccaagtttaccaccgtttaaaacgtgcgcacggtttgaaaccacttcattcacgttcatattagattgcgtacctgaacctgtttgccagattactagcgggaattgattatctaatttgtttgctaggatttcatcgcaggcttgagcgattaaatcacgtttttcagcagaaagtacgcctaaatcatggtttgcgtaagcggctgcttttttcaaataaccgaatgcttcaatgatttctttcggcattgatgcttctgggccgattttgaagttgttacgtgaacgttctgtttgcgcagcccaatatttatcagctggtacttgcacttcgcccatggtgtctttttcaatacggaatgtcattgttttctcctagtggaataaaataataaaatcaatgagtaaatcctagcattctaggaaaaagaaaggaatggaaattgctccattccttgtccgtttttttagtttttgtgatatggatcataaatccaatatggaattatattttatctagtattaaatcgctttcggagtccggcagcatacaaggcattatctgcatcattgagtaaattctgctttgttttgtctgaaatcgtatagatatattgtcgatttattgctccatgaagtcgaaataataaagcttgatcagcatcaacacctattttaaggaggttgacgaaaatatcaatctcgcccctatctactaaatcatcaatagagtagacacctagtttttttaatgtcctttcgagttgtattgtcatattcggcagcgtccgaatacattttttcttttccatatactgattttgtttcgtatggagaatatctttcacactttcgacgacccaatgtgaaacttgttgtaagtcattaagtagatcgggagggattaaatagaaggattttagattaatgccagtctgagagtcgagaagaagagataaatttttagctatgttttcctctaagcaatgatttggtatgtgtagatagaatttatcatctttgtataaagcaaacatagctttatctttcattattccataataggaaaaataggtttttgctttcgtttcgccaatgattgggtaaagaagattacggatatgttgtgtttttgcatcaatgtatttcatatacacctcaattaattatacatcttgattaggaaatgagcgttatttacactcaaataagataatcgcttttcagccaaataatgcaatgaaataacaagaatatttttgtgacactcgtcgaaaaatcagaaaaaaaaccaatatttagaataaaaaaacacctgcttgtttgaattttgagcttttcgtgtttgtaaatttatggttatttaaggctgttgggcaaatttcacttgcaaaagataaaagagttaggtagaatctcgccacttttgacatcgtagtctaagtcgcttggtgtaatcatttatcaagtggtattaccgatagggtagtacgtaacaatgtttccgatttggaaactataacaaggtatgactgtgcccccttaatttaatttgttaagcggtggttcagttttttattagctaaattttaatggagctctggtctaatgcagaaccaaagaatccgtatccgcttaaaagcatttgatcatcgtttaattgatcaatctactgcggagatcgtagaaacagctaaacgtactggtgcacaagttcgtggtccgattcctttaccaactcgtaaagaacgtttcaccgtgttgatttctccacacgtaaacaaagacgctcgtgaccaatacgaaattcgtacacacaaacgtttagtagatatcgtagagccaacagaaaaaactgttgatgcattaatgcgtttagatttggctgccggcgttgacgtgcagatcagcctaggttaattaagaggttattacaatgattggtttagtcggtcgtaaagttggtatgacccgtatcttcaatgaagacggcgtgtcagttccagttaccgttatcgaaatcgaagccaaccgtgtgactcaagttaaaactcttgaaaacgatggctatactgcagttcaagttactactggctctaaaaaagcaagtcgtgtaactaagcctgaagcaggtcatttcgttaaagcaggtgttgaagctggtcgcggtttatgggaatttcgtactgaaggtgaagaattcactttaggtcaagaaatcaacgtagacatcttcacagatgttaaaaaagtagatgttactggtacatcaaaaggtaaaggtttccaaggtggtgttaaacgttggaacttccgtactcaagatgctactcacggtaactctttatcacaccgtgtacttggttctattggtcaaaaccaaactccaggtcgtgtgtttaaaggtaaaaaaatggctggacacttaggtgctgagcgtgtaaccgttcaatcacttgaagttgttcgtgtagatgctgagcgtaaattattattagttaaaggttctgtacctggtgcaactaatagtgatgttattgttaaaccagcagttaaagcataagtctaggagatagagatggaattacaagttgtaggtgcgacagcactcagcgtttctgaaactaccttcggacgtgagtttaacgaagcgttaatccaccaagtagttgttgcttatgcagcaggtgctcgtcaaggtacacgcgcacaaaaaactcgtgctgaagtgtctggttcaggcaaaaaaccttggcgtcaaaaaggtacaggtcgcgctcgttcaggtgatatcaaatcaccaatctggcgttcaggtggtgtaactttcgcagcgaaaccacaagatcacagccaaaaagtgaacaagaaaatgtaccgtggtgcaattaaaagcattctttctgaattagttcgtcaagaccgtttagtggttgttgataaattcgaaatcgatgcaccaaaaaccaaagttttagtacaaaaattaaaagatatggcgttaactgacgctcttatcatcactgcaagcttagatgaaaacctattcttagcagcacgtaacttatacaaagttgatgtacgtgatgtacaaggtatcgatccagtaagcttaatcgctttcgataaagtggttatcactgttgatgcagtaaaacaaattgaggagatgttagcatgattcaacaagaacgtttgctaaaagtgcttaaagcaccacatatctctgagaaagcgacaaataacgcagaaaaagacaacacaatcgtattcaaagtagcattagacgctaacaaagtggaaattgcgaacgcggttgagcaacttttcgaagttaaagtagattctgttcgtacagtggttgttaaaggtaaaactaaacgtcacggtgcaaaatcaggtcgtcgtagtgactggaaaaaagcttatgtaactcttcaagaaggtcaatcacttgacttcgttgaaggtgcggcagagtaatttcggaggaatagaaaactatggctatcgttaaatgtaagccgacctccgctggtcgtcgtcatgtagttaaagttgttaatactgagcttcacaaaggtaaaccttttgcagcacttttagatactaaatctaaaacaggtggtcgtaacaacttaggtcgtatcactactcgtcacatcggtggcggacacaaacaacactaccgtttaattgacttcaaacgtaacaaattagacattccagctgttgttgagcgtttagaatacgatccaaaccgttctgcgaatatcgcattagtactttataaagatggtgaacgccgttacatcttagcaccaaaaggcttagctgcaggtgatacgatccaagcgggtgcttcagcgccaattaaagtaggtaactcattaccaatgcgtaatatcccagtaggttctactgttcataacgtagaattaaaaccaggtaaaggcggtcaaatcgctcgttctgctggtgcatatgtgcaaattatcgcgcgtgaaggtaactatgtaactttacgtcttcgttcaggcgaaatgcgtaaagtattagctgagtgttctgcaaccatcggtgaagtaggtaactcagagcatatgcttcgcgtacttggtaaagcaggtgcaaaccgttggagaggtattcgtccaaccgttcgtggtactgcgatgaacccagtagaccacccacacggtggtggtgaaggtcgtaacttcggtaaacaccctgttacaccttggggcgttcaaaccaaaggtaagaaaactcgtcacaacaaacgtactgataaattcatcgtacgtcgtcgtggcaaataattttttaattaattaaagaggataagccatgccacgttctctcaagaagggtcctttccttgacctacacttgttgaagaaggtagagaaggcggtggaaagcggggataaaaaaccaatcaaaacttggtcccgtcgttcaatgatcattccatcaatgatcggattgaccatcgcagtccataatggtcgtcagcatgttccagtttatgtttctgatgaaatgatcggtcataaattaggtgaatttgcaccgactcgtacataccgcggtcacgccgcagataagaaagctaagaaataagaggtaaaagatggaaactattgcaaaacatcgttacgctcgtacttctgcacaaaaagctcgcttagttgctgatttaatccgtggtaagaaagtttctgcagcattagaaatcttaactttcactaacaaaaaagcagcagctttagtgaagaaagttttagagtcagctatcgcaaacgcagagcacaatgacggtgcagatgtcgatgatcttaaagttgcgaagattttcgttgatgaaggtccaagcatgaaacgtgttatgccacgtgctaaagatcgtgcagatcgtattttaaaacgtactagccacatcactgtggtagtgtcagatcgttaatcagtaggagaatagcaatgggtcagaaagtacatccacatggtattcgccttggtattgttaagccttggagctctacttggttcgcgaatacacaagatttcgctgataacttagaaggcgatttcaaagtacgtcaatttttaaacaaagagttagcgaacgcgtctgtatctcgtattactatcgagcgtccagcaaaaagcattcgtgtaactattcacacagctcgcccaggtatcgttatcggtaaaaaaggcgaagatgttgaaaaattaagaaacgcagtatctaaaattgctggcgttcctgcacaaatcaacatttctgaagtgaaaaaaccagagctagatgcaaaattagttgcagatagcattgctgctcaacttgagcgtcgtgtaatgttccgtcgtgcaatgaaacgtgcggtacaaaacgcaatgcgtttaggtgctaaaggtatcaaagttgaagtaagcggtcgtttaggtggtgcagaaatcgcacgttcagaatggtatcgtgaaggtcgtgtgcctctacatactcttcgtgctgacatcgactataacacagctgaagctcacacaacttacggcgtaatcggcgttaaagtgtggatcttcaaaggtgaaattcttggtggaatggctgcagtgattgaatctgagaaagaaccagcggcacagcctaaaaagccagctcgcaaaggtcgtaaataaggagatcactgaatgttacaaccaaaacgtacaaaattccgtaaagtacacaaaggccgtaaccgtggtattgcgggcggtacagaagtgagcttcggttcattcggcttaaaagcaattggtcgtggtcgtttaacagctcgtcaaatcgaagcagcgcgtcgtgcgatgagccgtgcagtaaaacgtcaaggtaaaatctggatccgtgtgttcccagacaaaccaattactgaaaaaccattagaagtccgtatgggtaaaggtaaaggtaacgtagagtactgggtagccttaatccagccgggtaaagttctctatgaaatggatggtgtatctgaagaagttgcacgcaatgcattcgcattagcagcagctaaacttccgttcaaaaccacatttgtaactaagacggtgatgtaatgaaagctcaagaactacgtaacaaaagtgttgaagagctgaatggtgaattagtgaaccttttaggtgaacagttcaaattgcgtatgcaagcagccaccggtcagcttcaacaaacccaccagttaaaacaagtgcgtcgtagcattgcacaagttaaaactgtattaaccgaaaaggcgggtgagtaatgactgataaaattcgtacagtacaaggtaaagttgttagcgacaaaatggacaaatcatttgtagttgctatcgaacgcacagttaaacacccaatttatggtaagtttatccgtcgtacaacaaaattacacgtacacgatgaaaacaacgaagctaaattaggcgatgtagttgaagtgaaagagtgtcgtccactctctaaaactaaatctcatactttagttcgtgttgttgaaaaagcagtagcttaatcaacaataaaaattaaaacccctagcagaaatgctgggggtttttgtttttttcacgattgctaaatgtatctttttttttacatttatgtgttttccttaataaagtaaacttgtagcaaagctacatatttttatattaatatagagaattatttcaaaaatgttaactatatcacagatttttagtgtatttagtagtttaatgcgtttgtgaaaatatggagggggtacagctaattttcatatattgctatgttgtttttttgctgtatccgtaaattttaattatttaaagcaaagacgaaaaaatgaaaagaagattatctaaaaatgttaaatgcagttttgtaccttcattgatttttctagcattagcatctaatttgcatgctactacgttctggaaaagcgatttaaacgagaatctaactcatataactaaacgagtaggtcaggataattttacggtagctgaagaaggaagattatggcctggtataggtcctaatggagaggctcctggaacagtgcctctatattatagccgtattccagcaatgaccattacagatgataataaaatggttgttatgtatgatttaagatggaacagcgcatccgatcaagatagaatcgatccaggagtatccatttcagaagatggaggaaatacttggttaagtaaaacagcttggacatttaatgattctaaaatgcctttgcgaagagctatggatcctacgattttgtataacagtatagatggtagtatctatgctatgcatgggacttgggctacaggtaatggattttggtatcaagatcgtttcaactattttcaaaataatatttgggctacaaccatttataagtctatagatggagggaaaacttgggagaaaaatgctgaatttagtaaattaagtaaccccgatgttttttctaaagtaagtaaaggtccaaataacccagtagttagttttttaggaggtgttggttctggtattgtgatgcgtaatggaacattagtatttccaatacaaactgctcataattatggtattgcagcaaccattatgtattctaaagataatggaaaaacttgggaaatgccagaaacaacggatcttccagcaccgaatcaaagctctttagagaatatggtttttgagatggggaataaattaattatggttggaagggaggcgagagtaagaggaactcaagcagataaacgatgggcatactatacagaagatatgggtaagagttggcatgcttatgaacctgcgagttttggttctagtacagcccaaccaagtcaaggctcatcaatttatgttaccttgccaaacggtaggagagtattgctcgtttcaaaacctaatggtaataatgataactgggctaggggtaaccttgctctttatatgctagatgcaaaagatccacaacatgtatatgaggtggctattatcagacctggttctggaaatgcagcgggtgcaggttattcatctttggcttataaagagggaaatttatttgttgcttatgaggatgatggaaatattactgtaaaaaatttgacacaatatatgacagatattcaagctaaagcccttgaatggaatcttcctgatgaaattgaacctgatgttgaaaaaattaatgctttaatgcatttgaatcaggggcaaaaagacgaattgattgctaaacttcgtaggagcctctcccacaatttgtgtaaataactgtttctgagataatacattcagacacaggtattttattatgaacgaaaaacaacttcacgccttggcagcggaatttgccaaaaacctaaaaacaccagaagacctcaatcaattttcacggatgctcaagaaaatcaccgtcgaggctgcgttaaatgatgaactgaccgaccatcttggttatctaaaacgaaaattcagctttgcattgtgcatttagtgcgtaacagcttgaaattcgtttcgtggaaagattacaaagccgtcaccgcagatttaaagcaggtttatcaggccccgacggaagcacaggctcgcgaaaatctgaccgcactttcgcaaaaatggcaggcaaaatacccgcttgtggcgaaaggctgggaagataactgggcaaatattgccacattttttgattatccggctgacattcgtaaagcgatttataccacgaatgctgtggaatcgcttaatagcgtgattcgtcgcgtgattaaaaaacgaaatgtattcccgacggatgattcagttttcaaagtgatttggcttgcgattaaagatgcatcaaaaaaatggacaatgccgattcagaactggaaactggcgatgaatcgatttatgattgattttggtgatcgcctagacgatcaccattaagttgaaatgggtgtttacacagaatttgggatagggtccttcgtagggcaaatgataacgcaatagcacagtctaacgctcttgatcaggctatgtcagaattaaaactcaaaagctttgcattaagtcaacaagcggtttcttttgaaaaggctttaccatccaatcttaagaatttccaagatgcattagcatctattaatactatttcagaatctaagaatacaacaaatgtcaattatttaggtgttcatgatttatatgatagcttgtataccatgtttttagctttgaataatccattggactttaccaaatatattgagcaggctaagcatttaaatgaatacaaccatgatattttgtatcgctcctttgatgatgtttttgctcattatagtggaggttcaaaatataataagctctctttaggtggaaataagacggttagtgaaaaagttcaggctggattgttttttgaatatggcaataaacatcaaaaaagttatcatgttggtatgagagcaaaatatcaactggataatcatcagattgctggttttattcgttaccgtggcgtaaaacaccaagactttattgaacgtaataacaatgttgatctttatttgaactatgcttatcaacttagattgagtgaagatctgagtgtgagtccttcgtttggtacctatatttctcgttccaatagaacattgttagatcaggatgtcgctgttaataagagaacagtttatgctggagatgttggtgtgaatcttatgtataagataaatgatattaatgtaaatatccggccaaatattgcattcatcaatgacagtctgaaactatctcaatctaatgataagagtaatgtatataaaattagttcacataatacaatttatggattggcaactagtattaataaagctttttcaaatggattgaaagtaggttcaacattagaattgcaaaaatatggtagtcaatattctaatgtaaatttaggtgtagatatcagttatacttggtaactagaccctatcccaaattctgtgtaaacacccatttcaacttaacggtgatcgtctaagcgatcaccaaaatcaatcataaatcgattcatcgccggtttccggttctgaatcggcattgtccatttttttgatgcatctttaatcgcaagccaaatcactttgaaaactgaatcatccgtcgggaatacatttcgttttttaatcacgcgacgaatcacgctattaagcgattccacggcattcgtggtataaatcgctttacgaatgtcagccggataatcaaaaaatgtggcaatatttgcccagttatcttcccagcctttcgccacaagcgggtattttgcctgccatttttgcgaaagtgcggtcagattttcgcgagcttgtgcttccgtcggggcctgataaacctgctttaaatctgcggtgacggctttgtaatctttccacgaaacgaatttcaagctgttacgcactaaatgcacaatgcaaagctgaattttcgttttagataaccaagatggtcggtcagttcaccatttaacgcagcctcgacggtgattttcttgagcatccgtgaaaattgattgaggtcttctggtgtttttaggtttttggcaaattccgcttccaaggcgtgaagttgtttttcgttcataataaaatacctgtgtctgaatgtattatctcagaaacaggtatttacacaaattgtgggagaggctctcttggggagcgtgaatcattggaagatcaaacaatgaatataaaataatcaaagcggaaacaacatcggcaccaaaaatactgctaacagcattaccaaaagcgtaaacggtaatcctactttcacaaaatccataaaactatagccacttggtgcaagtaccatcgtattcacaggagatgaaacgggggtaataaaagaggctgaggctgaaatagcgacaatcattgcaaatggtactggcgaaaaatttagctgttgtgcgatagcaatggcaatcggcattactaaaattgcagtggctgtatttgagataaaggcattgatgatggcggtaaaaataaataacaccatcaacacaaaatgcacccctaagccttgcataatctcagtgagcatttgaacaatcagatcgatcccgcctgttttttgtaatgcaatggaaaatggcatcataccgacaattaaaacaatactcggccaatggattgattcgtaagcacttttcatatcaacacaacggaatttgcccaacatcaaacaggcaatcaaagccgcaatcacattcggcactaaccctgtaatcatcaacaccaccattgtgacaatcgaaaaaattgcgtgaggtgcttggctaatcgctggtgctgcgtgtttgctctcttcgggagctttgagtaggaagaagtcacggttattgtgatcgagtttgagcaaattattccatacccccataatcagcaaggtatcaccaaattctaacggggttgaaatcagattatcttcaatcaatgtatccccacgttttaacccgacgacacttaagccataggtagaacgcaatttaagttcactaatactttttccgatacttcctgcttcaggcataatcgaaaattccgccattccaacagattttgcgtgttctgagaaatagtcccctttcaactcaattatgcgtaaaccaaagtcctcacaccgttgcaaaaagcggtctaaatcaatattaatatccatcaacagaatatcttttccttgcaaagtttccgtgccataggcggcaatagaaagtgttcttaaacgtttaacacgttgaatagccacgatatttagcccatactcacggcggagatttaattcattgatcgtttttccaatcaatgatgagccagcatcgatcactaccattttcgctcgcccagttaaattatattccgcaataagctgttgcattgatgaaccatttttattttcagcacggacggtttcgccattatctaaccaacggcgagcaaaaagcatataaacaatccctagcaccaataccgaaacgccaatcggcgtaaaactgaagaaaccaaaaccttgatgtcctgttttaactaattcagagttagctacaaggttgggcggtgtcgcaattaaggtcatcataccgctaataagcccagcaaaactcaacggcatcattaagcgtttcggagaaatccccatacccgaacaaattgccaacaccacaggaataaaaatggccacaatccccgttgaactcataaaagagccaagcccggcaatagataacatcaacaacactaaaaccttaacttcgctttcccctgcaacacgcattagccactcactcacctgataggcaatccctgttcttaccagtccctcacccacaataaagagcaaagcaatcaaaatcacattcggatcacttaatccagcaaacacctcattgaccgaaagaatgccacttagactaaaaaaggcaataacgagtaaggcaacaatatccattcgtaatttattgcgaatgaactgccaaattgcaaatgccaataaggcaagcacccaaaacagtggcgataagagaaaatcagggagggaataaagtatcggttgcataagcattatcaaggaagttgaacaatagtttgattataccgattttcagaaaattaacagggagttttctcaaattccgctaaaaaatttggcatatctctattaggtgctctcgctagaatttaattggttatattgaagtgttcacaagagccctttgggcttttaccaacaaaattattaactttttcttaatagcatatgaaaatacattatgtcgcaaataatatcagggatatttatttctaaaagcataagaatgttaatttttttataaaaatgttaagtaaccgaaatttttgcagggtttacaggttggcaattttggtcaatctgcgtataattcggaagattttgattgcgtaactttagattagtttacacaaagaaatcgtttacttttttattaggttttagttaaaaatgtctgcggttcttcgacaaacgaaacaactttatcaaaaagcactcggtatcgagttaattctgctgttctgcatagcaggagcagtggggattgggttgggcttaaatcgctttatttcgttattattaggggaaattgcggcgttgcttccgcattgtgtgtttgtgtattgggtgttttttcgtcagtcggtaataaatccccaaaatatgaccgctttttatcgtggggaagggctgaaatggctcacgacgattgttgtgattgtagtggcatttaaaagttatggtgctatgcactatgtttcgtttttttgtgggttcttttttattattctttgtaatagtcttttgcctattgcattgaaatggcattcaaaataaatttcttttaatttcaaagggataagctatggctggtcaaacaacggctgactatattggtcaccacttatcgttcttaaaaacaggggacggtttttggaatgtgcatttagatactctgtttttctcattagtagcaggtgcaactttcctctttttcttctctcgtgtggcgaagaatgcaacagatggcgtaccaggtaaatttcaatgttttgttgaaatgattgtcgagtgggttgatggtttggttaaagataacttccacggtagtcgtgaggttgttgctcctttagctttaactgtgttctgctgggtgttcgtaatgaatgctatcgacttaattcctgtggattatccaccacaatttgctgcattattagggattgactatttgcgtgctgttccaacagcagacattagtgcaaccttaggtatggcgatctgtgtattctgtttaattattttttacaccattaaatcgaaaggtttttctggttttgttaaagaatatacgcttcacccatttaaccactgggcatttattcctgtaaactttgtacttgagatcgtaacgttattggcgaaaccgatttctcttgcattccgtttattcggtaatatgtatgcaggtgagttaatttttatcctgattgcagtgatgtatatggcggataacttcttgcttcaagcattaggtttgccattacacttagcttgggcgattttccatattttggttattacgttacaagcctttatctttatgatgctaacgattgtttacttgagtattgcttataataaagcggatcactaaacaaactggattggtgagcggttacttttatgcaaaaaattgcaatgattagaccgcttatgaaacccgatcatatttattgaaacttttttattaaccctagccataaggctaatttccttacttttatggagaacattatggaaactgtaattacagcaactattattggcgcatcaatcctacttgctttcgcagcattaggtactgcaattggcttcgctatcttaggtggtaaattcttagagtcttcagctcgtcaaccagaattagcaagcagcttacaaactaaaatgtttatcgttgcaggtcttttagatgcgattgcaatgattgcagtaggtatttctttacttttcatcttcgcaaacccgttcattgatttattgaaataagtcggatttgtttttaaccgtagttactcaagagtaacttagccgacttaaggagggcgttgtgaacttaaatgcaacactaataggccaactgattgcattcgcactatttgtgtggttctgtatgaagtttgtatggccaccgcttattaaagcgattgaaacgcgtcaagcaaatattgcagacgctcttgcaagtgctgagaaagcgaagcaagaacaagctgatactaaagttttagttgagcaagaactcgctaaagctcgtgaagaagcgcaacatatcattgatttagcaacaaaacgtcgcaatgaaattttagaatctgttcaagcagaagctgaagcagagaaagcgaaaattattgagcaaggttacgcagaagtggaaaacgagcgtcgtcgtgttcaagaagaacttcgtcaaaaagtggctgcattggcggttgctggtgcagagaaaattgtgggtcgttctgttgatgcagcggcaaacaatgacatcattgataagctagttgcagaattataattaaggggggcagatgtcacaattaacaacagtagctcgcccctatgctaaagcagcttttgattttgctttagaacaaggtcagttagataaatggcaggaaatgttacagttttctgcattggttgctgaaaatgaagatgtgcaacattttattcattcatcttctgcagccactcaagttgtcgatacctttatcgcaatttgcggtgatcaactcgatcaatatgggcaaaatttcattcgagtcatggctgagaataagcgtctttcggcgttaccttcagtatttgctagttttaatcaaatccgtgcggagtatgaatccgttaaagatgtgtttgttacatcagcaacacctttaacaaaagcacaggaagataaaatcgctaacgcgatgaaacaaaagctaaatagtgaagttcgaattacgacaagtatcgatgcgtcattaattgcaggcgttattattcgttacgatgatgttgtcattgatggtagtagtcgtggtcagttaaatcgtttgagccaagagttgtgcttgtaagaggaatagaaaatgcaactaaattctacagaaattagtgaattgattaaaaaacgtattgcacagttcaatgtggtcagtgaagcacaaagtactggtacaatcgtttcagtcagcgacggggttattcgtatccacggtctcgctgatgtaatgcaaggtgagatgattgcattaccaggcaatcgttatgcgattgctttaaacttagaaagagattcagttggtgcagtagtaatgggtccatacgcagatttagcagaaggtatggaagtgaaatgtactggccgtattttagaagtacctgttggtcgtggtttattaggtcgtgtagtaaacacattaggtcagccaatcgatggtaaaggtgaaatcgacaatgacggtttctcgccaatcgaagtgattgcaccgggcgttatcgaccgccaatctgttgatcaaccagttcagactggctataaagccgttgactcaatggtgccaatcggccgtggtcagcgtgagttaatcatcggtgaccgtcaaacaggtaaaacagcattagcgattgatgcgatcattaaccaacgtgattcaggtattaaatgtatctatgtggctatcggtcaaaaagcgtctaccatttctaacgtagtacgtaaattagaagaacacggtgcgttacaaaatactatcgtggtggtagcaagtgcatcagaatctgcagcattacaatatttagcaccttatgcaggttgtgcaatgggtgaatacttccgtgatcgtggtgaagatgcgttaatcgtttacgatgatttatctaagcaagcagttgcttaccgtcaaatttcattgttattacgtcgtccaccaggtcgtgaagcctatccaggtgatgtattctacctacactctcgtttacttgagcgtgctgctcgtgtaaatgcagattatgtagaacgtttcaccaatggtgcagtaaaaggtcaaacaggttctttaactgcattaccaattattgaaacccaagcaggtgacgtttcagcattcgttccaacaaacgtaatttcgattaccgatggtcagatcttcttagaaaccagcttctttaacgcaggtattcgtccagcggtgaacccaggtatttcggtatctcgtgttggtggttctgcacaaactaaacttgttaagaaattagcgggtggtatccgtactgcacttgctcagtaccgtgaattagcagcctttgctcagtttgcttcagatcttgatgatgcaacacgtaagcaactttcacacggtcaaaaagtaacagagttacttaaacagaaacaattcgaaccaatgtctgtggcacaattaggtttatcacttgcagcagctgaatttggttatttagatgatgttgaagttgagcgtgtaggttcatttgaatcaaatcttttagcttatgcaaatgcaaattatgctgagtttatgaaagatttaagtaaatcaggcgatttcaatgacactatcaaagcgaaattaatcgagattttagatagtttcaaaaagaatagtgcttggtaatctactttagcggagaaagaatatggcaggtgctaaagagataagaaccaaaattgcaagtgttcgtaatacacaaaaaattaccaaagcgatggagatggttgctgcatctaaaatgcgtaaaacgcaagaaagaatgtctgcatcacgtccatactcagatgccattcgtaaggtaattagccatattgccaaaggaagtattgattataaacatcctttcttaaccgaacgtgaagtcaaaaaagttggatttattgttgtttcaacggaccgtggtctatgcggtggcttaaacattaatttatttaaaaccgttttaaatgagttaaaaacacgtaaagataaagggggggattcagtcttaggattggttggaaacaaagcagtttcatttttccaatcaatgggggtggaaatcaaagctcaagtaacgggcttaggtgatacacctgcaatggaagatttagttggtattgtaaatggtatgattgaaaactaccgtaatggcgaagttgatgaagtctatattatttataaccgcttcgtgaatacgatgtcgcaaaaaccaacggttcaaaaattacttccattgccagaacttgaagatgacgatttggaaaataaaggttcgtgggattatatctatgagcctaatccaaaagtgttgctagatagcttacttgttcgctatttagaatctcaagtttatcaagcgatcgtagataatcttgcatctgaacaggcagctcgaatggtagcaatgaaagcagcaacggataacgcaggtaatttaatcaatgagttacagttggtgtataacaaagctcgtcaagcaagtattacgaatgaattaaatgaaattgtcgcgggtgccgcagcaatttaacaatgaatagaggaacggtaatggcaacgggaaaaattgtacaaatcatcggtgcggtaatcgatgttgagtttccacaagatgcagtaccaaaagtttatgatgcattaaaagttgaaacaggtttaacccttgaagttcaacaacaattaggcggtggcgtagtacgctgtatcgctcttggtacatctgatggtttaaaacgtggcttaaaagttgaaaatacgaacaaagcaattgaagtgccagtgggtacaaaaacgcttggtcgtattatgaacgtattaggtgagcctattgatgaagcaggtcctatcggtgaagaagagcgttggacgattcatcgtgcagcaccaagctatgaagagcaagcaaacagcacagaacttttagaaacagggatcaaagttatcgacttgatcgctccgtttgctaaagggggtaaagttggcttattcggtggtgctggcgtaggtaaaacggtaaatatgatggagttaatccgtaacatcgcaatcgaacactctggttactcagtattcgcaggtgttggtgagcgtactcgtgaaggtaatgacttctaccacgagatgaaagactctaacgtattagataaagtatcattggtttatggtcagatgaacgagccaccaggtaaccgtttacgtgttgcgttaaccggtttaaccatggcggaaaaattccgtgatgaaggccgtgacgtgttattcttcgtcgataacatctatcgttatacccttgcaggtacagaagtatcagcgttattaggtcgtatgccatcagcggtaggttaccaaccaacacttgcggaagaaatgggtgttctacaagaacgtattacgtcaaccaaaacaggttctatcacctcggttcaagcggtttacgttcctgctgatgacttaacagacccatcaccagcaacaacctttgctcacttagactcaacggttgtattaagccgtaacatcgcatcattaggtatttaccctgcgatcgacccgcttgattcaacatcacgtcaattagacccactcgttgttggtcaagagcactatgatgttgcacgtggcgtacaaaaaacgcttcaacgttacaaagagttgaaagacatcatcgcaattcttggtatggatgagttatcagaagatgacaaattagtggttgctcgtgcacgtaaaattgaacgtttcttatcacaaccattccacgttgcagaagtgttcaacagcgtaccaggtaaatttgtaccattaaaagaaacaattcgtggtttcaaaggcattttagcaggcgaatatgaccatatcccagaacaagcgttctatatggcaggttcaattgacgaagtggttgaaagagccaacaagatgtaattgttctttgaactaaggagaacaaaatgacatcatttgaactcacagtcgttagtgcagagcgtaaaatctttgaaggtcaagtaactagtgttcgagtttcaggggtagatggggaattaggtgtctatgcaggacacaccccactattaaccgccattaaacccggcatggtcaaattcactttggaagataacaaagaagaatatatctatgtttcaggcggattccttgaagttcaaccaacggttgtgaccgtgcttgcagacgttgcaattcgtggtgaagaactcgatgaacaacgtatccttgcagcaaaacgcaaagcagaagaaacaataagcaaaacaaatgaagcggatatgaccgccaaattagctcgcgaaattgctaaactgcatgtttacgaactcactaaaacgaaattagcgaatagacgttaattttatatacagaaacgccttaatatgtttatattagggcgtttttatttctcagcaatttataaaggctcactatggcaacaatgaaagatatagctcgaattgcaggggtttcactttcgaccgtttctcacgtcgtaaacaattcccgttttgtcagtgaagaaattactttaaaagtcaaaaaagttattgaggagctaaattatcgcccttctttggtagcaagaagtttgaagatcaaggaaaccaataccattggtatgattgtgacgactagcaataatcccttttttgcagaagtagttcgtcatgtggaacgttattgcgaacgccatcattatcacctgattctagttaataccgacggcaacagccaaaatttacagcaacatctagagaggttgttattaaagcaagttgatggcttattgctgatgtgtgcagaacctcaaaattttgacttaagtgcgattacccatttaacactcccgatggttgtgattgactggtggcaacaacctttaaatgccgatatcattcacgaaaattcagaactaggcggttatcttgcgacaaaagcattaattgatgctggttatcatgatatagccattattaccggtgaactttcaaaaccgttggctcaaaaccgtttagctggctacaagcgggtacttttagagaataatttgcaaattcgccccgaatggattattgaaagccatttccattatgatggggggattgaagcaatgacaaaattgttagctttaccttcacgtcctaaagctgtttttgcgatgagtgacagtattgcgattggtgcatatcaaatgattcaacgagcaggattacggattccgcaagatattgcgattatcggttacgataatatcgaacttgctcaatatctttatccccctctttctactattcatcaacctaaagcccgattagctaaagctgctgttgagaaattaattctacgtattcagcaaccacaaacggaaatagaaacgatcaagctaacccctgaattaatcatacgggaatctttttaaacttattttttgaagtagttcacattttcaaaataacatagttgtttttttattattttttgtctatcttttagtcatcgaaacgtttcgatggtttttaaaggacggtttgtgatgaaaaagacaacaatcttaaatgctcaactttcacatgtaattgcaacaatgggacataccgatggactcacaatttgtgatgctggtttaccaattccaacagagcagcattgcattgaccttgctttaaccaaaggtatccccgattttctttcagtcttacaagcggtatcaagtgaattatttattgaaaaaattgtattagctgaagaaatcaagaatattaatcctcaaattgaacaacagttattaatggttattcaacaaatagaggtgcaacaaaaaaataccattaagattgaatatatcccacataacgaatttaaacatcaaagtaatcaagccaaagccgtcgttagaacgggagaatgtagcccgtatgcaaatgttattctttattcgggcgtaccattttaggtggatatgatgaaaaacttactcaaaattagtggaatagataaagcctttcccggtattcaggctcttaaaaatgcttgcttgaatgtctatgcgggtagagcgatggcgttaatgggggaaaatggtgcgggtaaatccaccttaatgaaaattctcaccggaatttatcaacgtgatgccggtacgattgaatatctggggcaagcagtgaaatttgctaatccgaaagcctctcaagaagctggattgagtattattcaccaagagctaaatatactcggtaatctctccattgctgaaaacatctttttaggacgtgaatttacgcacccttggggcggtattgattggcgtaaaatgtatgcggaatccgaccgcttgttagctcgccttggtgttcgtcattccagtaaacttcctgctggtgagctttctatcggtgaacgacaaatggtagagattgctaaagcgttgagttttgaatcgaaagtgattgtgatggatgaaccaacggatgcgctgacggatacggaaacagaagctttatttgcggtgattcgtgagttgaaagcggaaggtcatggtattgtctatatttcccaccgcattaaagagattttccaaatttgtgatgatgtgactgttttgcgtgatggtcaattcattggagaaaaagcggttaccgatttaactgaagatcagttgattgaaatgatggtcggacgaaaattagaagaacaatatccgcatatcgacaccgatcaaaatagtgtacgtcttgaagtcaataatttgacgggaagtggtgttcatcaaatttcatttaacttgaaaaaaggcgaaattctcggtgtttctgggttaatgggcgcagggcgaaccgagttaatgaaagtgctttacggcgcattgcctcgtacatcgggttcagtcagattagatggcaaagacattcataaccgtaccgcccaagatggattagataacggcattgtttatatttccgaagaccgcaagggggatggtttagtgctaggtatgtcggtgaaggaaaatatgtctttgaccgcattagcccatctttctcattacggaagaattgataaagctagagagaatatggtcgtcacggattttattgatctgtttaatatcaaaaccccaaatgcagataaagtcattggtgaactatcaggaggtaatcagcaaaaagtagcgatagccaaaggattaatgacccgtccaaatgtgctgattttagatgaaccaacaagaggcgtagatgttggagcaaaaaaagaaatctatcaacttatcaataaatttaaagcggaagggcttagtattattttagtatcgtccgatatgccagaagttttaggcatgtccgaccgtattttagtgatgcgagaaggtcgaatcagcggtgaatttagccgtcaagaagcgacgcaagagaaattattggcggctgcaatcggtaaaacaagcggtcagatctcataggaaatttgcaaatgaataaatcgtttaacttcactaaatttttaatcgaccaacggtcgatcattgcattaatcacgatgattgtcgtggtgtcatttctaaatccggatttttttactacggataacttgctcaacattctgcgccaaacctcggtgaacgccattattgcgattgggatgacttttgtgattttgattgccggtattgatttatcggttggttcagtacttgctctgacgggagctgtggctgcaacattagttggaatagatttacccgtttatgtcgtgattcccaccgtactgatttttggttgtttaatcggtttacttaatggatcgctggtggcatttggtaaagttcaagcctttatggcaactttgattacgatgctgttattgcgtggtgtaacgatgatttatatgggcggtcgcccgattagcacaggtttttccgataatgctgatgctttcgccgaaatcggcacagggatttggctcggtattccagttcctgtttggttgatgtttgctttatttgcattaggttggtttgtactcacacagacacgtatgggacgctatatttatgctttagggggaaatgaatcggcaaccgtactttcaggcattaatgtgaataaggtgaaactctttgtatttgcggtcagtggtgtattggctgcccttgctggtttgatcgtcacctctcgtttaggctccgcccaaccaaccgcaggaacaggctatgaattagatgcgatagcggctgttgtagtgggtggcaccagtcttatgggcggtaaaggccgtattatcggcacgttaataggtgcattaattattggtttcttgagcaatgccttgaatttattagacattgactcttactatcaactagttgcgaaagcactagtaattttagctgcagttatcttagataacttcataggtcgtaaaaaagtctagttgttctaagacattattcttcattacataggagatttttatgaaaaaattaacttcattagcgattgcattaggtttagcattcagtacatcagcaatggcaaaggaaactatcgctctggcaatttcaaccttagataatccattctttgtgaccttgaaagaaggtgcagagaaaaaagccaaagaattaggctataacttagttgttttggattcacaaaatgacccagcgaaagagctgtctaacgttgaagatgtgactgttcgtggtgcaaaagtgttactgattaacccaaccgattctgaagcggtaggtacagccgttgcggtagccaataagaagaatattccagttatcaccttagaccgtggtgcaaataaaggtaatgttgtgagtcatatcgcctctgataacgtggcaggtggaaaaatggctggtgattttatcgctgaaaaagttggtaaaaatgcaaaagtaattcaattagaaggcattgctggcacctctgctgcgcgtgaacgtggcgaaggttttaaacaagcggtagaagctaaccaatttgaactgcttgctagccaaccagcagattttgaccgcactaaaggtttaaacgtgatggaaaacttacttgccagccacggttctgctaaagcggtatttgctcaaaatgatgagatggcattaggggctttacgtgcaatcaaagcatcaggcaaaaacattttagtggttggttttgacggtacagacgatgcagtaaaagcggtgaatggtggacaacttgcagcaacaattgctcaacaaccagaaaaaattggtgagttaggtgttgaagtagcggataaagtgttgaaaggtgaaaaagttgaagcacaaattccggttccattaaaagtaatttctaaatagtttgttggtaggggcaaatgacatttgccctattttcatactagtggcgaaagatatttcgcctctatatttaggagtagttatgaaaaaactctgtgttctcggtagtatcaacgttgatcacgttattcgtgtgccttattttccaaaagcaggcgaaaccttaacaggttacggttatcaaattgcttatggtggaaaaggggcaaatcaagcggttgcagcggcaagatgtggtgcaaatgttcactttattggtgcaattggtgatgatcaaattgggaaaacaatgaagcaagcctttgaacaagacgggatcaatacagaagcaatttctgttatggaaaaccaatcaacagggttggcgatgattcaggttgccgatttgggtgaaaatagcattgtaatttccgctggcgcaaatgcggatctttcagaggctttagttgaacaacataaatcacatattgaacaagcggatattttgctaatgcagttggaaagtccgttacaagcggtggctaaggctgcaaaaattgccaaaaaagcaggggtaaaagtggtgttaaatcccgctcccgctcaacctttaccagacagtttattatcacaaattgacattatcaccccaaatgaaacagaagcggaaatactgactggaattaaagtgaccaatgagcaaactgcagctgtagccgccaactattttcatcaacttgggatcgaaacggtcttaattaccctaggctcaaaaggtttgttttatagcgaaaaaggacaaggtgaaattattccagggttccgtgtcgatgcagtggatacaacagccgcaggcgatacatttaacggagcttttgtgacggcattactagaaggaaaatcacctaaagaatctattcgttttgctcacgcagcagcggcaatttcggtcacaagaatgggagcacagacagcaattcctagacgcgaggagattgaggcgttcttattattttcaatgtaacttaaactactatgttggagtttttcttaactggcagtttgtgaatgacaatgcggtttgatatttgcacttaacgagtcgagcggctgcgatttgttaggtatagcgttaattttatctctctattgaaatacattgacgagcatttttaatcacaatatagtgtcgatagagaacaaagttgttttgcaaacaaagatattagaaaaaataattaaggtcataaaaatttttattgatatttctttttcttatggtattttaaacagcgtctcagacacttttttatttgtagttattattttaagaggattagccaatgtcaaacaccaacgccattgcaaacgttgcaaaactcattcgagagaatgatattaaatttgtcttactgaaatttaccgacattaaaggtaaagaacacggggtgtcaatgcctgtttcccttgttgccgatgacctcgaagacctttttgaagaggggcgaatgttcgacggttcctcggttgaaggttggcgagcgattaacaaagccgatatgctgttaatgccaattcctgaaaccgccgttgttgaccctttcgcccgtatcccaaccctcactatccgctgcagtatcttcgacccaaacacaatgcaaagctatgaccgtgacccacgttcaattgctattcgtgctgaaaactatctaaaatcaacaggtattgctgacagcgtaatgtttggtccagagcctgagttcttcctctttgaggatgttcgttttagcactgagatgaacaatgtgtcttatcatattgatgatattgaagcggcgtggaacaccaaccgtaaatatgaagacggcaacaatgcgtatcgtccgctcaaaaaaggcggctactgtgtagtagcaccaatcgacaccgctcacgatattcgttctgaaatgtgcttaattttagaagagatgggcttagtgattgaagctcaccatcacgaagtggcgacagcaggtcaaaatgaaattgcaagccgtttcaatagcttaactttaaaagcagacgaaacccaaatctataaatatgtggttcaaaacgttgcccttgaacacggcaaaaccgcttgctttatgccaaaaccattcgcaggcgataacggctcaggtatgcactgtaatatgtcgttaagcaaagatggcaaaaacgtctttatgggcgataaatatgcaggcttgtctgaaactgccctttactatatcggcggtatcatcaaacacgctaaagcattaaatgcgtttactaacccaaccacaaactcatacaaacgtttagtaccgggttttgaagcacctgtattattagcttactctgcaagtaaccgctctgcgtctatccgtattcctgcagtaactagcccgaaagcaacccgtattgaagcacgtttcccagatccaatggcaaacccatacttatgttttgcggcgttgttaatggctggtcttgatggtgtgattaacaaaatccacccaggcgatgcaatggataaaaacctctatgacttaccaccagaggagttaaaagagatcccagcagtgtcaagttcattaggtgaagcgttagataacttggaaaaagattatgaatttttaacccaaggcggcgtgttcactaaagagtttatcgatgcctttattgcaatgaaacgtaaagaagttgagcgtttgaatatgaccccacatcctgtggaatttgagatgtattacgcttagccttaaaagttaggttcagaaaataaaatagttgctgatgaatactttaattattcttagcaactatatttttatttaaagaatcctttataaatatagtgttatgtatcttattgtttttgcgtgatgaaataatttttcttcatttgcctaaataaatgttaaaaaacgatttagtgttttacatatcaagaatgtaatcatcaatagagtttttttgaacgctattagatagtcattcccaatctttattagagtaggataaatattacatttataaagtttgatattacttttggggctgacgtagattagccctaaatttcacaccattttctcaatgttttaagttgctcttttggtgttccaaagttaaaccgaaattcatattctttcaagaataaagggaaactttttcggtcaattacattatattttcggagtatccgcttagcttgactccaaaaattctcaatgccgttgatgtgattttgtttcactgtaaacagctccgaatggctaattcgttcgtggtgaaattcgcttacatcaagggcatcataactacgataagtatctgtataaacccagctgtcgggcttgattttccttgatataacaggcattagcgttgttgtcttcgtatcattgactaccacagtaaatacttttccttgccgtttcaatatcccaaagacagccacttttcctgccgctccacgacctcgttttcctttacgatgtccaccaaaatagctttcatccaactcaatttgtccgtcaaatacttcatccacttcaagtgctaaatgatagcagatgacctcgcggattttgcggtaaaacagtgcagcagagttagcatttatctctaacaaatttgccgcagaacggacagtgacttctaatacaaaaaattcaaggagattttttgtatggatttctttaatttacaatgagttatcttcatttttgtaggttagcatactagctaatctacgtcagccccaaaaatattgctctcccaaccgcgcttcacgctcgccatttaccacaatgcaaatactcggctcttggtcgccatttacagaaacttggttagcgataaagttgttacttgtcgtggtctatatcgttttcggtgttgtggcacaaaaaaacattcgcaccccaaaagggttcgcgttttacagcttgtcgctactcgcttttttaacaatggtgttgctatcgctttgcaaaataggctaagacgtacaccgaacttattaaccaactgaaataaaaggaaataaaatgaagattttttacaaaacctgttgccacagcccctggacaaagtgcggttacagttacgccaaattctgccacttcttcggcaatggcttggctgaaagacgtgacataggcttttgttgcataataaaccgcttgtaatggaccaggtaaaaagcctgccgttgaagaaacgtttagaattttaccacagcggcgttccaccataccttttaagtaaaaatggcttaactcggttaaagtggtgatgtttacttggatcatttgttgttctttggctaaatcacgctcaaaaaagcgaccgtgtccgccaaaacctgcattattgattagaatatcaacggtaatgccctgtgcttccgtctgtgcaaaaatcgcttgtgccgcattaggttctgataaatcttgggcgataacggtggctttaataccgtatgtgttagctaagtcgtgtgctagttcggccaatttctcttttgaacgtgccaccaacaccacatcgccgccttttttggcgtgaatttttgctagttccaaaccgataccatttgatgcacctgtaatcaatgctgtttgtttcattttttatccttcattgtctttgctttcgatgaagtgtattattccgtaaaataccagtatgaaaaaggtaaaaaagggcttaataatggcaaaaataggaaatacacaagcaatccccacaccgcaatcggcacttgaaatttgtctatttagtgaatttaaccaaagcaatttgcacgctgatgaattaacacgggaaatgctcgctgagcaacatcgctttgatttttatgtttggctgtgggtaacagaaggggaatgtcagcatttgcttgatttccaaagcgttacgcaacgcacaggcgaatggttgctgatccgcccacagcaagttcaccattttcaaacaatggaaggttgggacggttggggattatcttttccagccgaatgggtttctgctgatttagcctcaatttggcaacagctgccacaaaagcaatctgtaaccgccgagcaagcccctttgctgcaactggcgttacaacagctcaaacaatatcgctactttgaatggcaagggcaaaattatcagctcttattacaaacgcagttacacacctttctgaccttgctcaacaccctttatgctgcaaatcagccacaagaagaccaccaaaatcaacgttggcaaggtttttctcagctattggaacaacatttttgcacgcaacatcaagtccaattttatgcggaacaactcggttgcacagaaaaaaaaaacgctcggctcaacctgtttagcacatacggggctgcctgccaaaatggttatcaaccaacgtttgctacttgaagccaaacgcctactggtgcatacccaaaaatccgtgaaacacattgcgttacaactcggttttgaagaagctactcactttaataaattcttcaaaaaatacgaacgatgtacgccaaaaggctttcgggaaagctatttagcggaaaaataaaagagcggtggggttttcaggaaattttgcaaatacaaaacttatgaaaatcccacagctcttctacaagttctatgacaactgttttaaataatcttccaacccttgaacttccccatacaacaactggctcggcacaatatgcaaccgttgatcgttatcccacgcatagcgggcgaaatcggcgtccattttacgaccgctttggtaaaacagccccgttggcacaagtgcaagcggatagatttcattgagtttttgcaatgttgctgacgcaccataacaccagccgcaaaggggatcgaataaataataaattttcattaaaacattccacgtccgctttctgttttttctggtaccgcttggattacgtcccaatgttctacaattttgccgttttcatcgaaacggaaaatatccaccaccgcttcgcctttatctttttcattgagctggctgtgaacgtgtaatgctactaaatcgccgtccgctaatacacgtttaactgttgctcgcgaagttgggtgttctttcaaaaacggagcaaaagcatcaataaaggcttgaccaccatcggctacacttgggttgtgttgcaaatactctttgccgatatatttatccactgcgtcttgtaattgatgttggttaaacgccatttcatagaacgccaatgcattcgctttattttgctctggcgtagtttgtgccattgcaacggttgatgagaaaagtgcagttaaaagtaaaagtaattttttcattttgttttccttttgttggattatacattcagcttgattgctattgatggcgtgcattttaatgaaataaaaagagagaaaaagtgcgattttagaatataattatttccgattaagaaacaaaaaggataactatggacaaactcaccgcaatcaaggtctttctgaccgttgccgaaacaggcagttttaccgctaccgcagaacggttagagatttccaaaccgatgattagccgttatgttgctttaatggaagaatggctgaacgcccgactttttcagcgttccacccgtaaagtcgccctaacagatgcaggcgaacaagcggtgcttttttgtcaaaaaattgttaatttaaccgcagagatggaacaagaaatgatggcacagcagggtgaattacatggtttattacgtattaccagtagccaaagttttggggcatatcatttgatacaaacggtcaatcgatttttgcagttgcacccgaaattgaatattcagttgttgctcaatgatcaacaaatggatttaataagcgaacggatcgaccttgccattcggattaccaacacgcccgacccgaattttattgcccgaaaacttgctgattgccattcattgttggtggcaacgcctgaatatttgacaaagttcggtacgccaacgcagcctgaagatttgtatcaacatcactatttgtcgcaccataacatcaaccgcaaagcgtggaaatgtacgcaaggggaacaggaagtgttgctcgacctaaacagccgtttcaccaccaacgacacccaagccctgctcaactccgtgctggacagcaacggcattgcgatgttaccgaaatatatgctagaaactgaactgaaaaggggcaaactgcaagccgttttaactgactggcaactgccgacattcagcatttatgcgatgtatccgtcaagggacaaactcccccttgccgtaagaaaattgattgattttttgctggagagttttgaagggaaagcatggtagagttaaatttggttatttatttagcactcctgctttcccattacttatggtactgtttttacgtaattatcaacagtattccgaaaaataaatctttctataataatcattacaagaataataggtgatggaatttctaccattttttccccaagcggttgaaaatatgactgtattttcgctattttcacacataatatttggggctaatctatgatctgcccccaaaaagttagactgatttagttcaaggactgagttctgtattccacagggcttagtcctttcaatcttacttgaatacgctcatgattgtaataatgaatatattcgtgaatagcttgttccagttgctcaaaggtctcaaaccgtttaccaaagtaacattccgtttttaaacgcccaaagaaactttccattgcactgttatccaaacaatttccctttctcgacatactttgtacgatgccactttgcttcaatatcgactgataacttaccattttattgtctttttcagcaagatgataaaagaacgtactccgttttaaatcaaccaattgcaataaaatctcaaacggaaattggtggcgtagttccttcacgaggtgtgattatactgattaatccaatatcttaatatggtttccttaacctgaaaatgctgacgagttaatgaccgaattctattattttgaagataaaattcgatcacttgttgtttaaaagattgagtgtatttagccataaaaatctgcaccttaattagttggttgtttagtccaacttttggggtgcagatcatttcgctcccccactttcccaatacttcccccataaatgaggggaagtattttctcataacgccactctacaacactacccccccccacccatccaattcttcccccgcttgcgggggaaggtgcccgaagggcggatgggggcgaatatgggtgcttttcgattgttctaaaaagatttctcgttaaaactaaatagcgtagaatggtgtcatttatcactacatgccttgataatcatgaatccactaaattcgctacaattagctttaaatcaatctagccttattgaagcctctgcaggcacaggcaaaacctatacgatggcaaatttgtatttgcggttgattttaggtgttcggtgtccctccccattgacagttgaacaaatcttggttgtcacctttaccaaagccgcaacccaagagctacgagatcgaattagggaaaaattggtcaatgtgggaaaatggtttcgagatccctcttctaaagaggctcaagatgcgttacgagaaccattccttgcggagctttatcaagaagttcaaccacgtttaaatgaatgcctcttacgcttaagcattgctgaacgcgaaattgatttagccagtattttcaccattgatagcttctgtcaaaagatgttgtttcagtttgcgtttagctctggcattcgttttgatattgatttattgagcaatgaagatgaattattaactcgtttgagtgaagaaacttggcgtgaactattttatccaatgggacttgcagaaactgtcgccgttgctgaagagttaaaaacgccttctgacgcattaaccgcagtgaaaggttatctctatggcgattttccagatttagcggcagaaaaccaatggctgacacaaggcatttcaagctatctcgccgattatcaagccttgttacaagaagctaaacaacattggcttgccgtgggggcggaagcggaaagcctgattgtgactgagatcaacaaaagctacaaaaaaggcgaaaagaaatcgctcagccgccgagcttatcaaatgcgttggattgaaaattggctgaaagagctgaacgaatgggctacaagcggtagccattattttccaaccaacagcctctctcgcttttgtcaggattttatcaatgaaaaagcggaagaaggggcagaaccgcttacccacactatttttgcaaaaaatcaagattatcttaccgcttaccaaacacagtttgaaggcaaatcaaaagcgattttcctctatcaattcttcagccatctacgtcaaaaacttgccgattataagcaaacccataaagagaaaagttttggcgacatgttgagctttttgctttccgctttgcaatcagagcgtggggatacgttagcccagcaaattagagccttgtatccctttgcgatgattgatgaatttcaagatacgaaccaacagcaatatgaagtgttccatcgtatctttatggatcaaaataccagcgagcaaggttttattatgattggcgatccaaaacagtcgatctataaattccgtggtgctgatattttcacctatttaaaagcgaagaacgaggttcaggaacaggcaacacttgaccgtaactggcgctctgtgcctgaagtggtggagagttgtaatcgtctatttcagtttccagaaggagataatcctccatttttatatcacggtattccctttcagcccgttaaagctaaagaggcttcagatacattagtgggtgaacaagcgaccagatgtctattaatcagcacggagtttgatgaacagcttgcggccactcactgtgcttatcaaattcaacaacagctgaaaaaaagtgagcaagggttgctctttgtgcaaaaagaggagggaaatagaccgcttgaagccaaagacattacgatccttgtgcgtagccataaacaagccagtttaatccgagcagaattattaaaacgccatattccatcggtctttttctctgaacgaaacagtgtctatgaaacccaagaagcacaagatttacgcattattctttctgcgtgtttaaacccttatcgtcaatctagcttgctttcggctattggtacatcgctttggggtttaacatcgaccgacatttttaatatcaaacaagatgaaaaagcgtgggataatgtggtggaaagctttgttggctatcaacaagtttggttacatcaggggattttaccgatgttgcaccaaatttttgtgaaagaaaatattatccaacggatcaatgccttaccgaatgcggaacgtcgtattaccgatctgttgcatttagccgagttgctacaaggggcaatgccaaatttagagaacgagttcgccttgctacgttggtatgaacagcaattagacaatccagatggctacgccgatgaacaaaaacagcgtttagagagcgaagagagtttggttaaagtggtgactatccacggctcaaaaggcttggaataccctgtagtttggttgccgtttgtggctaaagcaagccaacctgccaaaagtaaaccaataacaatctatcaaaatgacgaaggcaaggctcactggagcttcggctcacaatccgacgaaatcaaaaaatatattgataaagcagaatttgcggaagatttgcggttgctctatgttgcggtcacacgggcgaagtatcagctaaacctgattttaccaagtcaatttgatgaaaaatggaatagtctaagctatttgttaagcaatggtgagattggaacaggtggcatcgccccaagccaaaatactcaatattatttagcacagaaaggcattaaagcggagctgattacggttaataatgatgtgcctgaagacaattggcaaccaatactcgtgcaacctattgatattgaagcgaaatcctttacaggcaaaattcgcaccgttgggcaaattaccagcttcacggcattacaggctcaaaatgaacgtttgcaacataaagagcaaaacataccgcttgctacttttggtgacgaagctcaagattatgaccgcacagagttcatcgcctcggactttcttgaagataacgctcagccatatagtcgctaccaatttccacatagcacgaaagtcggtaatctgttgcataaattctttgagcattgggattttcaacaaacggtggatcaaacacaattacaggcattgtgtgaacaacttgatttagacgaagcgtggcttgagcctttaacaaggtggtttgagcaagttattcaaaccccatttggtgatcaagcggtaagtttagcgcagatttttactcataagcgcttgaacgaatggcaattttatttacgcttatccaataaagaagctttatatcgacttaatcagctactgaaaaaatatagcccgctagcaaaacagttgcctgatttaaccttatataaccttgaaggcttcgtgcgtggttttgtcgattgtattgcccaaattgatggcaaattctatgtgattgactataaatccaattttttaggctatttgccacaagattatcaagccgaaaaattagccaaaacaatggggcaattccgctatgatttgcaatatttgctctatacccttgccgttcaccgctacttaagcgctcgcttaggggaaaattataattacgagcaacactttggcggcgtggcttatttattcctacgaggaatgaatggcgagccaaatagtggtgtttattttgataaaccaagtcaggagttgattgaagagatggataggttgtttgggtaagagatattctctatatcaataaagcccactttgagtgttttgtgggacgaataaaaagaaaaatgatatttattgtttcggattaatgtaattactccccatattcgcccccatccgcccttcgggcaccttcccccgcaagcgggggaagtattggggagaagtaggggaagtattgtagagcggtgttatgagaaaattcttcccccatttatgggggaagtccctgagcgttagcgaaggggatgggggctgagggataaaatctgtgaacaaaaaaagcggatagagagcctctcccacaatttgtgtaaatacctgtttctgagataatacattcagacacaggtattttattatgaacgaaaaacaacttcacgccttggcagcggaatttgccaaaaacctaaaaacaccagaagacctcaatcaattttcacggatgctcaagaaaattaccgtcgaggctgcgttaaatagtgaactgaccgaccatcttggttatctaaaacgaagattcagctttgcattgtgcatttagtgcgtaacagcttgaaattcgtttcgtggaaagattacaaagccgtcaccgcagatttaaagcaggtttatcaagccccgacggaagcacaggctcgcgaaaatctgaccgcactttcgcaaaaatggcaggcaaaatacccgcttgtaaagatgcatcaaaaaaatggacaatgccgattcagaactggaaactggcgatgaatcgatttatgattgattttggtgatcgcttagacgatcaccgttaagttgaaatgggtgtttacacagaatttgggatagggtctacgtaggcaaaaatacaatcctgtaaaagaagattatcctaagtaatttaaatatcatcacaacactcaataaagaatactttaattgaacaaaaagctgactctggctctaacccattatcagcccttaataattaaatagtgcaaaaatccacactctcaaatcgggtacagcttacgattctttttctagcgttgtctgaattgccaactccgccaacgctttcgggttaccgaaacttggtgcatcggtcatcaagcaagctgccgccgttgttttcgggaaggcaatcacatcacggatattttctgtgccagtaattaacatcgttaaacggtctaaaccgaacgccaagcctgcgtgtggtggtgtaccaaattttaatgcgtctaacaagaagccgaatttctctttttgttcttcttcgttaatgtctaaaataccgaataccgtttgttgcattttcggatcgaaaatacgcacagaaccgccgcccacttcatagccgttaatcaccatatcgtaagcattcgccacagcaccttttggattttgaactagctcttcagggcttaaatcttttggtgcggtgaacgggtggtgcattgctgaccagttaccttcgtcatctttttcaaacattgggaaatcgacaacccaaagtggtttccaagcggtgagatctgttaaacctaaatcacgtcccactttcaaacgtaacgcacccatcgcatctgtaaccactttttcactgtccgcaccaaagaagataatatcgccattttgtgcattgacacgtgctaataatgctttaaccacatcatcagttaagaacttagcaatcgggctttgcaaaccttctaagcctgcgtttacatcattcacttttgcccacgctaagccttttgcgccatagttcccaacaaattgagtatattcatcaatctgtttacgggtaatttccgcaccattcggcacacgaatgaccgcaacacgcccttcaggatcgtttgctggaccactgaatactttaaattcaacatcttttagaatatccgccacatcaactaattctaacgggttacgcagatcgggtttgtctgaaccataacgacgcattgcttctgcaaaagtcatttgtgggaactcgcctaaatcaacatttaaacgatctaaccacaagccgcggatcattttttccatcatcgcacgcacttcaggggcggtcataaaggtagtttccacatcgatttgggtaaattcaggctgacgatctgcacgcaaatcttcatcacggaaacatttgacgatttggtagtaacggtcaaaacctgacatcatcagcaactgtttaaataattgcggtgattgtggtaacgcatagaatttgcccttatgcacacggcttggcactaaatagtcacgcgcaccttcaggggttgctttggtgagcattggagtttcaatgtccagaaaaccgttgtcgtccatatagcgacgcacaaaactggtaatttttgcacgggttttcaaacgttccgccatttcaggacggcgtaaatctaaataacggtattttaaacgctgttcttcggtgttgttctgattgaaatcgagcggtaatacgtctgaattgttatataccacaagttctttgaccaacacttcaatttcacctgttgccatctctttattaatttgagatgtatcacgagcaatcacttcacctttaatttgcacgcaggcttccgcacgcaatgtagaggcttgtttgaataaggcttcatctttctcatcaaagaaaacctgcacgatcccttcacggtcacgaatttgcataaaaataaaacgaccaaggttacgcacacggtgtacccaaccgcttaatgttacttgctcaccaacgtgagtacggtttaacacaccgcaataatgagaacgcatcatatctagttatccttcttataaaatttggaaaaaaattgtggcgattatagcgaaaacagaccaaagaaaacagataacaatggaaaataatcatttaagccttgaaatcccgtaatttgtcgctatattagcggtcgttttagtgcaaaaatttgcgaagtcaaaatttgaggatacacaatgacaaaccaaactgaaaaagaacaagtagaacaagacgttagccaagcaactgaattagcacaagaggctcaggaagctcaaacacaagatgttgaacctgagttgcaacaaaataatgaaatcgacccgcttgcagaggcgattgctcgtgtacaagagctagaagcctatattgctgaagcggataagcgtgaacaagatattcaactgcgtgcaagagcggaagtcgaaaatattcgccgccgtgcagagcaagatgtagaaaaagcccataaatttgccttagaaaaattctctaaagagatgctgactgttgtcgataacctagagcgtggtttacaggctcttgaaggggttgatgaaagcgtaaaatcaggcgtagaattaacccataaaggcttagtttcaaccttaaataactttggtgttgaagcagtcggcgtggtgggtgaagcatttaacccagagctacaccaagcaatttcaatgcaaccagctgagggcattgaagccaaccatattagtgtagtcttacaaaaaggttacacgctacacggacgtgttatccgtccagcaatggtaatggtcgctagttaattttctgtttttcgacggcgatcacaaaattagccccaaatacctgcgtgatttatgttattttttgataacactaatcacaaagggaataaaaaatggacgcaactatgagtattcgatttgataaacttcgctttgtaaaaaagctacaagaagctaatcaaccacctgaggttgctgaggcgtttgcaacagcgttagatgaagcacttgagcaaagtcaaagtggattagtcaataagtcagatttaaaagagagtattaacgaactaaaatctgaattaaagcaagaaattgctcagcttgaagtacgtttgacaacatcaatgtataaaatggctggatttatgtttgctggtcttggtgtattaatgggactaatgcgatttatcaactaactaaagcaaaacacaatcccttatttgtttatcaagtaagggattttcaccttaaataaacctatgtcactacaatttaattctgttgccctactgcttgttgcacttatcttactcggtattttcagtcaaaatagtgctgtaaccatttctgctgctgtattattgattatgcaacaaacgttattatcaaaatatgtgccttatttagaacaatatggtatcaaaatcggcattatcattctgactatcggcgtacttgcccctcttgtatcagggcgaattgccttgcctgaacttgttcaaccgattaattggaaaatgatcgttgctattattgctggcatagtagttgcttggcttggcggacgtggcgtaaccctaatgggcaaccaacctgtgctagtcacagggttattaatcggcactattatcggtgttgctttcttaaaaggcgtacctgttggtccgttaattgctgctgggattttgtcgctcatcataggaaaatcgtaatttaccattgaaatatgcaaaaaaaccataaaaaccaaccgcttacagcagaacaaaaaaacttacttaaccaactgcaagataccactttaattgatgctcgccgtttagccaggcgtattcgtgggttggcgaatatcaaaaatgaaaacgctaaacaagccatcattgcagaaattgaggtggatttgaccgattgtaaaagtcgctatctcacgcgtaaacaacaagccgaacaactgaaaattgagtaccctgatctgcctgtttccgctcgccgtgacgagatcttaaaactgattgccgaacatcaagtggtggtgattgctggggaaacggggtcgggtaaaactacgcagttgccaaaaatgtgtttggaactagggcgtggggtgaaaggactaatcgggcatacgcaacctagacgtatcgcggctcgctcggtggcgacacgcattgcagaagaattgaagtcagaacttggttcaaccatcggttataaaatccgctttaacgatcagattagcgataacaccctcgtcaaattgatgacggacggtattctgcttgccgaaatccaaaacgaccgctatctcaatcaatacgatacgctaattattgacgaagcccacgaacgttcgcttaacaatgattttattctcggctatctcaaacaaattttagcaaaacaccctgatttgaaggtgatcatcacatcggcaaccattgatgtggaacgtttttctaaacatttcaacaacgcaccaattattgaagtatcaggcagaacttatcctgtggaagtgcgttatcgcccgattgtggaagaagatgatcaagaccaactgcaaggcattctcaatgcggtggacgaactgcaagcagaaggtcggggcgatattttgatttttatgaacggcgagcgagaaattcgtgatactgccgaagccttgcagaagcaggaacttcgccatacggaaattttaccgttatatgcccgtttatctgccgcagaacagcaacgcatttttaatccaagtaatctaaaccgcattattctcgcgactaacgtggcggaaacctcgctgactatcccaaatatcaaatatgtgattgatacaggaacggctcgcatttcccgttatagctatcgtaccaaagttcagcgtttgccgattgagccgatttctcaagcctccgccaaccagcgtaaagggcgttgcgggcgtatttcggaagggatatgtatccgcttgtattcggaagaggattttaacgcccgtccgcagtttaccgatcctgaaattttgcggacaaatttggcttcggttatcttgcagatgacggcgttgggtttgacggatattgcttcgtttccgtttgtagatgcgccagatcaacggcatattcaagatggtattcgtcttttagaagaattaggtgctttgggtagggacacactgcgtgtgtccgcggacgcacgcagtgcgtccctacagaaattaacaaacatcggtcgccaactcgcccaactgcctatcgatccccgtctgggtcgtatggtgatcgaagcggctaaaaacggcagtttgcacgaagtgatgatgatcgtatcggcgttgtctattcaagatcctcgtgagcgtccgcaggaaaaacagcaatcgtcagatgataaacatcgccgttttgccgacaaagagagcgattttttagcctttgtgaacctgtggcattttattcaagagcaacaaaaggaactcaccaaaaatcagttccgcaagctctgccaaaaagattatctcaactatttgcgagtgcgtgagtggcaggatatttatcatcagcttcgccttgcggtgcgtgaaatgggcttgccgattaacagtgagcctgcaaattatcagcaaattcataccgctttattatcgggtttattgtcgcatatcggcttgaaagacaacgaaaaaatgcactatttaggggcgagaaatgcccatttctacctgttccctaattctgtgcttttcaaaaaacagccgaaatgggtaatggcggcagaattggttgaaaccactaaattgtgggggcgaatggtggctcggattgagcctgaatgggttgaaccgcttgccaaacacttaaccaaatccagttacagcgaaccacgttgggcgaaatcaaaaggggcggtggttgccgatgaaaaagtctcgctctacggtattccgattatcgccagccgtcctgtgatgtatggagcaatcgatcctgttgtcagccgtgaaatttttatccgctcagcgttggtggaaggtgaatggcacaataattacaaatttttcaaagaaaataaccgcttgatcaaagagatcgaagagttggaacataaatctcgccgtcgagatattttagtggacgagcaagtgctgtttgaattttacgatcagcggatcggcacagatgtcgtttccagcaagcattttgacagctggtggaaaaaagcgtcacagaaagatcctgaactactgaactttgaaaaatcgttcttgatgaatgataatgcaaacaaagtcagcgaattagacttcccaaatttctggtatcaagattcgctcaagttgaagctgagctatcaatttgaaatcggctcgcaagcggacggcgtgacggtacatattccgttgccgttgctgaaccaagtggatacgcacggcttcgattggcacgttccagggctacgtcaagagctaatcattgccttgattaaatcgctaccgaaagccactcgccgtagttttgtacctgcaccaaactatgcagaagcctttttatctcgtgcagagccgtttaaaaagccgttgttggaaagtttgagttatgaacttcgccgaatgacaggggttttggttgagcctgaacagtgggatttaagccaactgccaccgcatttgcggatcagcttccgtgtgattgataaaaaaggcaaaagccttgcggaaagtgaaaatcttgatgaactgaaattcaatttgaaagacgaagtgcaaaatactctgtctaacattgccgatgacggcattgagcaaagcggtgtgcatttgtggaattttgccgatttgccacaattttacgagcagaaaaaacagcattttagcgtaaaagtctaccctgcgattgtcgatgaaaaagatgccgttgggatcaagttgtttgaaacggaatttgagcaagccaaagcaatgcaagcaggcttacgccgattgttattgctaaacgtgccgtcgccgattaaatatctgcacgaaaaactgccgaataaaaccaaacttggtttatattttgctccgttcggcaaggtgctagaactgattgacgactgtatcgcctgtgcggtggataagttgatggaggagtttggtggctttgtgtggtcggaagaaaaatttaacaccctgcacgactacgttagggcgaatttaaacgacaccacggtcgaaattgctaaacaggttgagaaaaatcttacccttgcctatgaaatcaacaaacgtctaaaaggtaagttggatttcacgatggcatttgccctgtcagacattaaagcacaaattgacggtttgatttaccccgattttgtcaccaaaacgggctacaaacgccttgcagatttacaccgctatctcaccgctatcgacaagcggttagataagttggtggtggatagcaatgctgaccgatccaaaatgttgcgagtggaacaggtgcaaaacgcctatcaacaactgttggcgaaactgccaaaatccaaaccgatttccgatgaagtcttagaaattcgttatatgattgaagagttgcgtgtcagcctgtttgcccaacagcttggcaccaaatatccgatttcggataagcggattttgaatagtattcaccaaataataaaattttgaaaaaacacttaaatttgtaaaattatgtaaacaaacttgtctacctttatgataattattatcatctatccacttccaaaaataataggtaatcactccaactcttacgcctcattcccccacaaaatgaggcgttttttttcgccttttttcctcgttctccgctataatagccagtatttttcgcatatagtaaaaggaataataatgacacaatctattgaaaccgttctcgctgaacttaaacgtggcgtagaagatgtttattcagaagcagatttaattgagaaattaaaagaaaatcgtccgttacgcgtaaaacttggagcagatccaaccgctccagatattcacttagggcatacagtcgtgttaaataaacttcgccaattccaaaattttggtcacgaagtgattttcttaatcggtgacttcactgcaacagtcggcgatccgtcaggtaaaaatgcaactcgtccgccactttctcgtgaagacgtattacgcaatgcggaaacctataaagagcagatctataaaattttagacccacaaaaaacccgtattgtgtttaactctgagtggttaggtgagttaggcactattggtatgatccgcctagcatcaaactacactgtggctcgtatgctagagcgtgatgatttcaaaaaacgttttaacaataatcaatctatcgctattcacgaatttatctacccattattgcaaggtcacgactctgtggcattagaagcagatattgagcttggcggtacggaccaaacctttaacttattaatcggtcgtgagttacaaaaagcagcaggacagaagccacaggttgcaatgacattaccacttctcgttggtttagacggcgagaaaaaaatgtcgaaatcccttggtaactatatcggcgtgaccgaagcaccaaatgaaatgttcggcaaaattatgtcgatttctgatgaactgatgtgggattggtacaatttactttcattccgtccattaaccgaaatcgcacagttaaaagccgatgtggaagcaggtaaaaacccacgtgatgtgaaaattttattggcgaaagagattatcgctcgtttccattctgaagcagatgcagatgcggcggaacaagagtttatcaaccgcttccaaaaaggtgcaatgccggacgaaatgcctgaatttacctttgaaggcgaaatcggtttagcgacattattaaaagaagcaggcttagtgccttcaacttctgaagcaatccgttccgcacagcaaggtggcgtgaaaattgacggtgaaaaagtcgatgatgtgaaacaaaatgcacagaaagggacttttgtttaccaagtcggtaaacgtaagtttgcgagagtgactgttaactaatcctcaaaatcgtactacctaaagtctttattgcaaactattcaattcagcagaagagcttagtttaaattcaagctaagctctttatgttatatagcattactctctttatattcagtaatcacccttggtgttaattttgtgattaattcatagttaattgaacctatcgcttcggcaacctcttcaataagcaaacgctccccccaaagctcaacctcatcgcccactttatcttggctatcaatcccaagatcaacagtcatcatatccatcgaaactcgtccaacaatcggaaccttacgcccattaacaaaaacaggcgtaccttcaggagcatttcgagggtagccatcgccataaccaatagcaaccacaccaattttcgtgtctttatcacttacccaagatccgccatagcccacaggctcaccagctttgtgactgcgaaccgcgatcagagaagaagataatgtcattacgggtttaaatcctaaatcaataattggcgttgtgtgcggagaaatgccgtacataataatgccagggcgaacccaatcataatgggcttgcttccaataaagaataccgcttgaagcagaaatactacgctcaaccttgtactcttgactgactgtttcaaaagtagcgatctgcttttcggtataatcacaatcaagctcatccgctcgactaaaatggctgacaaagtgaatacattctacgagaggacaagcggttaaacgttgataaaattctgcaacttgttcggggtgaatacctaaacgatgcatacctgtatcaatcttaagccaaacagtaatcgggaaataaattttggttttacgctgccaaaaacctttctgcttttccgcttgccactcttgagccacattttcgagcagctcaagttgctcaaggcaatgaataactgtatcgaaacgacgggaaagggtttttaataattcttcacgatcaaaaaaaccttcaagcaataaaattttaccggcatagccactttcttgaatagtcaatgcttctttaatgcgagcaacaccaaaagcctctacctgatcttctaaattcttaatcacggctcgaataccttgcccgtaagcattggctttgactaccgcacagattttactgtgaggagccaaagatttaattaaacgcatattatgtcgtaaggcactaccgttgatcgtcgctgttgctggtttcatcgttttaaagtatctatttgaaaatactcaaaattatacgctgaaattgtaaaaatccctagaaattcaggaaaaatagactaatatataggcaattgtttaacctatattaaggagaatatgatgttatctgaattgatgattttacccttcgtctttgtcattttgaccattgccattttactatcgtcaattaaaaccgtgccgcagggatttcattggactattgaacgttttgggcgttataccaaaacattaaccccagggttgaatattgttattccttttattgatagggttggacgtaaaatcaatatgatggaacaagtgctagatattccatcacaagaagtgatttccaaagataatgcgagtgtggcaattgatgccgtttgctttgttcaggtgatcgatgctcgtcgtgctgcttatgaagttaatcatttagagcaggcaatcatcaatttaacgatgaccaatatgcgtacggtactcggttctatggatttagatgatatgctttcacagcgagatttgattaacggtagattattagccattgtcgatgaagccgcaaacatttggggtgtcaaagtaacgcgtattgaaattagagatgtgcgtccgcccaaagagctagttgaagcaatgaatgcacaaatgaaagcagagcgtaataaacgtgccgatattttagaagcagaagggatccgtcaagcagaaattttgcgtgcagaaggggaaaaacaagctcgcattctaaaagcagaaggtgaacgacaagaggcattcttacaagcagaggctcgtgaacgtgcggcagaagcggaagcaaaagcaacacaaatggtgtctgaagcgattacaagcggtgacactaaagcaattaattactttattgcacaaaaatacactgaagcactgcgtgaaattggtgctgctgacaacagtaaagttgtcttaatgccactagaggcaggcaatttaatcggatctgtggctggcattgctgaattacttaaaggcgataagaaataagggggaaatatggaatggctttcgggctggactgcttggctgatttttggttttattttgcttattctagaaactctcattgcagggatctttataatgtggtggggatttgcagcgattattgttgcaatactactcatattattccctaatatcgaattgggctggcaagccactatttttgcgatcttagctattctgtttagcctcgcttggtggaaatatcagcacagtaaagatcagcaagaagatcaacaagccgatttaaatgcccgagatcacgcaatgatcggcttacaggggactgtcgttgaagttctcgacagcggtgttgcaagaggaaaatttggcgacacgacttggcgagtgattggcaacgcattacaagttggcgataacattcaagtagaaaaggttgatggcattaccttgtttgttcgtgttgtatagaaaaattctgacaataaaaaaccgcttgttttacaaaacaagcggtttgatttttctaaattttaccaatgaatttattctgctttttcagttttctcttttggtaatactaaatttaagataattgccacaatcgcacagaggctaataccttttaacgagaactcgcctacgttaattagcattccgccgataccaaatgtcattactacagacacgatacagagattgcgagcttcgctcatatctactttcgcacgaattaaggtactcatacctactgctgcgatagaaccaaatactaacatcataataccgcccatcacgacagctggaatggtttgtagcaatgcccctacttttccgcagaaagagattgcaatagcccaacatgccgcccaagtcatcacttttggattgaagtttttggtgagcattaccgccccagttacttccgcataggttgtatttggtgggccgcctagcattgcagcagcagatgttgccacgccatcacctaaaagtgtacggtgtaaacctggtttgcttaggaagtttttccctgtaacagagctaatcgccataataccaccaacgtgttctactgctggtgcaagtgcgattggaagtaagtagaggattgcttcaagtttaaattcaggtgttgttaattttggcaagctgaaccacgccgcatcataaacaggttggaaattcactaaaccgaagaagagtgacacaatatagccgaccacaattgcgaacataatcggcacaagtttcatcatacctttggtaaatacagccacaattagtgtggtaattagggtaatcattgaaacagtcactgccgttgcataaggaatatcagtgcctttaccgatagccatatctacaccgacgggtgctaagcctaaaccgataatgatgattactggaccaactacaacaggtggaaataacttatctaaaattgccacacctttaaatttaactaatgcggaaaggacaaaataaattaaaccagagaaaacaattccccccattgtgacagggattccccactgctgaacgccatattgaatgggtgcaataaacgcaaaagaagaagcaaggaaaataggaacttgtcctttagtgcagatttggaagattaaagtaccgataccggcagtaagaagtgctgtgttaggatctaagcctgtaatcaatggcattagaaccaatgctccaaatgcaacgaaaagcatttgtaagccaacgaacgcctgtttaggcgtactgatattttctgttgtcatttttcaactctctaataatgtttgatagtcgccaagctacaagacatagctcaggcggacattatatagaaaaatgcaaacgtttgcagatttttttgtcaaaaaaattaattagataggcaaattttgtaaaggcagaaagtgatattgcatagagataatgtgagcacacaacgtgtgcccacaggacgaaattatccaacccaaacaaatttagcaataaagagcagtgaaaccaccgcaacagcagggttaatctcttttactcgacctgtacagagcttcataatgcaatagctaatgaaaccaaaggcaatcccttcagtaattgaataggtaaatggcatcatcgctgtagtaataaatgcaggtgtcgcttcggttaagtcgtcccattttacttcaattaaacttgaagccattaaaatgccgacaaacactaaagcaccagccgttgcataagtaggcacaacagctgcaagcggtgaaaagaagatcgttaataggaaaagcacgcccaccacgacagcagttaaacctgtgcgtccaccaacagaaaccccagaaccactttcaatataggtactgatcgctgatgttcccatataagaacccgccatagcgctgacgctatcgacataaagtgcctgtttcatttttgggaagcgaccttgttcatcggcaattccagctttattcgtaaccgcaattaatgttcctgatgagtcaaacaagttaaccaacataaaggaaaagataatccccagcaatgcggtatctaatgcccctgcgatatcgacttgtccaacaacagcttcaaggcttggtggtattgaaatcacgcctgagaatttgacatcaggatcaaagattaacgctaatgccgtcacaacaacgattgaaattaatacgccagaatgaataccttttgcagccagtaccacgataataaagaagcctaaaatacccattaagacttttggatcgtgcaattcacctaacgccactaaggtcgcagggtttgcgacaacaagccccatatttttaaagccgattaacgcaataaataagccgatacctgcaccaatacccacacgtaaaccaagtggaatggctgacataaaccagtagcgaacttgtaatatcgtgagaataaatagaccgacagaaccccagaagattgcccccattcctgtctgccacgtatagccgagtttttgaacgacgacaaatgcaaaaaaggcattcaatcccattgcaggggcaagagcgatcggcaagttactaaataaacccatcgcaatagtaccaaaagcggcgattaaacaggtggtaacaaagacaacttgggtatccataccagccacacctaaaatagatgggttgacgaaaacgatataaaccatcgtaaagaatgtggtgatccctgccacaatttcagttttgacattactgcctttttcttttaattgaaacaaacgttcgagcatagtgcctcttaatagaataaagaatttcaggaaataagatggaaatgaaatcgacgaaggcaaccgacagtactaaatgcacaaagagataggaagtcttggctatttcgttcagagtgtagccaaaatcttaggattactcaagggatagaatgtaaaaacgtaatcgtttgcttatttaagcattattctacaaaataatgtggtacaaagtggctatcattccctgtaattgcggtaaaatcttctcgaatacctataccacaagcagtatccccaacaatccaagagcctataactggatacattccatcaaagcaagggattgcatatttttgttgaaatacatagggggctgtcctagataatgactaaaagctctattttaggttaaaataaccaaatgagaaaaagtcgtctaagtcagcataaacaaaataaactcattgagctgtttgtggcaggtgtcactgctcgaacagcggctgaattggtaaatgtaaataaaacgacagcagcctattacttctatcgtctgcgattgcttatctatcaaaacagcccacatatggagatgtttgaaggtgaaattgaagccgatgaaagctatttttgcggcactcgcaaaggtaaacgagatcgtggagctgtgggtaaaaccgctgtattcgggcttttaaagcgtgatggtaaggtgtataccgtcgttatcatttttcaactctctataattgaactaggatttatgtaccatgagtgatgaaaaactttgtgatacaggcatgatttcaatgctatttacattcacatgattaggttgttgattcagccacaatactatttctgcaatatcttcgggttttaaatactctacattttcataaagtttagataccttttccttatcacctttaaagcggacatacgaaaactcagtatcaccacataaccccggttcgacattactcacacgtattgctgtcccaattagatccgctcttaaatttaaactaaattgtttcaaaaaagccttcgtccccccataaacgttacctcctggataagcatatgtaccagctattgatcccaaattaataatatgcccagtatttctttctaccattcctggtaaaatcaaatgggtgatagtaaccacccctttgatattggtatcaatcatttggtaccaatcatctaaatctgcttcatatgcagcatctaaacccaatgccaaaccagcattattcactaataaatcgacatgtttccaacaatctggtcgattatttagagcatgaatcgtttcatctgcattacgaatatcaaaagcaagcggaaaaaaatgatctgggaattcatcttttaacatctttaaccgttcaatacgtctccctgtaccaataactctataacctgcctgaatcaacgttcgacaaatagctaaaccgaatccagaagttactcctgtcaccaatgctgttttcataattcccctccctaaataccataggtaaaaaaatattgaaggataaaaattgactatgagttattgtcaccctctctcaatagttttgcgattgcattacgataagtgatctctaagctctctcgacttgtcgccataacaccttgatcatttaagaacccatcattaacatcatagacccaaccatgaatagagagtttttttcccctctcccaagctgatttaacaatagttgaacgtcccaaattataaacctgttccgctacattcaaacgaactaacatatcccccctatgttcgggagatatttttccaagaagatggctatgtttaaaccatagatctcgaatatgcagtagccaattgctaattaaaccatgatcttccattccaattgcagccttaataccgccacagttggtatgcccacaaataataatatgttcgatatccagcacatccacagcatattgtacaactgaaagacaatttaaatcggtgtgaatgacaagattccccacatttctatgaacgaatagttctcctggctctaatcccgtcaacttctcagcaggaactcgactatctgaacatccaatccataaaaaactaggtttctgatgttctgctagctgtttaaaataatctgaatgctcatctttcatttgagttgcccaagcatgattatttgcaaacagacgttcaatttttttcataaattcccatttagtataaaaaacaaaccccaaattttaaattgggaaagaacaattcttattcaaagattaatgaataaaaaggttttcatcttattatgagtactcatatccgtcaaatttaatcaataattaaactcaacgagcagagagatccccataaatggatagaacattatatagtaagttttatccctccaataaatccaatatgctatagcaaaatagcggggaagctcctacaagtctaatctgatcacataagtatgattgaattttactgctttcatgtagcatctaccacgttttttgtttaagatgaaacacaataatttctttcaacaagtaaaacataatgtcatcaaatgaacttcttcgctgtgaaaatatcagcaaattttaccaagagggcgaaaatgccactcaggtgcttaaaaatgtctccttttcaatgaacgcaggcgaacttgtggcgattgtcggtagctctggctcaggcaaaagtaccttgttacacacccttggcggtttagatcaaccgagtgacggcgaggtgtttatcaaagggcaatcattgcagaagctcagtagcaatgctcttgcaaaactacgcaatcaacatctgggctttgtctatcaatttcatcacttaatggcggatttctctgcgttggaaaatgtgatgatgccaatgttaatcgggcaacaaaacaaaacagaagccaaagatcgggcagaaaaaatgttacaagcggtcggattggctcatcgaattacccatcgaccttcggcgttatcgggcggtgaacgccagcgtgttgcgattgctcgtgcgttggtgaataaccctgcgttggttcttgctgatgaaccaacgggtaatctcgaccaaaaaacaaccgaaagtatttttgagctaattcaacgtttaaatcaggaacagcagattgctttcctgttagtgacccacgacttgaatttagctcacaaactgaaccgccgtttaattatgcaagacggtgtattgcgtgagggtaactgatgaataccccattttttatcagttggcgttatcagcgtggcaaacagaaaaatcgcttggtgtcgttgatttcgctcttttctagtgtcggcattgcgttgggcgttgcggtgctgattatcggcttaagtgcgatgaacggctttgaacgagagctaaatcaacgagtgctttccgttgttcctcacgctgaaattatggcgtataacgaaagtaaatcagcgaccattgcacaaggtgatcgccttgagcatatcgtaaaagataacccaaatgtgaccgctttatcgccgtttgtcagctttactggcttgattgaaaatggtagccagctaaagattgcacaggttcggggaatagatccaaccaaacaagaacaagtgagccagctcacccaatttattccgcaagatcaatggcaagcgttcaagcaagagggcggtttagttttaggggctggaattgctcgttctctggacatcaacgttggcgatgaagtcactctgttattgtcacaaccaaccgacgacggcaaattggctcaacctttgcgttttagcttaacggtgaccggtattttgcgtttagacggacaacttgatcacagttacgcactgcttccgattgcaaaagcccaagaactgttagaactgaaaccaagccaatatacaggcattgaattagcggtgaaacagccgtttcaagtcagagatattacgttccctgaattagcgaattatcctcagcaactatatatgcaaacgtggattgataaatttggctatatgtacaacgatattcaactgatccgcacagtgatgtacattgcgatggtgcttgtgattggtgtggcatgctttaacatcatttcgaccttagtaatggcagttaaagacaaacagggcgatattgccattcagcgaaccttaggggcaaacaaccgctttattcaacatattttcctttggtacggtttaatttcaggtatgaaaggggcgttattcggcgtggtgttaggcgtgattgtgtcaatgaatttaactgcaattattaaatggtttgaaggtttaatcggaatgaaattgctctcagacggggtctattttattgactttttaccgagcgaaattcattggctagacattgtttgggtacttctcgccaccctaattttaagcctaatcgcaagcctttatcctgcgattagagcttctaaattagaacctgcgaaggtgttgagtgggcattaaatacttttagagtatgactatttagaacggaagttatatcaaccccaacaccttccgtccattcacgcttgcaatatttgccatttcttcgagattggtaaaacggcaacctgcggaaagtaggctaagttcttgccacatatccccctcacaaagaggaaccatatagtcacagatattatctgtaccaattgccacagtaattccctctgggatcatctcatcagcaggcgttaaagcattatggaatggtaaaacttcatctttacgagggctatcaatccacgccatcggacaagcaatcatcatcatatcaacggctttcattttcttataaagcatctgacgatactctctaggatgagcaccgattgaaatcccgtgaatagccaccacacgcccttgcattccgtgttccaccgctttatcacacagttgctctgtttctttctctttaggattgttaaattgatcgacgtgaacgtgcagcattttaccttgtgattttgcggtatccatcaaaatatccatcgcttctaaaccttttccatagtccaattcatcacgataaggtaagccgccaatcatatccaccatttctgaaccaatatcaaaccacttgcgagcattaggttcgattacaccttttaaggtttgatttgcaaaacgtagaataatatcgtttttatacacttcgcgtgctttatgtgctgccaaaatcgcacggtcttcgcaaacttggtcaatatcaacgaaagtcccaaatgcagttaccccttgtgaaatcatcaactcaatcgcttggctaaaacggcggtaataatcctctacgcttgaatttcgtttgacttcatcaactaaatcccatttctgttgtaaattggcattttgataaattttgattttctcaggtgtcatagtgaatgctctatctgcgtgcgcgtgggaattaacccagcccccttttttaatcacttcatcacgaatatggctttttaaagtacgaattaactggctcattgcttatcctctaaaatatgggcaaaaaaaaatctcaaaaatgagatcttctagaaatggaaaaataatgcgataaaaaaacagccaagcttcgttgaatagcgaagctcagctgaaaaagtgtgttggatactgttatatgatttggttgcatttctagttcctttcttggcactaggactacattttatcttgtttttcttctcaatgcaaacgtttgctttaaataaagtatcaaattttaagcggtcggttctcttaataatttttcaattactcgagaaacggcaaaaaagccaaaagtggcagtaaccatagtcgctgcaccaaaaccattggcacaattcattgttgcagacacttcacagccctcgctcattttagggaaaatcaatggctgagtagagaatacacaatcaataccaaatttacgtttagggttttggctgaaattatactcttttcgcaataggctacgcaccttagacgctagaggatcttgaatagttttacttaaatccgtgatctgaatttgcgttggatcagtttgcccacctgcaccgcctgtggtgattatcttgattttattacgcttacaaaatgcaattaacgctgctttcaccctaacgctatcaatcgcatcaatcacataatcataatctcttaacaaataatcagttaaattatccagtgtaagaaaatcatcaatgatcgtcacttcacattcagaattgattttagcgatccgctcttccatcacttccgttttcaatttaccgatctcgcccgacattgcgtggatttggcgattaatgttggtgacacaaatatcgtccatatcaattaaggttaatttaccaatacctgaacgagccaacgcttccaccgcccaagatccgacaccgccaatcccaatcacacaaatgtgcgattgacgtaatttggctaatccttcagctgtataaagacgaccaattccgccaaaacgttgttcgtagttgtctattcttgccatgttaatcctttagctctacataaactacttcgaatttgttgagggttaatgcaacttcatcgttggtcttaaaaaacgattaattctaccaaccaacataatcaaccctgttttgacacaaccgtgtagagccacttggtgcatacgatagagtgaaaggtatgccatacgggcgatcttcccttcaataaacattgagcctttagttaaattccccattagactacctactgtaccaaaacgagagaaagaaattagcgagcctttatcatcaaatataaaagcctttaaaggtttgttttctaattgtgctaagatatttttaccacaaaccgttgccatttgatgtgcagcttgcgctcttggcggaacaggcttaccatctgcttgtagcaaaaaggcacagtcaccaatcacatagacgttctcatcagttaatgtctgtaaagtatctttgattgcaatttggttaatacgattagtttcaaagccaaatgtttttgttatttcaggggccttaacacctgccgcccaaaccatcagatctgctttaaagttttcatcatatttagtaactaatccctccgcagttgcacgaataacaggagtattggttaacacatctacacccaatgcacgtaactctttaattgcagatgccgataccctttctggtaacgcaggcaacaagcgttctcctgcttctaataatgttaccttcaagctagtattatctaacttaccatatccataagaatttaaatgtttaaccgcattatacagttctgcggataactcaatacctgtagccccgccaccaacaacagcgatatgaacttctttttcattattatttgaaaatttcaaaaacaattccatcatacgtttatggaatacttttgcttgctctgaactgtctaagaaaatacagtgttctgcaacaccaggcgtattaaaatcatttgagcgacttccgattgcaagaaccaatttatcatagacaatggtacgttccgctactaataattcccccgcctcatcatagattggggctaatacaatgattttttctgctggtttaacttgagttaatgtgccttgacgaaattcaaagtgatgatttttcgcatgagcacgataacttaaagcatcagtaccatcatctaaagagcctgttgcaacttcatgaagtaacggtttccataaatggctaatatttttatccaccaaaataatatttgcctttttctttttacctaatttgttacctaaataagttgcaagctctaatccacctgcaccgccgccaacgataacgatcgtttccattgtttgctccgaaatgaataaatattaaaactaaaggcattctaaaccttagctactgaatgatctaggtagatttacaaattatttcagtggaataaataaatagatatttgataagttttgcacaggcaaatgatgtcaagtcaaaaaaggtgaaaaaatcttgatttttttacattttgcctctagtcaaaatgtaacatattgattttaaaagaaaagttattttatgtacaatcgtaaacccgcatcaaaaaccctatgaattatcaagggtttggcgtgttttaaaaaagtaatccacaaagttatccacaggctttgtggatagaaaaagccttattttttcactgattttatgaacagtaatgaggggcgatgttgaagatctttaaattcattgtgccattcaacttgatcggcaagcataggctcttccacttgctcaatggtgaaattgctttgaataagggtatttaaaatagtggcggtagtgcggtggtaagttttaaaagattgctgaaaccaattacgatcacgctcaccttcatcacggtaataatttaggcggtatgcgacttgttgcttattgattttttcccaacgctcaccttctttaaaacaagttacaatcgggtgttcttgcgaaaaaatcagttgcccttgtggttttaatttggcagaaatctgcgttaataaggcagataaatcttttatataatgaaaagcaaaagagcttgtcaccagatcaaaatcgctttctgctatggtggataagacttccatcggtaagcaataaaagcggtaagcggtcggatcaaccccgttttttgcaaaatctttttcagcttgttcaagcatagattgagataaatctaagcctacaacctgtttcgcccccattgccatataatgcaacaaatgcccaccagccccgcaacctaaatccagcactttttttccgttcagatcaggtaaaagcgaaaacatcgtaggcttttccaccacttcatttaggcttatcgggttttcacgcagtttaagatagcgtccaaagaaaatcgggttgtcgtagatgctggttttcatttgcaaaaatctctcaaatcctaccgcttgtaaatatcttcaccatcacggcgagttttcaagatacgcaagatccagacatattgctctggattttttggcacaaagtactcaatcacttcgttcatttgccgtgccgactgttgctcatcacctgcaaattcaagcggtggcaaaatttcaatttgatacacgcctttttccgcattgtaaatcgggaacattgggatcaccactgcatttgccacacgagccattttcgctagccctggcaatgttgctttttcagtcgcaaaaaatggcacatacacactaagctctgctccgaagtcttcatcgggcaaaaaataacccaaacaccctttacgcacatcatttaaaaagggtttaatcccattttgacgggtatgcattttaccgccaaaacgttcgcgagtgcgattccaaagccaatcgacaaggggattatgatgtgggttatacattgaaaccattggcattccataggtatgcataataatccccgacgcatcaatcgaccaagtgtgtggcacgagtaaaatcacgtttttcccatttgctctcgcttctcttacgatctctaaacccgaaaactcactacgtttttgaatatgttcaacagaacgcaacgcaatttcaccaattcctaacatcgtttgagcgacagtaataaacattttttcaatcacatctgaccgcttctcttccgaccaatcaggaaaacagtagcgtaaattgctatccgctcgatgatattgctttttccctttcagctttttagcaacgatttttccgccccaggtcgccagcttatcacgccaacgaaatggtacataagccaagatcactagtcccaacattcctagccaaattccccaatatttcgggtgtaaaaaggctttttgaaactgatgttgataacctactcgatatgtttcacgttctgacattcttttgtcctatttcttacggtcgataatatttttcaccgccaaaatcaatcccaaaccaataaatgccccaggtggtaaaatggctaatagcaagcctgaatctaaatgtagcagatccattcttaaggcttttgcccaactgcctagcaataaatccaagtcgtcaaacagtgtaccgttaccaataatttctcgtatcgccccaagcaccacaaggcttaacgtcatccccagccccatcgcaaaaccatcaaaagcggaatgggcgacactatttttggaggcaaaggcttccgcccgaccaataacaatacagtttgtcacaatcaacggcacgaaaatccccaaggattgatacacaggaaaggcaaaagcattcattaacaactgaatagtcgtcaccgcagttgcaataatcatcacataaatcggaatacggatatcgtgcggaataaccttacggaacaaggaaatgatcgtatttgtaatggtcaaaaccaataaggttgccaatcctaagcccaaggcatttgtgacattattcgacactgccaacaacggacacaatccaagtagctggactaaggtcgagttatttgaccatacaccttgcgtaaataaatttttccaaactgaagattttgcttcggctgtcgtttcttcaatttgcgtaatagggatttgggtttcttgcatattttatctcttgtagggtgggtcttgacccaccattttccataacatattgattttataggttggttaaaacctacccacaatgcttcatctattttgatgatgtattatcaatcttaaccattgagctttattaaccatcttcagtggatcctttatacaataaagcctattatttattaaaatttcttacatatcccactgatataaactgagcatatcatttttcacatcacttccccaatccatcggaaattttccattttgtacgtctttatgaaatgatgaataagcccaatcagatacattttttacataattatgtttcacagggttatagtaagtataagcaatatgtttttctaaatcttcttcatctctaatataatgctcccaaaaccgtctttgccaaatccctgcttcatttcgtttttcacgactaaaatttgggtttcgatgttctttgggtatcttttgagtaaatcttgttttcaaaaattttaatcttattgaatagtcatcatcattttcaggtaattgtaaaatcagatgtagatgatcaggtaaaatcgtaattgcaatggtttcaaacgagtatttctcaacagtttctttatatgcacaacgaaattcatcaatatatctaactaacaaatcgcttgttctatcctgcaaaacgatggtaaaaaaataaataccgccctgagtaaaattacgtcgataatttgacatactttttccaaaaatggtgggtcaagacccaccctacaatttattacaactcaaaaaaccttccaccatttcaggcttttgctttaactgagtaatcacccattttgcactttggcgaacattattcaccaccgctcttggtgtaatggtcgcaccagtaaattgatcgaaggtaccaccgtctttttttaccgcccattcgccttcattttctaagctaaatttgcggttggtgaaactgtaaatccaatcgtcaattcgggtttcgattttatcacccagcccaggggtttctttatgggcaagggttcgcacgcctaataccgtgccgtcaggctgaatacctatcaacagctctatattgcccgaatagccgtctggaacggtagcttgaatagcgtaagcggttagatccgagcctttttttgccatatggattttatttaaaaacggcacttcaggaagtttaaccactttgcaagttgccaatagctcattatcaaaatgtacttgtggcacaacttctaataataattgccgttgctgttctgccgtaaccacatcaattcgacttttagtcagcagataaacgcccgttgaaaccgccgtacatagtaaggctatcgctcctaaaatcagagcgtaacgtgtggtaatcactgatgttttcattgtctccgtcctaattttgtaccgtataaacggggttgagtatagtggtcgattaacggcacacagatgtttgccaacaacaccgcaaacgccacgccgtcagggtagttgccataataacgaatgaaataaatcaacaaaccgaccaacgccccgaaaatcagtttgccttttggcgtgattgaagcggtgacaggatcggttgcaataaagaatgccccgaacatcatcgccccactaaataactgagcttgagccgtccaacgagccgtttctgacacaaaatctgtcgcaaagctcaacaaggcaaaagtccccaacatcgcaacaggaatttgccaatgaataattcgcttataaatcaataataaaccaccaagcaaaaaggctaaattcacttgcccccaaccgccgaccaacacatctgcaaaaagtttgtctaactgaatacctaaggtcacattatctttaatgctactcatcgcctgttttgagccgtctaacactgtggcagacgacacgccatcgacactttgaataagttgatgaacgctaaagccgtccgtggtgacattcgcaaaaatcagcgaaaaactatccgctaacgttggcggttcgttcaacaacgccaacggtggcaaccacgccgtcatttgcacagggaatgacaccaacaacaacgcatagccaatcattgcagggttaaataaattctgccccaaaccgccataaacgtgctttgccagcaacaacgccacgatcacgccaatcacaatcacccaataaggtgcatagggcggaatagccatcgccaaaattaatgcggtcaaaatccccgacaaatccgccaaatagaaagcggtcgctttaccacacaattttgcaacggcaatttcaattaccaccgccaagccaatcgccaagctcgcctgaatgaatatcccgtaaccaaaaaaataccactgcacaaccaacgcaggcaacatcgccccaatcacccacagcataaaatttgccgtcaggttgttggaatgcgtatggggggaactgatcattttaaacatcaaatgtttcctttatatcgtctaaatttgctaaatcttcggcaaatgcatattaaatttaatcgtgagcattcggattgcaatgaccgtcgttaccgttgccacatcaatccaattactttcaaacccagcatcacggaacaaaataaaaataataccaccaacaagacttgcggtcacatacacttctttttgtaaaatgatcggcacttcgttgcgtaaaatatctcgaataagcccaccaaaacagcctgttacaccgcctaatgcaacacaaattaacgggtgcaagccaaaatccagccctttttgcacaccaattacagtaaacacccccaacccaatcgcatcaaaaatcaacaagccttttttccaataatcacggtcgatctgatttttcaaaattgccacaatcaccaccgccactgaaatcatcagcacataaatcggctgtttcatccaaaacacaggggtactgccaatcatcacatctcgcaaggttccaccgcccacgcctgtcacaaaagctaacacaaacataccgaaaatatccattttgtgctggcgtgccgcaatcgcccctgaaatcgcaaaaacaatagtaccaatcaagtcttgaataaacaaaaacgaccacggaaatgggggaaataattcgttcatttgtgttccttaattattagttcatttacttgtgtcactttcataacaataatatatgtagggacacactgcgtgtgtccgtaaatcaacgttgtgggggtttaactaatacggacacacgcagtgtatcccttgtatattaaaattatagtaaactagcaacataaaccataacgttatccacagcttgggtgtccctagagctaaaactcgttctgtagcgtaggcgtggataacttcatcagcaaaaccgaacagttgaaatataaacccgaatacaaggcaggttaccgatgaacgctccgatttattgtggtattgatgttgctaaacgcaatttcgtgattggtttttcccatcagaaaaagaccaaaaccgaaaccaataacgccaaaggtattcaacataccttggactatttaagccagtttaatgtggctctgataacgcttgaagcaacgggtggattagaaattcccgtggcaaaagcccttgctcgagcaggttatcgtgtatttattgctaatccactgaaagccagtgagtttgcaaaatctcaaacgagagccaaaaccgatgcaaaagatgcggttaatctcgctttctatgggctcacttgtgagcttaaaggcgaagtagagcatcagttgtatgttccgctttctgagcaagaagaacagctggaagcccttgtggttcgccgtcgtcagcttgtggatatgcgagtagcagagctaaatcgtttgcaacaaagccacgaaacccagttggacaatatccaacaacacattgaaatgcttgataaattaatcgccgaacttgataaagatatcgacgaccaaagtaagcattttagtgataaagctgaccttatctcagacatcaaaggcgttggcaaaaattgcgtcgccgtgatgatgtcaagcctgccggaattaggcaagctaagcagcaaaagaattgcctcactcgttggcgttattccgcatccacaggaaagcggtcaatggaaaggaaaatccttttgctatggtggtcgagcgattgttcgtaatgccttatatatggcagcactatcggcaattcgctttgaacctgtttttaaagccttttacacccgattggttgcaaaaggcaaagcgaagaaagtcgctattatggcgtgtgtgcgtaaactgctaaccattatgaatgcgttggttagacgcaatgaaaaatgggacgctacacgctacttatccacagaatctgtgggtcaaaattgaataacttttttgtgtgtaaacacagttgctactatgctatttctgagcctcttttttcgctttcgctcttgcaatcgctgccgcaactgctgcttttcttggatcttccgcaacttcagcttttgcaacattttcatcagaaaccaccgcttgctgtgcttctttcttcgcttttgctctggctaaagctgccgcaactgccgctttgcgtggatcattcccctcgcccgcttgcgggagagggacagattcaagcgacgtaatgtcgcgagaatcagggagagggctaacttccacctgcttcgccaaccgtcttgccttacgttgtgccatcaattcgctgttatctggctcaccgttggctttggtttgaactggggtagccgtttctgcttttttcgcttttaagcgttcaagtgctgctttaaccgggtcttcaccttggctatttgccacttcttcacgacgtttttcagcagcttgttgaatacgtgctgtgcgagcttctttctctttatttaaacgggcttcacgagcttcaaaacggatcttcgcttcttccgcttgtttggctttttgatcgacttcttggatcttggctttttcttggcggaaatactgaataagcggaatgtaactagggcaaacgtaggcacaaacaccgcactctatacaagcatctaaatggtattcctttgatttatcgtgatcttctgcacgggcaaaccagtaaagttgttgcggtaacaaatcgacaggacaagcatcagaacagcttgaacaacgaatacaatttcgctctggttctggcggtgcatattcaaagtgatcaggggcgataatacagtttgctgttttggtaatcggtgattgtagtgacggcaaaataaagcccatcatcggtccacctaaaaagacaggaaaacgttcatccgcttgataatccacttgttcaagcaaatgcaaaatcggcgtgccgagctttgcccaaacgttgcctttattgcggattttatcgcccgtcagcgtcaccactcgctcaattaacggctcatcgtccattaccgcacgttttactgcaaatgccgttccgacattgtgcatcacaatgcccatctcaatggttcgtttaccttgcggaatttctagccctgtcagtacttgcaccaactgatcgcttgcccccgacggatatttagtcgggatcactcgcacgctaatatcatttgcaccttttaacgccttttcgaccgcttgtatcgctttcggtttattatcttcaatggcgatcagcacttcttcagggcgaagcacatagcgtaaaatccgcacaccttcgatcatctcatcggcataatcttgcattaaacgatcatcacaagtgatataaggttcgcattctgcaccgttaataatcaacaacttacagcgtttatcggcaacatgtaatttgtgtgatgttgggaagaccgcaccgcctaagcctgcgatccctgcttggtaaactttttgaataatctgatcgcttgttaagcttaaaaaatcatcaatcggctgacgttcgatccacttatcttcgccgtccgtttcaatcacaatggttaattcgggtaagccagacgggtgtgatgaaacgtggggctgaatagcgaccacttttcctgaagtcggactatgaacaggcagttggcgataattatcccctttcgtcaaggcttgtcctttcagcaccaaatccccttgctgaacaatcacgtccccagccgttcccgaatgttgcaacacaggcacatagaaaaatttcggcagatgtaacgaacggatcggcttttggttcgactgttttttcatttcaggcgggtggataccgccagggaaatcccataactttccttcacgaatacggcttaatacatcagcttgcattacttccccccaaccacaattttcttttcaacttcagtggtattcacaatcgggatcaccaaattcgcatcaaatttccagttccagttttgtgtcgtttgtttcacttttatcatttcaatacaatcagtcgggcaaggggcaacacagagttcacaccctgtacaaaaatcggcaatcaccgtatgcatcgctttgtttgtcccgacaatcgcatcaacagggcaagctgcaatgcatttggtacagccgatacacagttcttcgtgaatatacgccaccttcgccacaggctcttcccccgatgtttcaggcacatcaaccccaagcaactcggcgattttcaccaccgtcgcttgcccacctgggatacatttcgtaatgtcgtcgccatttgctaccgctttcgcatagggcttacaaccagggtagccacattgcccgcattgactttgtggtagcaaagcatcgatctgctcaacaatcggatcggcttcaactttcagcttaaccgacgaatagcccaacatcgccccaaaaatcaaggcaatcacagcaattgcaattaaaatatagagaataatggaatgatcgaacattagatttttaccaaacctgtaaagcccataaaggctaatgacatcaaccctgcggtaattaacgcaatggacgcaccttgaaaggctctaggcacatctgccgcgactaaccgctcacgcaaagctgaaaaaagcactaaaactaatgaaaaccctgccgctgcaccgaagccgtaaagcacagactgcacaagattattagataaattcacgttcaacaacgccacccctaataccgcacagttagtagtaattaatggcaaatagatacccagtaaacgatagagagcagagctggttttgtgtacgatcatttcagttaattgcacaatcaccgcaatcaccaaaataaagaccaaggtgcgtaaaaactgagcttcaaggggaataagcagataggtttcgaccaaataagcagaaagcgaagcgaccgtcaaaacgaaagttgtcgccatacccataccgatagccgtttcaacctttttcgacacgcccataaacggacaaagccccaagaatttcacaagcacgaagttattgattaacgccgtactgataattaacagaatatactcaaccatttaacccacgaatttatcatcagaaaatctaaaaaatgtcgtgtattatcggcttttttgctgtaatgaacaacctatttacatcaactcacttacaagcggtcagggcaagatcgcatacaatgcatttcaatttgcaccttgccgaaaatcttgctaaagtgcggtacaatttggtgcgaatttaatattaggaagaacaaatgagccaagaatacttagattttgaattacctattgcagaattggaagccaaaattgaatcgctacgttctgtcgccgaacaagacgataaaattaatcttgatgatgaaattgcacgcttgcaaaagaaaagtgtggaattaacacaaaaaacctttgcaaatttagacgcttggcaagtttcccgcatggcgcgtcatccaaaccgcccttacaccttggattacattgaacacatttttaccgattttgaagaacttgccggtgatcgagcctttgctgatgataaagcgattatcagcggcttgtttgatgagctacggttattgttaatcaaatgatttgttaaaaagagaggttattttgaccgctcttttaacgttataaaaaagatatttattattaaaaaggagttcatatgaaaaacctgatttctattcaatctcacgtcgtgtatggttatgcgggtaataaatccgcaacctttccaatgcaactgctcggagtggatgtatgggctttgaataccgtccaattctccaaccatacgcaatatgccaaatggactggtatggtgctacccaaagaacaaatcggcgaaatcgtgcgtggtattgatgaaattggcgaattacatcgctgcgatgcgatcatttctggctatatcggttcagctgatcaagtcgaagaaattgttaatgcggttaactatgttaaacaacgcaatccaaatgcggtttacctctgtgatccagttatgggacatccagataagggttgtatcgtagcagatggtgtaaaagaaggtttggttaaaattgccatgaaagcggcagatattattacaccaaatttagttgaattacgtgaattaagtggtttaactgttgataatttttcccaagcaattgaagcagttaaagtaattctagctcaaggcccaaaaaaagtgttggttaaacatttgagtaaagttggacaagatccgactaaatttgaaatgctactcgccaatcaagaaggcatttggcacattagtcgcccgttacatacttttgctaaagatcccgttggcgtgggcgatttaactgccggattgtttatggcgaatttgttaaacggaaaatccgatattgaagcttttgaacataccgccaatgcagtgaatgaagtgatgcaaataactcatgattctgggctttacgagctacaaattatcgcggctagagaatttatcgttaatccgcgcagccattatcaagcggtaaaaattgcttaatatagcatggatatttttgcaaaatttgagcatatcgttagccaacatcaaccgacacaaacacattttctcgtcggttttagcggtggacttgattccaccgcattgctctctttattgacaaaattctgtcaaaaacgaccgcacttttccctcagtgccatccatattcatcacggtttaagcccaaacgccgatcattggatgacacattgtcaacacctttgtcgccaattgtccgttccactgatcgtggaaaaagtccaagtcgatcgacgtttaggcgttgaagcgggtgctcgcgaagcgcgttaccaagccattcgtcgttatatgcgtgcagatcatattttgacgaccggccatcatcagcaagatcaaacagaaacctttttttctcgcactaaaacgtggcagcggcgtgcaaggcttgtccgctatgccgatgcaaagtgcggtcttttctgtgccgatttttcgcccactgctccaattcacgcgtaccgaactggaagaatatgttaatagcgaaaatttgccttggatcgaagatgaaagcaatcaagataaccgttatgaccgcaacttcttgcgccatcaaattttgccccacttgtgacaacgctgggcacattttgaccaagccgtacagcacagcacgcaacattgcttagaacaacagcaattgttaaacgaattactggcacaagaattacaaaaatatcaaaaaaatgaccacacttttgacattagccaatttgcgcatttttctataccaaaacaaaaagcgttactgcgtttgtggttggccaattgcgatttacccatgccctcaagcaaacaattggcacaaattattcaggatgtgatcttcgcccaagccgatcgttatccagaatttaaattgggcgacaagctgattcgtcgctatcgccagcacttacacatcacaccaatttatcaagatatcagccatcttgttttgccgatatgcttaaaccaatccattgatttactggataatttgggcaaatttataattaaaacgcaatctaatgaatggattgcaaaatggcaagattacatagttctccttccgccaacacaaaaacctatccatcttgcttttcgttattcgggaacggttctccaccatggtattcatcaagacatcaaaaaactgtggcaacaacataacgtcccctattggttacgccaacgcacgcctttaattttttatggcgatgaacttcaatgtgtagtggtacactaatcccgcagtcctcaataagtggtaaaatttaaccaaacatgaggatataaaaatgcgaagacctagaagaacctttagtgcggaatttaaagccgaagcggtaaaattgattaccgagcgtaaatattctattacacaagcttgcaaagagctagacatcggtgaaacagcgttgcgtcgccggctaagtcaagttcaaactgaatgtcagggctatgtgttgctgggttcaaagccaatcagtcctgaacaacaacgcattcgagagttagaaaaccgtatcaaagagctggaagaggataaagaaattctaaaaaaggctacggcgattttaatgtctctcgagagcaatgataccaagcggtcacgacgttaaaatcgcacggcattaagcgtttatgtgccttatttggtgtgtcagaaagtgcctattatgcgcgtttgaaacggcgacaagcggtcgaaaaacacaccgcacttgcgattgaaatcaaggtcatttttgaggcaagtcgtcaatctgccggcaagcgaactgttcaatcaggtttgagacaaaagggaattcgagctagtttgcggttgattcgcaacctaatgattcaacagggattatttagcaaacaaccacaaaaatggcataaccgaaataaagaaatagggcaagtttttgctaatcacttgaaccgagaatttacgcctgatgcacaaacgacggtgctttgtggcgatacgacgtacattaaagtcaatggtgtttggtgctatttagcggtagtgattaacctgttaaaccgtcaagttgttggttggaaattgagtcgacaccacgatgcgcaattggttgtcgatgcgttaaatcacgcgatgttgcagactaaacgtacgaaaacaatgctgtttcactcagaccaaggcagtatttatgggagtaagcaatttacccagtgtgtgtaaaaacacaagctaacgcaaagtatgagccgacggggcaactgctgggataatgcaccgatggagcgttggtttagaaattttaaatatgagtggatggcatatggtggttatgttgattttgaaagtgcggtcaacgatgtaaaagattatgtgatgtactacaaccacattcgcccacatagctataatcaaggtttgctcccgatttcagctgaaaaaacttatcggggactgttgaattagttgatcactacaaattgatgagcgttactaccgtaagctgaaagtgagtgattagctgagcaaagcggaggaatggaaggggataaaatcggtgttggaggtgtgtcgcaagcggtcagataatggcaaagaatcacaagaaaaagtcttttatatcagtagtttggatgttgatattcaaatattggcgaagtgcgtgcgagggcattgggaagtggaaaacaaagcccattgggtgctagatgtggtctataaagaagacgaatgtgctgtgaccgatgaatggggtgcggaaaatctggcaattttgcgtcgattagcgttgaacttggctcgattacacccgaaaaagcagagtatgaaagggaaattgaccgctgctggttggtcagatgaatttcgagatgagctgttgctcggtgtgtaggttgaaaaatggacaacatatgcggttgccctgcctattacactaaaattgatatcctaaggttgctaaaatatttcttgttttttgatttggcgtaagcgcactctctaatgccagctgagcaaaaaagccattgctaaaatttacttgtgagcttaaacctaaggtcaaaagagatggatttagtctatatgtttgcgtgaagtggctgtttgctatatcgctaaatttggcgttgttacaataatttctaccgcttaatctatgttgatagatcgcgtacgaattgaactgaatttgggcattgtctaatgtggttgcatagtttaataaaagccctgcccccatagccgttgagtgataattcacgctgtcgtatgattttgtaaaaatccgaccgctttcattaaatgcattttgatgtacaaaatcatagttgaaataagtcagtggcaatagcgtaacgttttctcgtttataggatttggcaacgcctagctgtgcactcgcaaagcggttttgataagagcctgtgatattttctctttctcccacaatctgtttctcgtagtggttttgcgagcccccccaatttataccacttagtagtttgaaatggtcaaaatgcgatacataattcaatgcgacattaaatacctttgaacgagcattcgcagaatggaaagtgcctttgcccctttcataatttaggctcattgcaagctgttgtttattatcgatatttgtcgctacccccatacgcaatccgtgtgaattagctctaaacttatccgcttgggtgatgtgataacttggtgtcaggtagaacatatatttttcctgtgccaaattatttttggctaatttagacaaaaacagatcttcgccacccactaatttttttattccgttggtattgaaacgctgaacaaaatagtttggggttaagctaaacagtagattttgttgagcaaagtgggtggttttgatagtgctgtcgttgagcatatcaggcaaatgatcttcagcaatgctgtttaacacggcttgtctatttgcggtattatccagtttcacaaagaaatcttgatacgcttggctgagttctgtagatgttcttgcagtataaaccgcttcaccgacatcactatttggaatatgaaaagcctcttttttaaccttaacttcagcgataagtgtcccttcttgagcaggtattgcttcagctttttccttctctttttctatgttgttcagctgttctgttgatacggtttcagagctactttcttcttttgccgtatcattaggcttaacttccgtatttggttgttccgttgaagctgcttcagaagtactttcctctgttacgttatcattaggcttaacttccgtatttggttgctccgttgaagctgtttcagaagtgctttcttccgttacgttatcactaggctgagcttctgtgtttagttgctccgttgaagctgcttcagaagagctttcttctttggcggtatcgctaggctgaggttcagtaacaggcttttcttcaatcgtatcatcattaattaccgtgtgatttgaagcgagtttaaaatccgctattttaaattccgttgagccattacttagaatttccacgctctcaaaacgattaaggctatttgctaatgagcctaaatcaatttgcactttctgccctgcggcataaaactgaccgcttaacggacgataaagtaattttccgcctttaatgtcgtaatgttgtgcaactagctttgaatttccttgagtgttgaaatttaacaccagtttagctgtgccgtgatgagtatagttttttccgaccgttaatgtcgcaatatcatcactgcccgcaataaccgtgcctttattgtctaaattgttggcaatcgtaccgcttccacttagggttccgttttgttcaacaaacactgaactttcgctaagtgctgagccactgtttaggcgtagctctccaccacgtaccaaggttgcccctttatagctgttgctaccgctgaaggaaagctgtccttgcccttgtttgataaatccaacattcaatcctcgcatttgttctgccggggaattttttgctgtggcaagatgtaggttgtcgtcccacattttttgctcgatattgttagtaaattcgccatttttcccttgggtatcaatcacataataggcttcagttttccctgttgggctttgaatatcacctaaatttaggcggtttgcatcaagtgtcgctacgccgtttaaggctttttgtacatcaagtatgccttgccccattaaatcttcgcgttttaggctatagagcgttttgttggttaagattttattgagtgtaactttatctttatcaggcgtatcgctatatccaagttccgctatatcttgcctgatttgagcctcgtctttcggtatatcctgatcaatatagatgacactaaatgcatcatagtttggtttctgtttgataatcaccttaggcaaggtgtaattttgatttgcggtagataacagcacatcggcgatctgtttgccatttaagaatgggaatttttgagcgacaagagcagctgcaccgctaaccatcggagcggcttggcttgtgccagttaaaggaataaattcctcttgctgttgtcgacctaacttattatgcacatcaaaaagggcatttgccgcatcaattttactgccaggtgccattagggaataagcctgagagcctaaaaagccgttggaatatttgtggataccttgtaaagtcaaggtcctttctccacctgaagaaagctgatttactcgtttttctttgataataattttgccgtcagaggcaatatctataccatcagcatctaacattcccactgcaataaatgagcgaatatcttcatcataacgaggtaaaagttcaaacaaagacgcactatttttcccatcattgcctgaaccaaacacatttaatactttgcgttctttggcaagtttaactatccgctctacttcatttttgttgttataaccattgtaaggatcattgctttctacggtttttaaggcttgttcatagttagagatattttgttcataaggaaaaaccttatagccccaactatgattgacgatgtgtaattttggatctttactgaaaaaatcaaatagatttaagccccaataattaaaatttgagctttctttaaacgcagctccataaaattttgcattaggggcaacaccataaggatcgccatcaccttcaatactgaaagttctacccaaattcttaccaagcaaaatccctgcaacgtgtgtgccgtgtcgaaatgtggcgttatctttttgtgctgaaccgatactacctgcatcatttttataaatatcatcaaaatttttataaccaccgatttcaatggcttttccctgtaagctagggtgttctggattgaataaagaatcaacaacaccaaccaccacattactaccatcaatagcagggttctgctctttggctttttgtaagtttatgatgttatacgatttttcaagggtcacaaaaagatcactggcaaaaaggctagggcttgataacacagcacagcattgcaaaggaaaaagaaactttttcatatgttgtctcctaaaaaatgaatattgttttatgtagggcacactgcgtgtactcgacccaacaaaaatcttaattcgtatcggcggatacctacattcactctgtttcgttatttataatgttgacaatcctactctcaactcacttgaaaacatagaaaagtctgtcaactggctaatacctattaatatttaacatattgtattcgtatattgtgtaatctttttcttgctaaatcaaatattggatgattattctaaaaatttagtcaaaaacaaaaatgacgacattaagacgtaatgatacttatacatctatttgtctactgtggcaggttctgcatctcaatttcgtaacctcataaaaatcgagatgcattgtatctatgttggaaattagaacggctgttattggttaatccgtccttttaagaaatccaacaactgatctttggcaatcatctgtttctcacctgtacggcggtttttatactcaatttctccattttcaagatttttctcaccgatgaccagcatatgtggcacaccgatcagttccatatcggcaaacatcatacctgggcgttctttacggtcgtcgaaaatcacatcaacgccttgtgaacgtaaggttttatacagatcttctgcaaaggtttggacactttcagacttgtgcatattcatcggtacaaccgcaacagtgaacggggcaatcgcatcggtcggccaaataattccgcgttcatcgtggtgctgttcaatggctgcggcaacaacacgagtaacaccgataccataacagcccataatcattgtttgcggacgaccatcttccccttgcactgtcgctttcatcgcttcagaatattttgtgccaagttggaaaatatgccctacttcaataccacgtttgattaacagcgtacctttaccgtccgggcttggatcgccttctaccacattacgcaaatccgcaatttttggtaaagcaacatcacgttcccagttgatattgaagtagtgtttaccgtcaatatttgcccctgcaccaaagtcgctcattaatgccacacttctgtcgataatcactggaattggcatattcacagggcctaacgaaccgatgcccgcaccgattttcgctttaatttctgcttcatcagcaaattcaaacggctccgccacttcttcgcatttcaccgctttgatttcattgagttcgtgatcgccacggatcactaatgccactaacggctgttcttcgcttgcacctttaacaatcaaggttttcaccgttttttcaatcggtagattgaactgttcaacgagttctgcaatggtttttgcatttggcgtatctacaagggtcatctctgccgttggggcttgacgctcgccgacagcaatcgcttctgcaagctcgatatttgccgcataatctgactcggttgagaacaccacatcatcttcaccgctttgagctaacacctgaaattcgtgtgatgccgaaccgccgatagaccccgtgtccgctgcaacaggacggaaatccaagcctaaacgagtgaaaatattgctataggtttggtgcatcacatcgtaggtttcttgaagcgactctttgctggtatggaacgagtaagcgtctttcattaaaaactcacgcccacgcattaccccaaaacgtggacgcacttcatcacggaatttggtttggatttgatatagatttaacggaagttgtttgtatgaactcacttcacgacgcactaaatccgtaatcacctcttcgtgggtcgggcctaatacgaacgggcggtcgccacgatctttaaaacgcagtaactcagggccgtaatcttcccaacgctcagattcaacccataaatccgcaggttgcaccacgggcatttccacttctaaagcaccgcttttattcatctcttcgcgaataatattttccacttttttcaacacacgcaacccggtcggcaaccagttgtacataccagaagcaagcggtcggatcatacctgcacgcaacattagctgatggctaacgacttgagcgtcgttcggggtttctttcaaggttgaaaagagatattgacttgtacgcatttatttatcctatttgtatcaattctataaaacgaaatgggcggtattttaaatcaaaaagcggttagatcgacaaagaattttgcaaattgtaaaaaaatcctcatatctggccgcttgttttaggtaattttagagaaatgccgattcgatcaaaaatccactatggataatccctgagcataatgttagaattacccaaatttttcgctaaccgatagcgaaacttagttctggtgttgtggaaaataaaggctggtttgacttgtattaaaacgcttgaatttagcaaattttcctttacactattcaactctcgcacttagcgaatttatacacataggaaacaaaaaatgagcattgaagaacgcgtaaaaaaaattatcgttgatcaacttggtgcaaaagcagaagatgtaaaaccagaaacttctttcattgaagatttaggtgcagactctcttgacactgttgagttagtgatggctttagaagaagaattcgatatcgaaattccagatgaagaagcagaaaaaatcgctactgttcaatctgcgattgattacgttcaaaacaatcaataatctccatttagaaaaagcgacttttacaagtcgcttttttttctgcctcttattttttctctaaatatatccgttcttaaattgcaaaactaaaccgttttagctactatgcacaagattatttttagactttgaaaggttgatttatgagcagaatttgggtgttaggtgatgccgttgtcgatttaattccggatggcgacaatcattatttgcgttgtgctggcggtgcgccagcgaatgttgcagtcggtgtttctcgtttaggggttgaggctggatttatcgggcgtgtgggcaatgacccactgggtaagtttatgcaacaaaccttgcaagcagaaaagatttcaaccgagcagatgatacttgatccacaacaacgtacttccacagtaatcgttggtttagatcaaggtgagcgtagttttacctttatggtcaatccgagtgcagatcagttcttagaggtcaatgatctgccaaatttccaacagggcgaatggttacactgctgttcgattgcgttaatcaatgatccttcacgttctactacgattgaagctattcgtcgtgtcaaacaagcgggcgggtttgtgtcgtttgatccaaatttgcgtgaatcactttggtcaagccttgatgaaatgaaaaaagtggtgaatagtgtcgtggcaatggcagacgtgttgaaattctctgaagaagaattgaccttattgactaatacgacaaatcttgaggatgcaacgaaagcggttacttcactttatccagagaagctgattattatcactttaggtaaagatggggcgatttatcacttaaacggtaagagccaagttgttgccagtaaagccttaaaaccagtagataccactggggctggcgatgcctttgtgagcggtttgttagctggtttatcgcaagtgtcaaactggaaagagagtgatgcggtattagttgaagtgatccgcaaggcgaatgcgtctggtgctttagcaacaacagcaaaaggggctatgtctgctctgccaaataaggctgagttagaggcgtttttaaaataatagatttgattctcctattgtacaacccaaatataatttacctttactgggcagtacccccaaaaggtaggcgaagatatgatgaagagccattcttacaaacctttagcaaaggtctaatgcgccaataatgcaggggctttcttttggctcttcccccactacaacagtgatatatatttcaaaatccctttaattttttgtgaatcggcaatgtctaacacattatcctgtgatgaagttcccattcttgccgaacttattgaatccattagactttgacgttgccctttggctgaaaaatgaatttcaggcaccttggtttgttcaatgatttgtttaacattatctgcattgaccccacagccagccattacttgaatacgcccattcgcttgtttgactaactgctgaataacaggaatcccatcaaaagcagttgcagcctgtcctgatgtcaaaatacgatgacaacctaagtcgataagttgttcaagagcagtaatgggatctttacagagatcgaaggctcgatgaaaggtgatctccataccttgtgaagccttaactaatagttctgttgttgctaaatcaatctcaccatttgcagataacgccccaaaaacgaccgcttgtatgcctagctgcttggcggttgcaatatcgttgagcattatctgaatttcatcttcgctatacagaaaatcacccgcacgaggacggatcatcaaggctaggggaatagtcgaaatttgttgagcctgctgaataaaacctagattcggtgttaagccgccaaccgcaagggcagagcatagttcaatacggtcaatcggaaattgatttgcagtgatgaccgactctagattatcgacacagatctcaactttcatttattcccccacgataaagcgataatgaatatgatgttgataagactcgtttgctttgctgattccgccatagtgccaccattctgggtggtttggagtatcagggaaaaactcaggttctagggcgactcctgcataatcaggatagcttccgctcgtcaaattaggctgtccgcccagccagttccctgtataaacttgcaatgctggtttggaggtacgaagttcaaggcgaagattatcatacgctaaaacagcatcagcctgacaagcgctcagatcttggcaagattttgcaagtaaaaaggcgtggtcataacctttaacagcttgttgatcggtatcagccagtaaatcttgaccgatcatttttgctgtgcggaaatcaaaacttgttccttcaacagcttttaatggggcgttcggaatgccattagcaccgacaggaaggtatttctccgcattgagttgtaggctatgttgatgaatggttggttcattagaaagattgaaataggcgtggttggtaaagcaaagcggtgtatcttgagagcttaccgcattaaattcaatctcaagttgattaccgttcaaacgataaacgacagttgctgttacttcaccgccaaagccttcttcaccattggcgaaaattttgtaaaaagtgaccgcttgttcatctgccgattgcacctgccacacacatttatccgccccgatttccccaccgtgcaaattattttccccgttattttttgccaaaataaacttttgcccattaagctcaaaggtgccatttgcaatgcggttggcataacgccctaccgttgcaccgaaataagctgattgctcttgccaacgttcaggcgtggtggttactaatacttctcgttgttcatttagcaatttaactacgcaagaaagccaagatgcaccaaagtcagatagagtgattttgagatgatcgttttcaagggtataaattttcatatttgctctctttatgttgcttcccctctcccgcaagcgggcgagagaaatgatattatgactgcataatttaaaccactcgcaccccttcacttgctgtgcaaacatagaaagtttcttgaatgccagtttgtttttggtagttttctgcaatgagtttacgcaacgcttccactttttcatttggaactaagcagacaatacaaccgccaaagccaccgcctgtcattcttgcaccgccatttttgccgatagccacttgagctaattcaactagatagtcaatttctgggatagtgatttcaaaatcatcacgcattgagtcgtgagattcgcccattaatacccctaatttttgcatatcgttggctttcaaggcttcaactgcttctagcacacgatgattttcgctgataacgtgttttgcacgtttgtaagctaattcattaagctgttgtaactctgccgctcgttcaataaattgttcagggctaacatctcttaatgctttaacgccaaagaattgtgccgcaaattcacactcttgacggcgactattatattccccagtcactaaatcgtgtttgacgttagagttaatgatcgcaatggaataaccttgcggtacaggggttgggctaatttctaagctacgacaatcgatcattacaaggtgatctttttgtcctaatgccgaagtgagctgatccatattgccacaatttgcaccgacaaatttattctcagcacgttgtccgattaaggcgatctcggctagactaatcggtaaattgcctaacacttggcaggttttaccgatagaaatttcaagggcagcagacgagcttaatcctgacgacatcggtacatcactggtcattgcaatatccgccccttgaataaattcaggacaacgttcttgaatatatttcaccacgccacgcacatagtttttccatttatcttcgctttgtggaatttcttttttaatatcaaaggcatcggtttcattaatatcaatcgcatagacacgccaaatggaatcgtcacgtttcgcaaaactcacagacataccatagttgatcgcacaaggcatcacaaagccatcgttataatcggtatgttcgccgataatgtttacacgacctggagcaaagacggtttgctgtgatgcataaccaaaatgttgttcaaattgagtttgagagagttggattgggggcattgttatcttccttcttaatttgttatttcggggcgggcacatctgatctgcccccaaaaagctagactgatttagttcaaggactgaattctgtattccacagggcttagtccttttaattttacttgaatacgctcatgattgtcagggcaaccgcatatgttgtccatttttcaacctacacaccgagcaacagctcatctcgaaattcatctgaccaaccagcagcggtcaatttccctttcatactctgctttttcgggtgcaatcgagccaagttcaacgctaatcgacgcaaaattgccagattttccgcaccccattcatcggtcacagcacattcgtcttctttatagaccacatctagcacccaatgggctttgttttccacttcccaatgccctcgcacgcacttcgccaatatttgaacatcaacatccaaactactgatataaaagactttttcttgtgattctttgccattatctgaccgcttgcgacacacctccaaccaccgattttatccccttccattcctccgctttgctcagccaatcactcactttcagcttacggtagtaacgctcatcaattcgactacgttccgcatttacctcctcatacgtctcaagcatttcggggcaatctcggcggattttgtgaaaatacgcctccacttccgactgaaattgacggtgatttttcttcaacggcatcacataatcccctttcttttcgatgattttctccgcaattttcttctgtgtattcatcgcatccaccgttataacggcattttttaagcaaaaactatcgataatttccatcaccgcctgctgctcattttgcttacccgaggattttttctgcgataaaatcaaaccacgagactggctccacaccgtcacactgtgcaaagcactttgggtttccggattgaaactatgacgaagtgtcttgccatcaatcgcaatcacttcacgtccttgttgtgtgcgtatctcattgataaaattaagaaaaacctcattaaatgcttgtggctcaatgcgttttattacacgggcgatagtatcatcgacaggaataccacactcaaaaggacgatattttcgcaaccaatccaaatgtaattcgccaaaaagtttgatttcagtccagctgtttgcccccgaaatcacggcactgacgacgagaaaaacgatgtctaaaaagtggtgtttttgattataggctcgtgggtcggataaattttcaaaaaaacgaaaaacgctcattttacaacctgatttgatatggataattaaggtgtattagatcataaatttgagaaagatgcgatcttgccctgtcatgattgtaataatgaatatattcgtgaatagcttgttccagttgctcaaaggtctcaaaccgtttaccaaagtaacattccgtttttaaacgcccaaagaaactttccattgcactgttatccaaacaatttccctttctcgacatactttgtacgatgccgctttgcttcaatatcgactgataacttgccattttattgtctttttcagcaagatgataaaagaacgtactccgttttaaatcaaccaattgcaataaaatctcaaacggaaattggtggcgtagttccttcacgaggtgtgattatactgattaatccaatatcttaatatggtttccttaacctgaaaatgctgacgagttaatgagcgatttttattatgttgaagataaaattcgatcacttgttgtttaaaagattgggtgtatttagccataaaaaatctgcaccttaattagttggttgtttagtccaacttttggggtgtagatcactacaccacgcaacaatttgtccgtctaattcataaacctaaatcggatatttagcatgatttagatgctgattaaaccacgtttggcggctttcctttgttgctggaactaaatctgccgtcactgtgcgtctttcaatctcaatcacctggttataaatttcaagaattcgagttaaatcatcttgttgtgctaggcggaacatctctatccttaaacttgctcggtacttaactgccaacctagttggcgatattgtttataacgttccctcgcttggaccttttctgtttcatcaaccgacacgaaatcaataatttgattgaagctgttaataaaattgggtaattctgtttgtaatgaaatcaatacatctcggcgttgggcattgcgtttgcctttccacgaaatttcaatcggggtcgtataggtggtgacttcgccggataaattatgtggtacaaaatcacccgcttctcttgcccaaagcgcttcatcaaggctgaatgcctgttcttcggtttcacaagcaatcagcacgcgtttaccttgtcgccacgcttttgcggctagatcgcaagcaagggcttcttgggcggaaagctcgcctacttgggcttggcttaatagatagaattgtacttgcttcactgacacactcttagaaatatagttagacgaattataacttatatttataataaaatagatgtttgaacatattcaaactacatttaatgcaatgtaaattgaaatttaagttaatgaacgttcattatacatctcctcaatctgctcccgatagcgttgcataatcactttacgacgtaatttcagcgtcggagtgatttcttccattgccgtactaaaggcttgaggcaagagagtaaacctcttcacctgctcaaagctcgggagttctttctgcaactcgtggatacgtctttcaaacatctgaataatgtcggaatgcttaatcagctcgatcctatcctgatatttgatattaagttgctttgcatattcctcaaggctatcaaaacacggcacaatcaaagcagaaacatacttctttgcatctgcaatcacggcaatctgctcaataaacttatctttaccgattttgccttcaatgtattgcggagcgatatatttcccatttgaagttttcattaactctttcaagcggtcagtaatgaataaatttccgcaactatccatttcgccaacatcaccggtgcgtaagaaaccatcatcagtaaaagcttttgccgtttcttcaagcttcttgtagtagcctcgcattaccattccgccacgcaccagaatttcattttcctcaccgattttgacttccgcatttggcattaatgtcccaatagaatttggattaaagcccttatcttgccagcaagaaactgttgcagtggtttcagtcattccgtagcccagtttaatgttgatcccaatgctatggaaaaatgaaccaatagaagcttccagctttgccccaccgcaaggcatcattttgatcctaccgcctaataaagctcgcagtttggtcagcactaatttatcggctagagcatattgcaaacgaagccacggtgatgggtgctctatttgataatgttgttcaccaatacgaattgcccagttgaacaaagctcggcgatgtagtggggctttttccactttatcccataccgccgtataaattttttcatagaagcgaggcaccgcacacatcaccgttggtttcagtgtagtcaaggcatcacggacgtggttggtgtcttccaaatagcaatttgtcgcaccacgatgaaaaacataagcaatccacgcacgttcaaaaatgtgcgaaagtggtaaaaacgaaagcgacacatcatcttcattcacatttaaagcaagatcgtgagcatttaattgatgggcaaggttagcataatccagcatcacgccttttggttcacccgttgttccagacgtataaatcagcgtaaaaagatcggataactgtttagaattaaggcgtttttcaaattccgcttcatttggaacaacattgagaaaatcttcccaataacacgcatttggaagatccctcaaatgcatattcgccttcattgccacaattttcattaattgtggacagttgttcgctatttgatagacctgatcaaattgctcttgatcaccaacaaagagaattttaatgtcagcatcattcacaatatattccacttgttttgccgtgtttgtcgcataaatcggcaccgcaacagcccttgcctgcatcgccccaaaatcagcgatagtccaacgaggcatattatttgcaaagataccgattttatcttgaatatcaatatgttgagcaattagagcataagagaagcggtcaatttcttgctgaaaagtttgccacgacatttcctgccattgagcttgttcacggaaacgcaaagcggtacgattaagccatttttttgcttgcaggcgaaatctattcacaaaatggaagtcgagagaagccatctttttatcctgtttattcagcttacaaatgttcgctaatatacttttttcactaagaaaaagctagagaaatgtgaacaaatgtaagctgaaatatagcttatctgtattcttaagcaatggtaatctgtgctttttgtatcattgactgccttactgcatctgctacttttaccgcatcaattggctgttctgtcagaacggattgtgcattatggcttaagtgatttagcaccgttaatgcctcaatttcggttgctcggcttagccacaaaggcacgagtgcatttaagtcattgtaacgttgagtagctttaccgttttcgcgtaaggataaatcggcttcaaattcatcgtacaaattaaattgctggcgttgcccatttgcaagggtgagcgttattgtagagttgaagaaattgataactaatgcccctaattctccgtgaatggatatatcccattcgtgtaggcgataagccgttcccatttctaaggaagcaaatacgccactttcaaattggagcagtaattggataatatcgtggttatcaatgttatccaaatgtgctctattggttgattgagcatagactgattttacatcgccaagtaaccaacaaaggagatcaagttcgtggatttcgttaaatagctttccacctgtcagggatacatcatttttccaccagtttttatttgctgggctatcaatccaacgttgtcgggttgctctggctaccgtaattttgcctaacacattttcttgcataaactgtttggctttcattacaccaggcaaagttctgagtagatgtcctgcaaaaaccgttttatttttttcaagtgcaagttgcattatctcttggctttcttggctatcaatagtgaaaggcgtttcaataaagatgtgagcattgtggttgagagcagtaatagcaggttgtttatgagcgtaattgtaagtcgcgattagaacaaggtctggctgagtgttaatcagtaaatcatcaatgtttgggtaagcaacggattgatacttttcggcgagctgattggcaagattaaaatcaagatcagtaaaaccaactaattcaccgttcattttgtgaaagctatatgctagttgcttgccgaaaaatccacagccaattagagcgattttaattctgttcattgtgatatccttttaataaacattgtctgatttcttggaaatagtagagaatagctcgttgcattcgttctagatcttttgcttcaacggcatcaactaattcacggtattgcaatgctaatgcagttggtgaaactcgaatgggggggagatcattttcaagtttttcatagatttcccaaaatgcatcaaggtattggctgagtaagtggttttgtaatggttggtaaatcagtaggtgaatttgtttttcttctgcgatagaaaagcactgttttcttgcattttcttctaatgtttttactagaagttgcaagcgttggctattttcttcactgatcttaggcaaagccattggggcaaaaccgtattgtaggatttctctaatatcaagaatatcaatgatgtttttgagattatcttgtaaatgcagttgagcataaaatgttagccctcggatcatcggggtaagtgatgatgagccgacaaatgttcctatgccgtggcgaatgtctaaaatatgtagagcttctaaggatttgatggcttctcttaggctagaacgactaacattaaataattcaatcagttcattttcagttggcattaaatcgcctgattttaatttgcgttgaagaatgagcgtcttaattttctcttgtaagtcaagagaagccgctttttttgtaaatttttccatttttctttcttttctgtgaagtagatcacggttttattttttaaagtaagacatcatatgtctaaaaggtaagacgtatgatgtcttgcttgaggtttaattaattttcgatctaaatgtattggttgtaaagcattaattattaatatctcaagggataagaaggtgaatttatggcaacgttatcactgaaaaatataggcaagcggtatgataatggctttgaagcggtacaaaatttcaatcttgaagtgaaagatagagaatttatcgcacttgttggtccttctggttgtggtaaatcgacaactttgcgaatgattgcaggtttagatgatattaccgaaggggagttttatattgatgatctactggtcaatgatgtagaagccaaagatcgagatattgcaatggtgtttcaatcttatgcgttatatccgcatatgacggtctatgacaatatggcttttgccttgaaactgagaaatttttccaaagaagagatcgatcagaaagttaaagaggctgcaaagattttagggcttgagcagttattagatcgtaaacctaaggcattatctggcgggcaacgacaacgggtggcattaggtagaaccattgtgcgttctccgaaagtctttttgatggacgagccgttatcaaatcttgatgcgaaattgcgtggcaatatgcgtgcagaaattattcgtatccataaaaatctcaatgccactacaatttatgttacccatgatcaaaccgaagcgatgacaatggcggatagaattgtggtgatgaaaagcggtattgttcagcaaattggctcaccaaaagaaatttataatcgcccaaataatctctttgtcgctggtttcattggtgcaccgacaatgaattttgtcaaaggagctatctcaaatcaccatttccatacagccacacattctcttttaattagcgagcaatggaatgagcttattcaagctcaaggttttgaaaataaagagatcattttaggtattcgtcctgaaaatatttcaaatgatcctacactattaagtcagtatccacagtcaaaaatttcagcttcaatcaatgtggctgaattacttggtgctgaatatatcttgcataccgatattgatgagcaaccgttaaaagccgttgttcattctcaccaagatgttgtgatggggcaaacgattgaactggcatttgatatgaaacacgttcatttctttgatccacacactgaaatgtcattattacagttatagtacttacatataggagattacactatgaaacttaaaagattgttttcagcgttacttcctatcattgctggcgtgtctgtattagctggttgtgatgataagaacacagctcaaaccaatgctacaatgcctaaagaagggcaagagttggctggtaatattacgttctggcattcttttacacaaggtcctcgtttagaagttattcagcaggctgcaaaagaatttgagcaaaaacacccgaaagtcaaaattaaaattgaaacgttttcgtggaatgacttttatacaaaatggacaacaggcttatcttcaggcaatgtgccagatatgagtacggctttaccaaatcacgtcattgaaatgattaatttcggtgcgttgcaaccgataggcgatctgattgatagtatcggtcgtgataagtttgctgagggtgcaatcaatgaaggaacggttaaagggcaaaattattctattccgctctattctcacgctcaagtgatgtgggtacgcaaagatttgttagccgcaaataatttaagcgtgccgaaaacgtgggatgaactttaccataccgcaaaagcattgacgaaagatggagtgtatgggctttctgttccaatgggaagtaacgatttaatggcaactcgctttttaaatctttatgtgagaagtgcgggggaaagtttattaaccaaagatcttaaagtgaacttgaccagccctattgctcaagaaggcattaagtattgggtgaaaatgtacaaagagacctcaccaaaagatgcagtgaactacaatgtattacaacaagccactttatattatcaaggtaaaacggcttttgacttcaactctggtttccaaattggcggagtaaaagcaaattcaccacatctattagaacaaattgatgcatacccgttaccacgaatgaaggcagacgatcctgaagtagggattgagcgttcaaacattccaatggttgtttggaaagcctctaaacacccagatgtcgctaaagcctttatgaaaacactttacgacaaagacaaatatattcaattcttgaagtcagttccagttggtatgttgcctgcaattaaaggtatctctgacgaagtggcatataaagaagatcctgtggttcagcaatttagccacgccgaaaaagtcatttctgatgcacttgaaaaaggaattgctattggttatgaacacggaccgagtgtacaagcgggtattttaactaaccaacacgttattgagaaaatgttccaagatattgttgtaaatggaacagatccaatggctgcagctcaaaaagcagaaaaagaactcaatactctgtttgaagccattgtagctcaataacttcatcacttccctaatcacttacatcacatactttatgacgaagtattagggaagttttgtctaaaaaactgataaggagctttccttatgtattaccgtcgcaataactatactagatggatattcgtattacctgcgttgttgatcgtttcggtactctttgtatatccgtttctctcaagtatcttttatagtttaccaataaaaacttgattatgccgacatatagctttgtaggattagccaactataaagcggtgttgtcagatcctcgcttttggatgtcatttggtcattcattaatgtggacagccttatctctgataggtcaggtgttagtcggtttcttacttgcattggctttaaatcgggtggaacgttttaaatggctttataaaatcctgttaattgtaccttgggcattcccgatgattgttatcgcattttcttggcaatggattttaaacggtgtttatggctatttaccgaatatgttggtgcagttagggctgatggatattgcccctaattttctcgctgatcgcacttgggcattcgtttgtctagtctttatcaacatttggtttggtgcccctttaataatggtcaatattctgtccgcattacagactattccgtccgatcaatatgaagcagccaaaattgatggagcaaatatgtggcaagtgttccgttatatcaccctaccgcatattaaagtcgttgttggattactagtcgtattgcgtaccatctgggtatttaataacatcgatattatttatcttattacaggtggcggtcctgctgatgcaacgatgacattaccaatctatgcctatgatatggggtggggaagtaaattattagggtgttcttctgcagtgactgtatggctctttatcttcttactgtcagtttgtttcatctacttcaaaattattaaccgttgggaaaaggagagtaaataaaatgaaaaagaaatcttcattacttggcgacatcgtttcccatcttttcttagctacttcaacggtcattgctatcttttctttggtatggatattcatttcgtccgtaaaaagtaaaggggaactcaccagtgaaccaactcggttttgaccaaagatattcacactagattactttgaacacgttattaacgatctcaatttcattgtaaatattaaaaacagcctatttatctcgctagttacgaccattatcgctatcaccatttcggcaatggcagcatacggtattgttcgtttcttcccgaaattaggctcgataatgtcaagactgttggtcacaacctatattttcccaccgattttgcttgctattccatactctattgcaatggcaaaagcagggctaaccaatacaacaagcggtctgatcatcgtctatctttccttcagcgtaccttatgcagtttggttgttagtaggattttttcagactgtaccgattgaaattgaagaaaccgccaaaattgacggagcagggaaattcactattttcttcaaagttgtattaccgcttgttgcaccaggtattgttgcaactgccatttacacctttatcaatgcgtggaatgagttcttatatgcccttattctcgtcaatgatactagcaaaatgacagttgccgtggcattacgatctctaaatggtgcagagatcctagattggggcgatatgatggcggcttcagttattgtggccattccatcagtattattcttttgttttattcaaaataaaatcgcaggaggattatctgaaggctcagttaaataaagtttcatcgctatcggtaaaggtaaattctgtattttaattaatttaggagacaaaaaatgattagatatggtgttgttggcgtgggctattttggtgcagatctcgcgccctttatgaatgaatttgataatgcacaaattacggcggtttacgacccagaaaacggacaaaccatcgcagaagaattgaaatgtgatgcagcaaacagtttggaagaattggtaatgcgtaatgatgtagattgtgtcattgtcgcaacgcccctgagtttggtgatgaagacgatatgttatttgtcaatttggaatttgatgataaccgctttgctgtattggaatggggatcagccttccgttggggcgaacattatgtgctaattcaaggcaccaaaggggcaatcaagctggatatgtatcattgcaaaggcatattacgccttgatggcaaagagagttatttcttggtccacgaaagccaagaagatgatgatagaacgcgtatttataccagtactgaaatggacggtgcaatccaatacggtaaaccaggaaaacgcaccccaatgtggctaagttccattatgaaaaaaagagatgaaatatctgaacgatattttacacggtatgcaaccaagtgaagaatttataaaactactcacgggcgaagccgcaagagctgctattgcaaccgcagatgcgtgtacgctttcagtaaaggaaaaacgtcgggttgaattaagtgaaattattcattaaataatggaaattaaaaccgcactttgaaaaagatagtgtcgtaaagtgttcataagttttggtataacggtaaattatacttgcttatgaacacttttatttagcgagttttgagagaatagcttgtttgtacttccaaagagtagtgaaacaccgcttctattcaaccggagccactttctcaatcggagcttgcccttctgcttcgtcggctttatttggtggggtttgaggggtgtctttgcctagtgacaatgcgtcccacacacttggttttgcttcaaccatagaaccgccacccgtgcaatagcgttgtcctttatctttccaaacaggaatttgacgagggctggagcagtcccaagagccgtagctgttgatacctacccattgaatagttggtatgcttggtagcttgaacgccaaggggtcggcacgtttaaaatagaagttgtcaagcaagcactgaccttccttgaataaattaattccatgtagctgttagcttctgtaccatctaacagctacatgatagtaccaacagaactaaatattctctaactcttccaactcatccgccattgcacttaatgcatctcgagtaagttgggctaatgccttataaaaaccagtatcaaaggcttctactttgcctaagaacttgcttaaacaaggtaaaacaaaatgttcaaagaaatcacgttgagcctcggtagaattaaggttatcttcaatccaagaggctgttagcagtagtaatgcaacgtgatcgggattggctaattcaggcatacctctttgttggcggaaggctacaaagtcggcaacggataatccataggcagaaattgttgtagcaatagctccattttccgcaaaaagagcttgataactgtccgcttgttccgtagggttagcatttttttctacggttgtgagggcagcttcgctctgctcatcggttgtcaaagcccaagtttgacgaagattaccctgttttaaccacgcaaaagtccctgctaaaataggatccgttggactgcgataaaagagattgccgaataaacggcatagtagagaaaagtcgttgattgttgtttggttcataagatcagtttccgtaaaatgaaagcggtatgttacacgaattatttggagaaaataagatgaaatatattggtgctcacgttagtgcttctggtggtattgaaaatgctgtattacgctcagtcgaaattggagcgaatgcctttgctttgtttacgaaaaatcaacgtcaatggcaagcaccgccattaaaagaagataccatcgaaaaatttaaacgtttttgccaagtccaccatttttcgccagcacaaattcttcctcacgatagctatttgattaatttaggcaatcccgaagcggaaaatttggcaaaatcacgtgaagcctttattgatgaaatgcgacgttgcgaccaattagggctcactttgttaaatttccacccaggtagccatctcaataaaatatcggaacaggattgtttagcgcgtattgccgaatctattaacattgcagttgatagcgtgcctaatgtggtggcagtgattgaaaatacggctgggcaaggttcaaatttagggtggcggtttgaacatttagctgaaatcattgagcaagttgaaaataaacagcgtgttggcgtttgcctagacacttgccacttattttcggctggttacgacatcagttcattagcctcttgtgaacaaacttttgctgatttcgataaagtggtcggttttgaatttttgcgaggtatgcacttaaatggctccaaaacactgcttgcaagccgagtagatcgccatcacacgttaagagaaggcacaattgggacagatgtctttaaatttattatgaataatgctcattttgacaatattccgctcattttagaaacaatcgaacctgaaatttgggctgaagagataaattttctacgttctttggaacaaaattaagttatactggtctgatgtgataggttttgtgcagaacaaaacctttgttttatacaaattactttaatttttagctgaggtagttcgcttttctagttctggcgagacaaatttattatgcaaaaatcattattttatttaaccaaaaccgttcttttttctctgaccatcgcgttgtctattgggtatagttcaaacgctgttgcaagtttgagtaccaaacctgcaaccccaacgcagttaaataaagcaaaaacaacggcaaaatttgcctcagcaaaaaaacaagatgtgacacagaaagtaatgaatgtctatcgtcaatgggctggaactcgctaccgtttaggcggtgaaagcaaagcaggtattgattgttctgcttttgtacaagctattatgggttctgcctttaaccaacacttcccacgttcaacggcagaacagcgatatatggggaaatccatctctaaatcagaattacgtccaggtgatttagtctttttccgtaaaaataatcacgttggtgtttatatcggtaatggaaaattcgttcacgcaagttcaagccaaggtgtaaccacaagttctatgtccgagagatattgggctaaaagctatacccaatctcgtcgagtgttttagattccatcctgtatgtttttagctgaaatgctatttcttatcggtataccttttgagcaatggccacttaaataaccagattgaaataaaagtaacaagtccatttcatcatgggtatagtatgtcaatacaaatcaaagtctactataaatttacttgataaataatgaaatttattcaataatggaggtgcactttttagttagctgtataaacctaatttagtgctttcatttattaaaaacaaggggagccattttcggcgttattacccacacaagaggaaactttaaaaatggcaaaaaaagtccaagcctacgttaaactgcaagttgcagcgggtatggctaacccatcaccaccagttggtccagcattaggtcaacaaggtgttaacattatggaattctgtaaagcattcaacgctcgtactgagagcttagaaaaaggtttaccaattccggttgttatcacagtttacgcagaccgttcattcactttcgtaactaaaactccaccagctgcagtgttattgaaaaaagcacttggcttaaaatctggttcaagcaaaccaaacaaagataaagtgggtacagtaactcaagcacaattacgtcaaatcgctgaaactaaagcagcagatatgactggtgctactatcgaaaccaaaatgaaatcaatcgctggtacagctcgttcaatgggcttaatcgtagaggaataatacaatggctaaattgactaaaaaaatgaaagcaattaaagctggtgtagattctactaaagcttatgagatcaacgaagcaatcgcagtgttaaaacaattcgcgacagctaaattcgttgagagcgtggatgttgcggtaaacttaggtatcgaccctcgtaaatcagaccaaaacgtgcgtggtgcaacagtattaccacacggtacaggtcgtacagctcgcgtagcagtatttactcaaggtgcaaacgcagaagcagcaaaagcagcgggtgcagacttagtgggtatggaagatcttgcagagcaagtgaagaaaggcgaaatgaactttgatgttgttatcgcttctccagatgcaatgcgtgttgtaggtcaattaggtcaagtattaggtccacgcggcttaatgccaaacccgaaagttggtacagtaactccaaacgtagcagaagcagttaaaaatgctaaatctggtcagatccgttaccgtaacgacaaaaatggtattatccatactacaatcggtaaagcagacttctctccagatcaattaaaagagaaccttcaagcgttattagcggcattagtgaaagctaaaccgacaacagcgaaaggtatctttattaagaaagtaagcatctctaccactatgggtgctggtgtagctgtggatcaagcttcactataatttcttatagatagattaaaagccgcttaaagttcatgctttatgcggcttttaatttttgcttaccacgcttttccctcaaaaccctccaccaaaaaatcaatcaattttctgacagcaagcggtagtttatccctcgaaggatacattgcataaatgctgaatgtcggcagttgccagtcggttaaaacggcttgcagtttgccctgttgaagttctggttctagcatatattttggtaacatcgcaatgccgttgctgtcccgcacggagttgagcagggcttgggtgtcgttggtggtgaaacggctgtttaggtcgagcaacacttcctgttccccttgcgtacatttccacgctttgcggttgatgttatggtgcgacaaatagtgatgttgatacaaatcttcaggctgcgttggcgtaccgaactttgtcaaatattcaggcgttgccaccaacaatgaatggcaatcagcaagttttcgggcgataaaattcgggtcgggcgtgttggtaatccgaatggcaagatcgatccgctcgctgattaaatccatcgtctgatcgttaagcaacagctgaatattcaacttcgggtgtaactgcaaaaagcgattgaccatttgcaccaaatgatacgccccgaaagtttggctactggtgacacgcaacgcaccacgcaattcaccctgctgtgccatcatttcttgttccatctctgcggttaagtttgcaattctttggcaaaaagcaccgcttgttcgcctgcatctgttagggcgactttgcgggtggaacgctgaaaaagtcgggcgttcagccattcttccattaaagcaacataacggctaatcatcggtttggaaatctctaaccgttctgcagtggcggtaaaactgcctgtttcggcaacggtcagaaagactttgatagcggtgagtttatccatatttgtttccatttatttcttaataagaaacactataattcataaaatgctatttttctaatgttttatttcaatataatgacaaatccaatttaatcagtttgacgattaacatatttttactttattagaggaaaacataatgaacaacttctttgaaaaattagcacaaactttcagtccatatatcctattaatcactcgtgtattagtcggttatatgtttttacttcatggcaccgcaaaattctttgagttaccgatttcaatgacaggcggcaatggtgcggtaccactcttttctctgtttggtgtagcaggtgtattagagattgttggcggtatcttgttgattttaggtttatttacccgtgcaacagcatttattctagcaggacaaatggcagtagcctattttatattccacgctgcttcaggggcgattttcgatccaattagtaacaaaggcgaagctgctgcattatttagtatggcattcttattattgtggcatagtggtgcaggtaaattatctcttgatgcgaaattaggaaaataataggggctgtcctagataacgactaaaatagagcttttagtcgttatctaggacagccccaaattcaatcaattgcctgtgatggtagacgtggcttgatgaaagatttatttaatacaccagtacaaatgtgtcaattttatatggtagcgatagtgatgcgaaaattaagaagaaagcatcagtctatggcaggaaaagaattaaaaaattattgcattgacacttaaacagagttctaaaaaagacgtctatttacgattacattattggcatttaaaatataaagcatttttagaagaatggtcagataaaccgaatgaaaagggctatcatccctataaacatcggaatgtaagaagtgcttatcatagttttaaacgttatatggattatctatttacctatgaaaagcatggcgatttaaatatcgaaaaacgacaaataggcttgaaaacttatttgggcaaccaaaggaaaaattatcgcatcatacaggattaatgaaaagacataagatcatgtttataaaggattttttaaataaaaagagttgctaagaataattaaaaatattcattagcaaccattttgtctactatgccttttatcttagcattctatcccaaaaactatctaatttccaattttgtgggatatccatatattctttttgaatctagtctgatggtataaagcaaggcttgggtagcaactaaaattggatatttaattgttggaaaggaatagtataagctgaaaaacgataatagctgatatgttctaaatagcgctttgaacaagcttcatcagggatttctttccattgttgtaaaagttctctgtttgattttgcaggtttgttgaattgatttatactccatcttccgcataaaaaactgcaaggttgtgcgtaactaagaaacttattcatagatatagcagatatatttttgagcatggtagaacaaactaaagatttcacaactctagttttatgtaacaaacgataaaatttgaagaacatggtacgaattaaccttttatccagatagcacaaatgcccatacttacactatctttttccccacctcttgtgtattttgcaaaattttcccaaatcccaccgcttgtaatttatccttattaccactaaattttcttgcattcccccctaattagcctacaatccgcatcgcctgaatggctaagtttttatgcgactttggtctatataaaaggacgatttctctctatatttggagaacaaaaatatgaaaaaatgggcaatggttttatcggcggtcacattggcatttgcaagccatcaagcagtagcaaaaggcgataccgcctatctctatacttggtctgaatacgtacctgaaggtttgcttgatgattttaccaagcaaacagggcttaaggtgatcgtttctagccttgaatcaatcgaaacaatgtatgctaagctaaaaacaatgggtatgatgtgattgcacctacaagttatttcgtttcaaaaatggctcattaattgaacggatggcataaatgaaaatttatgccactttttatactttaaataggtaatgttatttcataaattattaggagaagatcaagtttaataaactttcaaagatgaataaactttattttatttatacttatttaagtgcttcattaatgatttggattttttatctttttctggcaataaacaatatttccttgttttggttttttgacgctataatttcttttttatcatggttattaatgggagctgcattaacctatagctattctttatcaagatttctttcgcataaacatcgagaaaagatcaccatattctgctttcttatttttcttttgttttgtatttataaagaaattatgccaattcaggatgatatttatgtgaaagtatttaacggtattcgagagttttttatgctgatgaatgcggtttattttggtactctgctattaaaggtatttaaggtgaattatatgaataaccagaataaaatatctaagatatgggattaatgtatcacaagcgctttatttctataaaaactttgcaagttaaatttaatcggtatagtagacaaaatagttgctaaaaagtgatttgaagccttatagcacaaggatttaggtctcctttttgatatgtgaatgaaaaattgtccattttgctaaagcccggaaaaattgagtaatagaaaaaggctatataattcaatcaattaccttcgatggttggagtggtttgatgaaagatttatttaatacgccagcacagatgtgtcaatttcatatggtggagattatgatgcgaaaattaagaaaaaagcatcaatcgcaactatatgagatagcatatgcattaaaactgacatagtaaaaatggttgctatgcctgaaatttagggctaacttacatcagcacctaaattcgtgtggagatgtattaaaatgaatttaaggtaacaacgctagccccaattctttcaaaaatacattatgtttagctgttgcaactttgatttttgcatccaaatccatcaagacctgatgattggcagccaaatcaatttcttcttcaacagcggtattattaacatagcgggcgatatttaggttgtagttgttatcttcaatttcctgcacggaaatgcgtttggcatagccttgtgtttctttgcgatattgataatgttcgataatttttgcgatatgctcgtcagtcaaacggttttgacgtttgcctttttcaaaggcatcagctgcgttgataaataaaatatcgtcttcttttttgcattttttcaacaccaaaatacagacgggaatccctgtagaataaaacaaattagccggcaatccgataaccgcgtctatatttccatcgttcagcaatttcttacggattttttcctccgcccctccacggaacaatacaccatgcggcaaaataatagccattgtgccgttatcacttaaaaagtggaatccgtgcaataaaaaggcaaaatctgcagctgatttgggagcaagcccatagccgttgaagcggaaatcattggccaaatcttctttgggatcccagcggtagctgaacggcggattggcgacaacggcatcgaattccagttttcttgcaggattcatttcattcagaatatcccaatcattgattaaagaatcaccatgatgaatggcaaattccgtatccttcaccccgtgtaacagcatattcattctagccaagttgtaagtggtgatatttttttcctgcccgtagattttgccgatatgtccgccgttttccgccatttgatgacgcacattgagcagcaatgaaccagaaccgcaggcaaaatccagcacgctatccagttttttcttcttaccgctggcggggttttggctatccagcgttacgatttgcgataaaatagtggaaacttgttgcggcgtataaaattcgcctgcttttttacctgaaccagaagcaaattgggcaatcagatattcataggcatcacccaaagcatcgctgtcggcagaaaattcactgataccttcagcaatacgtttgacaatttcagccaatttgttgttgcgctccgtatagctttttcccaacttttccgaattcagattgatttcggaaaacagcccgccaaacgtgctctcaaaagattcgttttcgatatatttaaaaccctgttgtaaggtgcttaacaactcagtgctctgcactcttgccaattcggcaatactgccccacaaatattcaggcttaatcacataatgcactttgcgtcgcatttgcttttcaaaatcggcggtaaagtcagcattttcttgataccataccgccaaaggcgtgcgcttatcatcattgcttaattgcggataatccctacccagctctttttgcgcagcgagttcgtaattatctgataaatagcgtaaaaacaagaacgatagcatgtaatcacgaaaatcgtcggcattcatcgccccgcgtaattggtcggcaataccccataaggttttgcccagttggttgagttgctcttgggtcattgttgtatctctgttaaattaggtagattaaatggatattttgttaaaaaattttcaaatatttgtttaaacaactttttattatcttcattcatctctcgcggctcataaatagagtgatttccgtggctaagtaaattcaaagcacgagcatatagaacttcatcatcaataccacttaaacaatcagaaaaatcattgtaacccaagaaacttgaagttttttctaagatatttctcatcatattgaagtggtatctatcaattttattatcatctaccgctctttgtagttctctaagattcgcaacatgatgaaagaaaggaacatcatctgttgcttgaagataaagttgattagttattttatctttatataaaaagtattttctatgattttgtttttttaattcattgcacattacattaaaaaatagtccatgatgtgaggaaataatgactttaaaattatctttattatcttttaatagtgttgctaaatcacaggcaatggcaatcgtgttattatcatctaacgatgagacaggatcatcaatataaatatattttacccactgataagattcgtgtttatcagctaccaactggcataaagcgagaaaaaaacaccaaataaagatgacttcttcaccacgtgaaattttaattaatttatcagggttgtttggatgagtaaaagaaataaaccaactattataatcaattataaaatcaaattccgcataacgatctaaataaaacctaatattgttttctaatgggaaaccatctcttaaaatatcaaaaaattttgattcagaattaatcaataattttggttcaagtccatcattagtgaaatcattattccagtaaaataaatcctcggtgtaagcattaaaatacagagtattgcttacattaccattctttctctgattctgagctttaacctccatggacgaacgggtttttcccgtaccattataggcataaagtaaaacaaaattttgattattgagatcatctctaattctagtagcaagtcccttcaaggttttatatctagttatttttacttgattattactcatcatcgctcctaaatatttggaaacaattgctgcatcaagcctttcttatgggttttcagacggcctatccgttcgttttgttcgttaattagattatccagtgaagacaggcaatctgcgatggcttgttgttcttttggtgaggtcggtactgcaacgggaaaaatagaaattaaatttaaatctcccctaggcattttcacgccttttgcacctttcatcatatagtcaataaaatcatcatttttaatcgcaaatgacagaaaagatatatttatacttggttttgccctaatgatgataatatcatttgaagccccaccgttcttatctgcctgccatacttttttcaaatacggtcgaatattagaaaccaaaatgtcatttttcttatatgcagtaactttttctgttgtgggtaatttattagaagctgttaccccaccataatcagataataggttttcagtgctgatataatttgggggctctaaatttataacttccattttttcttttacaaaatatccaacatttcttaactcaacaacctcccaccccttacaatttctaaattgcggaaatctaagtttcggataaactatcttgcttgcttgcttgcttgcttgcttgcttgcttgcttgcttgcttgcttgcttgcttgcaaatcattatggcttgggaataattgctgcatcaagccttttttatgctgttttaaggcggcaagtttttgttcctgcaattcgattaattcatcaagtgaagaaagacaatcggcaattttttgttgttcttcgaatgatggaattaaaacatttacctcattaaaaaattcttgaatcccaatattcaacaatccatgatttcttgcaccttcttgggctactttcccaatatcattattttgaacaccagcttcaaaatagtgttcaaaaaaattaccatagtttgaataactttcctttagtttgaaacagatatataaggttgaaactacacctttatcatatagcttcaatggctttatagccccataaggatatccatttgaatagcttttattgtatgcaaaatctcctttatgtagtaaatagtatcctgtaatatctttggctgagacagatttattaaaaaaatccaactgactaattaatccatattgagctgaaattgttagtacattttgattattttctttattttttagcgtaattcgattaaaaactgttgataagggacgattttcccaccccaatgccgtctgaaactcaggaaaacgaagttttgggatcactctttcttgttggttttgcttattctgttctgaagcattcattatttctactcttgaatttgtatattactcaggcaaccagccgttctacaatttggctgcgttctgtccataaaatcggttcgatatcgtaattttttagtgcatcaatcgccgaagctgcgacttccgtttcgccgttattgagcaaaacaaataattcggaattgaccgcacggttttcacgactatccgtccatttgaaaaccgtcgcttcgatggcattttttttcgggttgccgagcgtttgtaagatacgttcgggttgtttgcgcgatttggggatgacaaagtcaaacatatggtcaaagccgcttttgccggtaaatttgatattgggggtatagcgtatatccgagtgatccagccattgcaccacatcttcataaaacaggttggcaacgtagggcgaagccaaataaaacaggtcgttaaccgccagcatggcttgcaggaaattatgttttttcaaggcgaaattttcggcgctggctttgagtatcaaggtttcgccgtcgagctgaacgccgaatcctgccaaagtcatttttaataatgctttgcgtttttcgctatccaaagaacagccggaactgattaaatcgtgaatgatatagccgtcatcactgagcaaaaaaccgttggcttctttgcggatataaaattgcaaacagtcgttatgacgatccaaatgcggagtggtaacctgcacccaatctttatcgatttgttttaaagccgttttgtctttcaaccattggagatattgctccatcaggctttgtatttcatcaatcatatgaataattctctttgaattaagggcttgccgataatatggcaataatccataaatttatccagtagttcataaggtctgtctaacacggattttagttcatcaggcagcggataagcccatttgtcgccgtagccttcccagtagaggtgaatatgcgggcaagtaatttcttcaccatcgggattgcggtgtggtggaccttcaatatccaagcgaaccaatacaatggcttttctggctctggtttggaaggtgattttttccaatgcgatataccctctggttacatccaagttaatatccattgagtgtaacgacaagcgtaatgaaccgcccatatagggaaatttgtattctccattgctgaaatcatattttcccaatgtcaataatgcatctgcctcttgctgtgtcagcatattatttattcctagattgtttattcatatgccttcaagcccgaaatttcttttccttttgccatatttttcagcaagggaacgagatcttccatcaaggctaattctttaatgcgccgttctttccagcttaattccaaaggttcgagcagatcggtgagcttttcgccgtcgaaaatcatgcggtttaggatttcttcgataaagcctctcaaagtatcggttgcaataccgtgtttttgcgcaagtgcggtcagttttgcgtttgtttttgcgtttctgaatgcctgatagccggctttaacttcttgttcgttaagtgcttcgcccgctttcaggctgtctatataggcaatgatgtagtctttttcatccatcaaatcgctgctggcggtaaccagctccgccaattgcttgcggctcatctgctgttttttcggtttggatgagttttcggcaatcagtttcatgatgtagtcgtaatcgatggttacggatgaaaacaacacaaattcaaagtctaattgctcaagctccggcgatggtggcgtttttccatataacgcttgttctttgatttgttgcgccatatccagatacacgcccttaaaagcgcgctgggtatcgcttggcaaaatattttcaattgcctgcttttgctcttcgcttaaatcggtatattgccccaactgggttttgtaacgctgcacttctttaaacagattgataaatccggcacgggcgttgtcgcctttcaggttatgtgcttcagacggcgtacaggtcaatccctgcgatgacatgaaatcttccagttgcgtcatggcgttttgcagtttggttatgacgatttccgctgggtcaacaatccagatttctttggctcggtcttggtcttgccctgaaaaacgcttgatggcttcgtctacttgcgcctgctgtccgcggaaatccaagatattaccgtagggtttggcagaatttaatacgcggttagttcgggaaaaagcttgaattaacccgtgatatttcagatttttgtctacataaagtgtatttaaatatttgctgtcaaaccccgtaagtaacatatcgacaacaatggtgagatcaattttgttgctgtgtggataatctttatcggagtattggtggtctttaattcgtttttgcacatcttggtaatatagatcaaattcattgatactataattggtgtggtactgcacattgtagtcatcaataatagcttttaaggcggcttttttgccgtttggatcatctttattgtcttgttcctcctgaggcaaatcggcttggatttgggcaatgtcttgattgccttcggcgggtggggaatacacacaggcgatattaagcggtgcgaagtcgggattatctgcctgtaacttggcttgtgcatctttaaaaatatgataatagtcaatcgcatcattaatggatgcagtagcaaaaatagcattgaaacgacgctcggaagtggcggcatcgtgcttgtttaaaatggaatcaacaatcgcctgcttggtaacgggatgattggcagatacgggcttacctccatccgccttgtaataatcaatatggaatttcaatacattaccgtcgtcaatggcattggtaatggtgtaagcgtgtaattgctgttcaaaaatatcttcggtggtttgataagatgcgtccgtgccgtcaatgcgtttgtaactagcattttcttcaaaaatcggcgtaccggtaaaaccaaataattgtgcttttgggaaaaatttcttgattgcctgatgattttctccaaattgggagcgatggcattcgtcaaaaataaaaaccatacgtttacctttgagcgcgcttaattgtctatggtgggtactattttctttgagtaccaaccccagcttttgaatggtagttacgataactttatcggcgtaatcatctgaaagcaggcggttgactaaagtagaagtattggtattttcttctaccgaaccttcttgaaagcggttaaattcttcacgtgtttgacggtctaggtcttttctatctactacaaacaagcatttatcaatatcgggattatttttgagcaatgtggaggctttgaatgaagtgagtgttttgcctgaacctgtggtatgccaaatatagccgttacctcggttttggtgaatacagtccacaatcgctttgacggcatagatctgatacggtctcatcatcaaaagcttttgttcgcttgctaccaacaccatataatggctgatcattttgcctaacgtgcatttttccaaaaatttatcggcaaaatcatacaagtaattaattttattgtttgcttcatcggcaagacggtataccggtaaaaaacgttcgtctgcatgaaaagcgaaatgtttgttttgattgttggcaaagtaataggtactactctcattgctgacaataaacaattgcataaaacacagtaaactgttgccgtagccgttgcctgtgtcatttttataatcgatgatttgctcaatggctttttggggtggaatttgcagggttttcagctcaatttgaacaacaggtataccgttaatcaataaaatcacatcgtagcggtgatggctgttttccgtgttgatacgcaactggctgatcacttcgtagtcgtttttgcaccaatctttgatatttaccagcgtataattgagcggtgtgtcatcttcgcggataaaggtgctagtttcacgcagtctcttagcagcggcaaagacatccggtgtgataatttcaagctttaagcgctcaaattcgctatcggttaaacgaacgcggtttaactgttcaaatttctcacgaaaattttcctccagtgattgtctgtcacaaatatcttctcgaaaaatatactttaaatcttgtaatttctttattagtttattttcgataatggattcagcatagttcatcataagctctatcagttcaagcgaaattttgagaatcttaacacaaacagtaaatctattaaatccatttgagtgtttccttagcaacggttttcgggtgttatttctgttaatgcgtatagtgtattgtaaggttgtcatatttactggaattatggaaaatcgacaccaaacgccactgcttgttttatctatccttacctatttcctaaaaaatctaaaatttaacttcttttaaatcaataagttaaatataaatccaaaatcttacatttttgtaagtacttccataaaataagttaaacatctatactgccctcaatttacttacttttaggaagtaaaaatgctgtttatcttattatttatttttagcttaatttttattttcgctattcgcaaaaaaaacacgcttactgcatttcggtacattccgttttgccaaaacgattacccataatcaacaccgtttttatcttgaagaagtgacgtttgacaatcggcagcaagccattcacggttattttcagcttgctccagccttgcaaaattatggcaaggtgcaggaaacggagtacgatttttttgatttttattcggtggtgctgcggtttgacgactgcacgatgaaactggtgcggtggcaggtttaatgtacaggggcaaacagccaactgctcggctgctttcaccctttgcacgcctgtatcgacaacgccattcactcgcaagcaggcgtgcaacttcgccttgcttgtgctgaattgatggaaaaacaagggcatttggaacccacagggcaagcaaaaatcaccccagcatttaacttgccgtctgcctacgttttgcacactgtagggccgattatcagtggtgcgttatcggcaaaagattgcgaactgctcgccagttgctaccgctcttgcctagaactcgccaagcaacacggtattgagagtgtcgccttttgttgcatcagcacgggcgaatttcgtttccctaatcaagaggcagcagaaatcgccgtgcaaactgtcaaagcctttttagccgataacccgcaaatgaaggtagtgtttaatgtgtttaaagatgtggatttagagatttatcgggggctgttgggggagttgataaaaagtgcggtcaaatttccacaaatttttacaattgcaaaatccataagaaatcccaccgcttgcaattagctatttcttttggcttttcaaaatcccattcaaattctcttccaaccagtccaccaaatccacaaggcgactgccagcctgtaagccaaaatccgtcagcgaatattcaacgtgtggcggaacggtgttgtaggatttacgattgagcataccatcttgttccaactgttgtagcgtttgggtcagcatacgttcgctcacgccgtcaatctcacggcggatttcgctaaaccgttttgtgcctttcatcaacacaatcatcaccaacacgccccaacggttagtcagatgttgcaaaatctcacgagaagggcattgagcggataatacataaccccgttcgattgaatttgaaaatttttccatttttatttccttatatttcaatagattacaaaatatcttcatttcttacatttttgtaagtacttctcaaaagtaagttttaatctataatacgccacatcagccagtttggcaaatcgcattaacttaacaaaggaaaaagcaatgaaaaaatcaaccgcacttttcgtttcagcattagcaatggcaaccgcagcttatgcccaaaatccacaatcaactgtatcaacaaaaggaaacacgacaatgacagcccaagttcaaacaaacaatatccgcaatgcacaagcgttaatcaatattttgtatcgggcgacagtgccaaagcttgcagcttgcttgcaccaaactacattcaacacaatagccaaatcgcagacggcgtatcaggcttaaccgctgcacttgaggcaataggcaaacagggtatcacaatgcaatcgcttttaggtgaagtgcgtcggttaattcccaagccgctttggtaatgtagccttcgatagcgtgggtcaatgcgtccatacctgttgctgccgttaatcctttcggcattgatgacatcatatccggatcgacaacggcaacggctggcacatcgtgaacatctacgcagacgaatttacgttttttctcttcgtcggtaattacatagttgattgtcacttctgctgctgtacctgcggtggttggtacggcaatgattggcacgcattttggtgggttggtgcaacgccttcaagggaaaggacatcgctaaattctgggttgttgatgatgataccgataccttttgcactgtcgataggtgaaccaccaccgattgcaatcatatagtcagcaccagaggctttgaatttttctaccccttttttgatgacacaaacagccaggtttgctttcacttcatcaaaaatttcataaggtaagcctgcttcgtcaagtaagttagtcacttttgctacgacttgataacgcacaagatctttgtcggtgacgattaaagctttggtgaaactacggctttttacttcgtgaacaatgtgttgaattgcacctttgccgtgatagctggtttcgttaaggataagacgatttgccataatgtttttcctcttaaaatttacaagttcaaatacgcacaagggagagggcgtaagcgtaaaattcagaagaaaacagaccgcttgatccctctcgaaatcccccctcattcccccttttccaaagggggaagtttgatattccccctctttgaaaaagagggggtaggggagatttttattagtaaagtaccgctttcgcttctggagagtcgatgttttcttttgttacataaactacaccagtatcaataactttctcgactttttcacctttaataattttgccgatagtatcaacacctttgtagcccatttggtatgaagattgcaccacgataccgtctaaagttccgtcacggacgaagttttgaaggtctgagttaccatcaaaaccaacggcaacgattttacctgcgaagcctttttgtttcacagcacgagccataccgactgcggtcggttcgtttgcgccgaagatcgccgcaatatcagggttagaacctaacacgtcttcagtttggttcaatgcggtaaccatttctgaatttgagtagtatggaccaacaattttgtaatctgctttagatttcacttcatcaatgaagccgcctgtacgttcaatcgcagaagctgcaccttgagtgaatgacatcactgccactttaccgcctttcactttagctaataatttttcagcggctaatttaccagctgcacggttatcggttgcaaggaatgattgatagtatttaccatcgctgtttaagcctgagtcgattaataccactggaataccgctttcataggcttttctcacagctggcacaagggctactgggtcagaagccgcaagcacaatacctgcaacaccacggttcacagcgttgtccaccatattgacttgtgcgtcaatcgcagtttctgattcagggccttggaaggtcactttatattttccgcctaaatctgcacctgcagtttctgcacctttacgtacgttttgccagaaagttgagttagcggattttacgatgactgcaatttcgtctgattttgcccacgctaagcctgcaaaaagggtagataaacctaatacagttgtggttacgattgctaattttttcatagttaaatctcctctagagtttatttcttaccaagttttttagattgacggagctggtctaaagacacggctacgataatcaccaaaccgataacaatcatttgcacaaacgatgatacgccattcatattcaaaccattacggagtacaccgataatgaatgacccgattaatgtgccagggatggtaccgacaccgcccatcaacgatgttcccccgactactgcacttgcgattgcatctagctcgtaagccacaccgccgtttggctgtgctgttaccaagcgagaagcaaggattacgcctgttaagccagagagtaagccgctggcaacataggcataaattttgacaacattggttttgataccagataagcgagccgcttcttcatttgaaccgatagcatagatgtagcgacccacttttaatttagttaaggcaaaggtaaagagtactgtgatgaagatcataataatcactggatacggaatacctgcaaacaccacttttggtaaaccatttggaccttcttccacaattttgaataacgcaccgttacctaaggctgcgaaactttccggcatacctgaaactggagcagcgttagtgacatagagtgctaaaccacgagcaaccatcatcataccgagtgtggcgataaatggcggtaatttcatttgggtgactaaaataccattgactaaaccacagataccgccaactaagatacccaacaccatacctaacggcaccggtacgcctgcgtttacaatcattgcagcagcaacccctgaaagggcaactacagaacctgtacttaagtcgataccgcccgttaagataacgcaagttgcaccgataccgattaatgcaatggtcgatgtttgcagaccaacagtcataatgttgttagaggtaaagaaatagtcgttggttacactaaagaaaatgactaagaggattaaccctgccaatgccgccattttgcgaagcagatctttatatttatcactcattttaaagctccttagtttttatattcgtttttgaacatatttctcacgccagtggcatattgcataatctcttcttggttggttttcttggtttccaacatacctgtcattctgccctcacgcattacgataacacggtcggtaatccctaaaatctcaggtaattcagaagaaatcacaatcacaccgacaccattggcggcaagttcatcaattaactgataaatcgcatatttcgccccaacgtcaatgcctcgagtaggttcatcgaaaatcatcacattcgcatcacggaataaccatttgccgataaccactttttgctggttaccaccacttagattattcactaactgctctggtgttggcgttttaatttccattttcttaataaaggtatcgctcgctttcagctcctcattatgtgaaataatgcctaactgatcgcatactttatccattgaagccattgtgatgttctcacgaatagacattctcactgccaccccatttagcttgcggtcttccgacagataagcaatacctgctttaattgagtcgcttgggtcacgaataaccactttcttattccgaacataaatttcgccaccatcaagcggatctgccccaaaaatcgcacgggcaagctctgttcgtttcgctccaaccaagcctgtaattcccaacacttcgccttttaacaagtcaaagtttaacggctcaaatacgcccttacgttctgcattcatcacagaaagcaacaattcatcactgattttggcggtttttggtgggaagtggttatcgagcgtacgccctaccattttggtaacgatttcgtccatcgtaatgtctgagaaacggtggctagacacataagtgccatcacggaaaatggtaatgcggtcgcagatctgttttagttcgtccatacggtgagaaatatagacgatacacacgcctttctctttcaagcggcggacaagctcgaataatttctcaatctctttttcagtgagagcggaagtcggctcgtccataatcaacacttcaacatcaaaagaaagggctttggcaatttccaccatttgctgacgagcaacggaaaggtctttgactagatcggtcggcttcacatcaatatcaaacatattgagcaagtcggcggcatctttattcattttggctttatcaacaatgccaaatttatttggttcacgggcaaagaagatattttctgccacggtaagatgaggaatgaggtttaactcttggaaaatcatactgataccgtctttctgagcttccaacacagaagaataattgacagcttttcctttatagatgatctccccttcatctgcttgataaaccccgatcaagcatttcattaaggtggattttccagcaccgttttcacccattaaggcgtggacttctcccttatgtaattcaagctgaacattctttaaggcttgaactcccacaaaagatttgctgatattcttcattgagagtaacggcgtattgctattgactgcggtcatctctgcctccatcgtgattattttatcggctatctctattgagaaaacaaccgtatattcaaacaaaattgaccgaataaaaagaaattttacgaagtaatttagtttttgtgattcagctcacaaaaaaagcaaacgttctcgttttttgactgcccgattttaagaaaagaagaataaatcgggcaaaagatagaacataggatcgggagtagaaaaaatgaacacaattacggcagtgttgcaatcacggcatagccatccatttcaccaataaaatctacttggctattagcgctgataaaaattgcttcgccttgttgtaaataaatcgagtcatatcctaaatcgacatacaaacttccagacattactaataaaatacttgcacttgttgcagtaaattgttcttcatcaaatggtttaaagctgagtcgctgtaaggcaaagtcctctgcttctggtgttggatataagtgcagtaactcttcactattattttcctcatattgaggaataatcttaggtgtaattgctcgataatcaatcgtatgtagaagtgctgggatatctacatatttaggggttagccctccccgaatgacattatctgaggctgccattagttcaatattttgtcctcgcaaataggcgtgaggtaagcctgcgccttgataaattccctctccctttttgagatttacaatattaaatagatagaaacagagaagccctgcatctagtttatccagacttattttcattgcatcaatagtatatagtacccaatagtcaggatcgtctagtttaagtctatcttgttgataatcctcttgtttattttcaatgatgggcaataaccattctgcaagctgagtttgttctgcttgcataatggaggcataaaccgttggtaaactttgtttttcaatcgctttcgccagaccttgtaaagattgatgcttcattaggctttctttaatcgcatcttcagatttgaacccgtgtaatagccaaaagtctgataatgcaatcatcatttctggtttatgattacgatctttataggtacggtttgaggcatttagtggaataccttcataattttcacgttcaaaaccgtgttctgcctcttttttagttgggtgaagttgaatcgaaagcggtaacttcacatccaaaattttcagtaagaaaggtaattcatctccaaattgttcacgcgatttttctcctagtatttgaggcgccttatctaaaacgcgatctaaaggcaaccatgctccttcaaattcaatcattgaaggagcagaacggtgtgctccaagccaatattctgcatagggtttctcttcgtgagtgtcaagttttaaccagttgggtatgaaaatatctccaccccaatcataatgttgatgtttacccactaatttgaaaatcattttttgtatcctccaaagaaattgacaactcgttcaatatcttctttttgtttaatccgaataaacaatcgcctattattttttagatcaatgactaaaatattctgatctgccaaattaatttgtgcaatatggctatataaaaaatagaaattgccaaagaaaaagccttgttcttttaatagtaaacgagggtaacgaatgaacgccgaatagactgctaagacaatacaaccgcataataagaatacagtgagaggttcaatacctgtttgcactccctgcacgataattaacccaattagggcaattaaaattcctgtgtctaaacttgcttgtcgaactaacggtacgcttaatcgagtttcgccttttcgtctgtccataatgagctgatcatagagaatatagagcaagctcaaaccaatagctaaaatcaaaagtatatttgtcatttgtagaatgttcttaaaaaaagaccgcttgtattttagcacaagcggtctaatttatcggattttttgcaaattatgcaagaatacccgtccacgcaccgaaaataccgataacgaagaagccgatgataatccaaagcgcattcacacggttacgtaataaccacatacacgcaaatgttaaaagtaacggtaataagcccggcattaagctatctaagatagattgaacggtggtaatttccgttgtgccgtcttgtttttgaatagtagaaactacaagcggtacattaatgcttgtccatttctgaaccaacgctcccataataaacaagccgagaattgatgcaccttcggttaatttttgtaataaaccgccgctcatatcttgtacaacatttaagccttttttgtaaccataaacgacgccgtagtaacgggttgctaaacgcacaaggttaaataatacgaagaatagtagtggacctaataagctacctgttaaggcaacgcctgcacctaatgctgcgaatactggacgagctgtcccccaataaatcgggtcgcccacaccagcaagaggccccatcaaaccaactttgatcccgttgattgccgcatcatcaataggtttaccattcgcacgctcttcttccattgcgatagttacccctaatacaggagccgctacgaatggttgagtattaaagaactcaaggtgacgtttgatcgcatctttacgttcttgtgagtttggatctggatataaacgtttgataacaggcaccattgagtaggcgaaacctaacgcctgcatacgctcgaagttccaagaaccttggaagagattagaacggcgtaccaccgcattcaaatcgccctgtgttacttttttgatttcagttgtcatagtcttacttccttagtctaatctgttgtcaaggtcgttgtttgttgcttgcacttgcaccacttgtttactttggttgtatttcgggtgaagttggatataaataatcgcagtgatagtacctaaaacccctaatgctacaaggttgaaatcggtaaatgctgcaattacgaaacccgcgtagaagaatggcattaagtgacctgcacgcatcatattgataaccatcgcataacctacaaccgcgataaagccaccggcaattttaagacctgttgttacaactggcggaatggctgctaacatagattgaacactatctgtacctgctgtcatcgcaacgattaacgctgggattgcaatacgcattgcttgaagtaataacgctgaacggtggatccaatccagcttatttaagtctcctgtttcaatcgctttatctgctgcgtgttggaaaccgactgtaatcgcacgtacaacataagttaaaacttggcctgccgcagcaagtggaatggcgagtgcaatcgctgtcgggatatcttgtccgctcacgataactaagatggttgaaaccactgatgctaatgccgcatctggtgctaatgccgcaccgatattcatccaacctaacgctaataattctaatgaaccaccaacaatgatccccgttttcatatcacctaatacgataccgattaaggtacaagcgattaacggacggtgagtttgccactcatcaaggattgatcccatacctgaaatacaggcgacaaggaatactaagataatttgtaatgtagaaatttccataataatttccttagattaagttatttttcttgagtaaatccatcatatattgacggctatcgttcgatactttacgcacatcaagttcaatacccttcgcatctaatactttaaatgcttcgatatctttatcatcaacagcaacggcactggtaatcattttcttaccatctttatatgccataccaccgatattgatcgatttgaactcaacacctgcttccattaaacgcaccacgtctgtcggattagtgaaaagtaacatcatacgttcattcgcatattcagggttgttgtaaacacggatcatcttatccacaggtacaacatgagccgtcactcctggtggtgctacactttttagcatcgttgaacgcacactatcttttgccacatcatcgttcactaccacaatacggctaacacggctctctttcgtccagcgagtcgccacttgaccgtgaattaaacggtcgtcaatacgcgctagaccaatcactaaattcccttcttgattgacttgagctacttgtggttgtactggagcttgagcagcagtagcaggttgtaccgcaggtgcttcttctttctcctgatagcgtaatgcacgcacgcctaaacgtcctgtttcaagagcgacttccactaattctgataaagacggaccatcatcacgtgccataaaggtttcaacgagcatcggcacgtttacacctgtgacgatatccatattctctttgccttcagacacacggtttgccgcattaaacggactaccgccccaagtatcaacaaggaatagcacctgatcgcagtgagcgagctcattcgctaatttctcttgatatttacccataatagtttcggcattttcaccaggtacaaagtcgatagtggctacatcactttgttccccgattaacatctctgtggttttgagaagttgttctgcggcgacaccgtgggttgctatgataatagcaatactcattggttgctccttatgtgaggatttattcggattattaaaacttattctcaatagagtaaatttcggagtggaattttaaaggatgccgatttttcagcaatctgatttatataaaaatgtgatctacttctcatttttgagttaggtaagagggttatttgctgattttatgagcttatttttttattataaaaaataattatctaatttgactatggagatataaaaatgtctgtatcttatagttgtcacttcagatacagacacagattgtagttagggggatacttcaccatctatcaaacaaattaacagatatattctcagtctagctttgactcaatcaacttaactaaaaagctaatatgatcgctatttgcattcaatgctgaaatatatctgtagttatttcctcctgcatttttaaaattttcctgattttcttcagcaatttcttcaattgtttcaaggcaatctgcggcaaaaccaggacaaataaccgctatgttttttatatttttagtaggaagattcgataaaagttcatcggtataaggttgaagccactcttcactaccaaaacgagattggaaagataaaagccattgattttctgtcaaattgagctccttggctactaaacgggcagtttctcggcattgttctgaataaaagtcaccttctgcttcataacgagcaggtataccgtggaaagaaaaaagtaatagctcattctctgtaagcgttacagtatttgctaatgctttaatatacaaagggtgattatggtaattgtgaataaattcaaaaggcaaaactttcttgtgtttatataatgcttgtgcaaaagcatccagcactgaggctgttgttgttgagctatattgagggtagagtggaagtataataattttttctacatcctgtgctataaggctatcaacagcactctggatactaggattaccgtaactcattccaagttcaatgacaatattgttgttctgtgagcaaaaataagtctgaatagcggcttgctgctgacgagatatagataataaaggagagccatcttctgtccagatagttttataagcctgtgcaactttaggtactcttttaggtaacacaagacagttcaaaataaatttccaacgccacttcggtaaatcaattactcttggatcgctcaggaattgtcttaagtaacgtttcactgccggagtagttggttcatcaggagtgcctaagtttgctaatagcacaccaattttttttgatttattcatagaaatccttcatgggtaattagttatagacgtattatagagtattagcaacatcaatactatttatcaaactaacaggcaaaaatataaatagatattatatttgtcagatttatctctatagtgaaatacagaagacatattagtgcttgctttatgctactgtttaagaaaaatacaaccaataaagtgattattagataaactgtccttgtattaagttttaatgctcatatacattaaactgaaccatgattccattctgtcagagattgttgttagatctaacgcttcagattgttcagtgatacgagtcagatagggatttttatttatatcaaaaatcttttttaagatttttgatggatccaattctttattcttgttattaaagtattctgtaatactatcactaagtgcccattttaattctgtttggcttgccaaataatcttgtaaataaagatttaatatctccgttgcttctgtttgcgaaatatcattaaaggttaggtaatttgctttttcaccttgtcgataataaaaacgtagcgaaagaatagggtgattatttgcttttaataacaaataataaatccacgcttgaataatatctttatctcgcaatccccctactcgccataataccacttcattattaaagcaatttggaacattacctacaagttgatattttctctctgcaaaaataacagagtgttctatttcaataacgtttttctcttgcgacaaataagaagataacgtatttcttaaaagctgaatatcttcggtgagttttgttttattaatctctgcaaaataacgagcgggtagattgccttttaatttttcattctcaaaaaagagttcaatatcctgttcttcgacttgaattagatcatcaagtaaattatatctttctaagccagacaattggaaaatttcactttcttcaattttatcttcattctgttcaaaacgaacccctaattgttgttgaaaaaaatattttatcggttcttgaatataagaaataaactgtgtcagtgaaatatctgacattatatcttcctgcgttttagttaatttctgcaagaaatttttgcgtggcaagatattatttttaacttccaaccactctttatcataagccactttgccatctttgaaattatttgggctaaatacggtcattgggtgaacagacaataatttagcatagtcagctttaggcaggttttctttcaaataatcaaataattgtgtcaccaacaccgatggtaatttttcttggctacttgtgagcgattgcctaatataactgatatagagcatttgttgagccgagagcaaggcttcaaggaaaagataacgatcatcatctcgtcttgagcggtcgcctttttgtggggcgtactgcattaaatcaaaactattgatcgtctgttggcgtggaaactcaccttcatccatacccaacaaacagactactttgaaaggaattgctcgcatcggtaataacgtacagaaattcaccttacccacaaggaaatttaagtggctacgctgttcgctcagctgttgagtaaatagctcaagcatcacatcaatacctatcgcttcttcaaaatggctttgctgaatttgctcaatcacatcacggatagcctgctgtaacgtcaaaatcgcatcaatactttgatcgttttcttgataggtctgtgccacaagggtaaacagctgttcttgccaagcagataggctctgtggctggcaaataaaggcgtgccaagcggtgagattgtcgataaattttgctaaattccctgttaattcagagattaatccataactttcatcaaaagctaaaatgttctgccagccattattttccgcttttaaacttgtgcctaacaataatcggtttagcccattttcccacgaattataattttgccattctgggttctctatttttaagccagatctaatgccaaccgatttaatccattctcttaatgtattaattttctgctcattaaattgatatttttctcgaatagctgaaatatcaaagagatctaatatctcttctgctgagaatttattttctttaatcgataacaattgtaaaaagctagcaataattggattaatataactaattttttgatctgataaggtaaagggaatatatcttctctctttttcataacgagaaaataccgccttaatataaggtgcataactatcaatatccgcagacatcacaataatatctttcggggataagtcaggataggtttcaaataaatataataattgattatataatacttctacttcacgcattttgctgtggcaagcgtgaagttgaatagagcgatcttcattagctaaagagaatgtagtttggtgttctgaatataaaatcgctttttttacttgggttaataatgtcggattttcatcttcaaaatgattataaagtgatatatcttgaatacctgtttcagttaataaatttaaaaattctttcccttgttttccccaaactgttaataatgggtttccttgtttttcaaataactctgctaattctgcttcagataaattatcttttagcgctaatttttctaataccttatcttcacgatcatttgcccagtattccatacttggattagtgaaaaagaggtgaacattgcaatgctcactcaattttttcaatacggcgagctgagaatggggaagggaagaaatgccaaacacaaaaatccgtttcggtaagcgagctttttcagtggcagttaaattatcaagtttatcgaaataacgctgttgcaaataagcacggtgtgaagtattaaaaatcgcttcatcgctatcctgttttatatcggcaaccaacgcattccaaaggatactttgccacgccacattcgttgcaatctcttttgcatttttttgcttaaaagaaaccgctcgcataatctcatcaaccaccgcttgcgattgccccttttcccataacaccaaccattgcggacggtacacgagatattggtcaaacagatcggcgattttctctgctaattgatactgttttagctgatcgccttggtttaaataggacgcaagtgcttcaaaggcaggttgttcaaggaactgcggaataattcgcattaaacgccacaacattgactggcgctcaaagctattctctttcggcaaatcaggaaaaagcacgcgatattgttgccataaaaaactggttgggtaaggaaattgcacattaccagccaccccgatttcttgagcaatctgcatttgcaaccattgtgccatacctaaactttgtaccagcacaatctcttgactaaatggatcggggttgggatctttcgctaagatcgcagtcaatagatttttctgttcggttatttggtttgaataatatactctaaacatagcaactcccctttgtaagcaagctattttagcgagtttggggggaatgatctatttggcaacctaatttataattagaattatagtgatgttattatctatcatataattcccaacgcatatttcaacgcccgttttttcaacggcgttgcacgttccgccacaattaacgcaacattacgcacgactttcacaggtaataaatctgtcttaaaggttttataaaatacgtccattcccgtttgcattaacagattatcaggcttacgttttcgttcgtaaccatttaacaccgcttcatctgcaaaattctgccctttttcgaccgcttgttctatcacttcaagtaaggcttttacatctttaaaaccaagattcaccccctgccctgccagtggattaatcgtatgagcagaatccccgactaagacaatcccatttcgcacatagctttgggcgtgctgacgtgtgagtgggaaactatcgtgagcggtcacttcaaccttgcctaaacggcttggaaaatggcgctgaatctctgcactcaatttctctttgctcatctgttgcagttgagcaatacgttgtggcgaatcataccaaaccacacaaccgttatgttccagtaacggtagaaaggctcttggaccgctttcaaagaactgttgccaagtgacactctgttgcggtaattctgttttgactacggcaagcagacagtgttggcgatattgccagcttgtcaaaccaatgcccgaccagcgacgcacaagggaatttgcgccatcacaggcaatcaatagcggtgcggaaaacacctgctgatcaagctcaaccatccaaacaccgttctcatcacgatttgcagaaatttgctcaaaaccaaccgcttgctgacagtttggatactgtgccaacgcttgccaaagcccaagctgaataaggttgttttccaccatataacccaacttatctaagccaagatcatttgcgtgaaaagcggtattaaagccatcaatttcccacgtttctaagccgtcataaggacaaacccgcattgcttcaatcgcctgccacgcccctaatttctccaacaaggcaacggaagccacactaattgccgaaattcgcacatcataaggtgcatttggatcaaatgtcggcaacggatttttctcaatcagaacaacctttagccctagctttgccagccctaacgctgtcgccgccccgaccattccaccgccaattacaatcacatcttgttgagtcatcgtcattttcctctcaaatttgttaggcagaagtttactacaagcggtgagatctgcattgatttttgcaaaatttttgtgaccctcgtcgaaaaatgattttctctcacttgtctttttgtcataaaaattaacaatctcgtgattacttcactatatgaagtttgcttgttattttgtattgaaaacattacaatcatagaaaatcaattatgtacattattgaacaaactgaaacctttaaattatggctaaatgaactcaaagatcctattgcaaaaattgcgattatccgtcgcttagaacgagcaaaaaacggacattttggagatcataagtcgctaggtgacggcatttatgaaatgcgattgatgataaacaaaggctaccgtatctactatgcaagaaaaggggaaatcatctatctcattatcaacggcggatacaaagacatccaagagcaagacatcgccgtagcaaaaagattctggcaacaataccaacttgaacaggaataaaatcagatgaaagataaatcgtttaacggacaaatatcaacgttcgatgctgctgagtatctcaataacgatgaacttatcgcactttatctatcggaagtgctaaaagacggtgatgaagccgaattcattcaagcgttaaataccattgcccgtgcaaaaggaatgaatgaattagccaaaaaagccaatatcggtagagaaagtttatatcaaacactttcaagcaaaaaaccacgttttgaaaccattgtgaaaattctttcagcgttaaatattgagctagtgcctaaggttaaaactacccaatagcttttatcttttcactatttttgtgacactcgtcgaaaaaccacaatattaaaattgcgttccctgtaaccatctcacaataatatgatttcatcacatacattgacttcattatttgaagtcataaaatagggaaatcaaatgcgaaagaaacatcagcaaacactttatgctattttcgcaacaccaacatcatctaatatcaaatggaaagagatagaatctctgattgaagggttaggtggtgagattattcaaggtgaaggctctagagtacgatttaaactaaacaatagcattgctcgttttcatcgtccacacccatcaccagatacggataagggtgctatcgcaaacttgcgtgaatggcttactaaaataggaattactccaaatggcaacaaaacaacaacctaatattatctatattgatcattatcctgctattgtcagctatgtacctgaattgaagatgtttcgtgggaaatttctcaatacgacgggatattgtgatttcattgccgatagcgtagttggtttatatcaagaaggaaaaatctctctagatgaatatctagcagactgccgtgaaaacggtattgttgcatttgagcaagaaaagcaaaaaacctttacattacgctatgatgaaaccctatcagaacttgttactcaacaggctaaagcacgtggaatttcaattaatcacttgatcattgaagctattgagcaacatttagcacaacgactttaactatttttgtgacactcgtcgaaaaaccaacattttttgctattcaaagatacacatactttttacgctaatataaaaaagaggaaaaagtatgtctttagcgattatttacagccgagcatctatcggcgttgaagccccattagtaaccattgaagtgcatatcagtggcggaagccctggacttaccctagttggattgcccgaaaaaagcgtcaaagaagcacaagatagggtgcgaagtgctttgatgaatgccaattttgattaccctgccagacgtattactatcaaccttgcccctgccgatctccccaaagaaggcggacgttttgatttacccattgccatcgggattttggcagcatcagggcaaattgacagcgataaactcaaacggattgaactgcttggagagctgtctttgacaggacatttgcgtggggttcacggtgcaattcctgcggtgttggcagcaagtaaagcgaaacgggaaattattgtgccacaacaaaacgccaatgaagtttccttggtttcaaatacccaaacctattgtgcttcaaccttgttacaggttgtcaattttctcaacaatcgagatcaactgccgattgctcagcagctttcgcaaaatattgccgaaaacagaccgcttgtcagccgtgatttaaccgatattatcgggcaacaacacgccaaacgagcattgattattgccgctagcggtcagcataatctgttgtttttaggtccacctggtacaggcaaaacaatgcttgctagtcgccttgccgatctgctgcctgaaatggaagatgatgaagcaattgaaacagcatctgtcaccagtcttgtacaaaatgaactcaactttcagaactggaaaaaacgcccgtttcgttccccacatcacagtgcatcaatggttgcgttggttgggggcggttcgatcccgaaaccaggggaaatttcactggcacacaacggcgtgctgtttttagacgaattgcctgaatttgaacggaaagtgttagatgcattacgccagccgttggagtcgggagaaatcattatttccagagccaatgccaaggtgcagtttcctgcttgttttcaactgattgccgcaatgaacccaagcccgacagggcattatcaaggaacgcacaatcgaacgtcaccacaacagttaatgcgttatctcaaccgtttatcagggccttttctcgaccgcttcgatctctcgattgaagttccgctactgccacaaggtgcgttgcaaaataataccgatcaacgtggcgaaactacagaacaggctcgcaagcgggtacttgaagcaagacatttacaatttaatcgtcgggggaaaatcaatgctcaactaacgaccaaagagattgaacaagattgcaaactggctgatcgagatgcgttatttttagaaaatgccttaacgaaattaggtttgtcagtgcgagcttatcaccgtattctcaaagtttctcgcaccattgctgacttggctggagaagcccaaatccaacagccccatctggctgaagctttgggctatcgggcaatggatcgtttgttacaaaggttacaaggggaaagttagttctcaaaaacctctaacaccaacttactcaaacagtccaacaacatcaactcttgattgaccgcattgacttcgcgtaaatcccgttgggtttgttgaataatttgatgccctttcagtaaaccttgagcagtcagctgttggctaaaaggcagaataccgttttgcagatcaggattgagccaacctgttgcgatttgcattttggctttcagggcatcgctgaaaaacgaacccagccattcaagctgttgtagcacttgctcaggctctttgtcaaaagcagaaaagagcaagaaaacatctcggcttttgtaaaaacgccaaaaggtctgcaaaaaggttttacggcttggtaagcggtcagtttcaaggaatgttttgcaaagcaatgggcggttgtggcataaacgaagtgcggtttcaatctcacttggctgtgcggtcggacattccgtttgtagccactcaaacacttgtgacggctcaggcgtatgaaccaaccacgtctggcaacggctttgtatggtggcaagcattgtggcttgcaaaggggcttccaataagaaatacacattttggttcggctcttcaagggttttcagtaacgcattcgccgctgcttccgttaaacgttccgcactggctaaataaactacggcatttccgccttgttgagcaaactgttgtaatttggcagtaatttctcgcacttgatcgatcccaatatctttatcatcaatcggggctaacaggtgaaaatcagggtgattgccgctctgccataacaaacagcttttgcattgtccgcaaggttggctctgttgtggcgtatggcaaagcaaccaatgagcgaaatgacgaataagttgctctgtacctagcccactgtctgttttaaacaataaggcgtgatgcccccgaccttgtaggaaggtcgaagtgatttggtggtggggttgttgatgccaaggataaaggttcatattcattcaacaaattaccagctaataaaactaaatatgctcttatttttcattcgtttcattactccctcactttgcctttgcttctgccaaatctcccctaacccctctttgctaaagaggggaatttactcagataaaaatttcagatcgaagttcttcaaaatgattttggattttgtagatcaactagaatatccttcgatctgatccccctctttagcaaagaggggttaggggagatttggcagatgtaaaaccgaagagaagaagataaaaacttaccaaatcattttgtcaataatctgaaaagatgtatatgcccctttcgtaaatatattatatttacacattcaaaacaatcttcatattatttctcagatgttaaaaatatttcaaccgcttgttgaatatccgccgacacctgttctatcgcaggttcagcgttaatgagcaccgctttcggattatctttgactaaggatacataacgctcacgggtacggtgaaaaaagtcgatatcgagttgctcaatacgatctaacgctccacgccctcttgctcgctctaaacctatcgatggctcaatatcaaggtagatcgtaaaatcaggctcaaaatcacctaaaatcaccgaacctacctcatccaccaattccgctaatccccgtccaccgccttgataggcttggctcgacatattgtggcgatcgccaacaacccatttgcctgaagctaaagctggttcaatcaccgtttccactaactgtatacgagccgcataaatcatcaatacttccgctttgtcggttgtatgctcgccgtcttcgccttctttccatagattgcgaagtgcttcggcaatcggagttccgcctggttcacgagtggtaataaattcaataccgtgagccgctaaggtttcgctcacaatacgttgtgcattgctttttccagccccttctaatccttcaatgacaataaattttccacgcattatttgttctcactctttttatttcgctcaatttggatccattctcgcaccgctttattatgctcatctaaggtacggctgaatttatgcccaccagaaccgtccgccacaaaatagaaataaggcgtactgtcaggctgtgccgtcgccttaattgacgcttcgctcggcattgcaatcggtgtcggcggtaaaccatcaatcacataagtattataaggcgtaggttcaagcagatctttcttacggatattgccatcatatttatcgcccataccgtaaatgaccgttggatcggcctgcaatttccagccatttttcaagcggttgataaataccgatgccacttgcggacgctcattcgccacgcccgtttctttttcgacaatcgaagccaaaattagcatttcataaggcgttttaagcggtaggttttctgccctattttgccaagcctgttccaacgccttttgctgtttttgataggcacgtttaagcacatcaatatctttggaataaggcacatagctataagtatcaggggcaagccaaccttccaatttatcctgagtgattcccaatagtttagcaatgtcagcctctgttttatccgtcaaagtttgttctaaatagcgagcctttgccaactgctcacgccacgttttaaaggtttttccttcaataaattgcacatttaactgcacttctttaccgctattgaaatgttgcaacagctctttcaccgtagcgatattatctaacgcataaaccccagccttaaatttactgagtttagggttaaggcggatcaaatagggtaatagctccacatcatcacgatgaataatgccttgctctgctaatagctgagcgagtttttggcttgatgtacctttttccaacacaaacagttgctcaggtttaacggttaatttatgttcagctaacagattgagtttctggtaaacataaatgccaccgccaagggcaataacagataaaagcccaagagaaataagaattttttttaacattgctatgaagttttaatcaaaagaaaaacagagtaaaccttactataaggcaaccaaaaaagccacgacaagcggaaagattttttcgatttgatgcaaaataaaagtggtgggtcgtgaaggattcgaaccttcgaccaacggattaaaagtccgctgctctaccgactgagctaacgacccatttgggagttgaattctaaagtggtgggtcgtgaaggattcgaaccttcgaccaacggattaaaagtccgctgctctaccgactgagctaacgaccctttagaaaagaacgctgattaagtggtgggtcgtgaaggattcgaaccttcgaccaacggattaaaagtccgctgctctaccgactgagctaacgacccttaacgttgcgtaacgagggcgtatcatacggattttacgttggagatcaaccctttttttatatttttaacttatttgcatagtttacaagcaaataatatcaacaagcggtgagattctgtaaaaattttaccaaatctaaccgcttgtctttaagcgaaaaaaattacgctttcgctttttctgctgcttttacgatcaccgcaaatgcaggcgctttaagtgacgcaccgcccactaacgcaccatcaatgtctggctgagtaaataattctgctgcattcgcatcattgactgaaccgccgtattgaatgatcacttgatctgccacggcttgtgactgttttgcaatgtgaccacgaatgaaagcgtgaactgcttgcgcctgtgctggggttgcagatttacctgtaccgattgcccaaactggttcgtacgcaattactgcaccattgaatgcttctgcacctaaagtatttaatactgcatctaattgacgggcacatactgcttcggtttgaccagcttcattttctgcttcagtttcaccgatacataacactggcactaaacctgcttcttttaatgctgcaaattttttcgcaataaattcatcgctctctttgtggtaagtacgacgctcagagtgaccgataatgatatatttcgcaccgaaatcttttagcattgctgttgaaatatcccctgtaaatgcaccttgtacattcacatcaacgttttgagcgcctaatgcaatgagtttattcgtggtgcattcacagccacagctcgctaatgccgcttctgcttctgctaaatacattactggcggtgcgattgcgacatcacaacctgtaacaccatcaagttctctttttaagctttccactaattctttagtgaatgctttgctaccgtttaatttccagttacccattactaacggacgacgtgccattttgtttctcctattgagtgaaatgtaaaataaaaacgtgcgaactataccaaatttcacagaaaatttattgtttttccgcaagatttcagctcaatatttaaaaataactgttaaaatagccattaagtaacgataaggcactttctcgtgccttttttaatatgagcaaaaaattgtaatggaacatcaagatctactggcattaacggcaaaagaacgaatgaactcatctcgccgtgcaatgttttgtaaaccacagcactttgaatgggcatttgaagatgatggattgcggttgaaattctttttagacgctggcagttatgccatagcgttggtgagagaattagtacagctcgaagaataactaaactttccccctttgaaaaaggggggaattaaaactataaggaaataaatcacaatgaatatactattaagcaatgacgatggctttcacgcccacggtattcaatttttagcgaaagcattaagagaagcaggacataaagtaaccattgttgcccctgatcgcaatcgcagtgcggcatcaagctgtttaacactggttgatccgcttcgtgtgcataaatttgagaatggtgattatacggtgattgcaggtacgcctgccgattgtgttcatcttgcattaaatggtttgcttgatgagccgtttgacttggtggtatcagggattaatcacggggcaaatttaggtgatgatgtggtctattcgggaaccgttgcggcggctcttgaaggtcgtcacttaccgttgccatcagtggcggtgtctttagtgggttctcacggttcaacctatttaacaggcaaatgccatttcgatacggctgcacaagtggtggttgaactattgccgaaaatcacggcaaatcttattcctgcaaatcaagtgttaaatgtgaatgtgccaaatgttccttatcacgagttgcaaggtattcaaattactcggttaggtgatcgttctcctgcggctgagattattaagcaacaagatccgcgtggggcaaatgtgtattggattggggcaagcggtaagccgactgatgaaagcgaaggcactgatttttatgcgatcaaccataactttgtgtctatcacccctattcaaccagatatgactgcatatttgtcaatttcacgtttaaatgagactttttaaatgaaactttttggaacaatttatgataaaacgatggaatggtcaaaacatcgctttgctgcaggctggttaagttttgtcagttttattgaagcgactttcttccctattccgcctgatgtgatgctaattcctatgtcgatgagtaaaccacagatggcaacacgttatgcgatttatactacgcttgcatcagttttaggtggtatcattggttactttatcggcttatatgcatttgattgggtaaaagggattattacagactggggaatgcaagcaagttttgatcaagccatggattggtttgaaacttggggagtagcaatcgtctttttagcaggcttctcgccaattccgtttaaagtatttactatttgtgcaggtgtattgcagatgtcttttttaccctttattttgaccgctgcaatttctcgttttgctcgcttcattcttgtggcaaaattatcagcttggggcggtgagaaatacgccgataagatccgtcgctcaatagaattaattggttggggaacagtgtctattgccgttgctgcctatgttatttataccttattaaaataagaggctattatgaaaaaatcgtttcttttacttccgcttgcagcagtagtgttagctgcgtgttcatcagatacatcgtcagaaacctcgcctaatgttgaagtaacagaggctggatctgcgtggcaaaccgaagttcaacaagtgggtatgccaagctcaatgacacagccaacttatcagcctcaaccaacttatactccgccaccagcaccgcagccgacctatcagcctgcaccacaaccgacttatagccaaccaagcaatgttcaaacgaactacggcggtcaaagtgaagtggtcggaagttgtaatgtggtaagagatggaagtaatgctccgatttatagccaaattcagaaaggttgctatacagacagcacttataccgttgacaaacacgatacgctctttttagtggcttatttgactgggcaaacacctaatcaaattgctgctttaaataatttgagtacagcaacgccattgaaagtaggtcaagtacttagagtaaaatagttttatttgtaatgacatttgaatagacgcagaggttgcgtctattacgatattgagcagacgctgtagcgttttagacttttttgaacgccctttggcgttttcattttctttgaaggataattgaatgaaaaaatcgtttttcttattaccgcttgcagcattagttttgactgcctgcggttcaaatacgcctgcacctgtggtaaatgcggaaggttctgatttatcacctggcgtaatgcaacctattggtatgggggcaaacaatactaattacggctggcagacagatgtgcaaagcacttctatgccaagcacgatggcacaaccaacttatacacaaccgccagtgcctcagcctgtgtatcaagctccgcagccaacttatcaagcacctcaacccgtgcatcaagttgttcctcagccgataacaaagccgacagctaaaacaacacccgtagcgaaaaagcctgtatcacaagattttactattcctcgtgacgctaacaatgcacctatttatagtcaaattgataaaggcttctataatggcgacagctacactgtccgcaaaggcgatacgatgttcctcatcgcatacattgcaggtaaagatgttaaggaagtcgctgctttgaacaatatgagcgagccttatcaacttggtgtagggcaggttttaaaattgggtaatactcaacctgttgaaccaaaacaacaaactgttcagtcaccaaaacctgcaccaaccccagtagaacctgtagtaacttatacccaagcaccgaacggcactgcttatggctcagatggtacaatgactggtcctgtgaaagcgagtgtaggcactgttccacctgctcaaacttctacaaccccaagagtaaacgcaactgcggctaacaataccccgaactacagctcaacatctgtaccagcagtggcatcgtcaattcgctggcagtggccgacgcaagggcgtgtaatttctggtttctctgcatctgaagggggcaataaaggtttagatattgcaggaacgaaagggcaaccagtaaaagcggctgcggcaggtcgagtagtttatgcaggtaacgcactacaaggttacggcaacttaattatcatcaaacataatgatgacttcttgagtgcctatgctcacaacgacagtatcaaagtggaagaacaagataatgttaaagctggcgaaaccattgcgactttaggtagcacagggacaaacagcaacaaactgcatttcgagatccgctatcaaggtaagtcggtagatcctgctcgctacttgccaagacagtaattatgataatttgaggcatagtagacaaaagtgttggtttttctgcaaactatgcctctaatggacaaaagtgttggttttaattatttttcctaattattaccaacacttttgtctactatgcaaaatatcctatctaaatcaccgctttcattagatttccgcctattatttctaacttttattgataaacgttgaaaaattcttgttattttattcttagttttgtgtaaatcattgtgtttttttttttttttactaatagcgtgcggggacatttgtgcatcctgaaaatgtaaataaaggtttacgatgttttattaggaaaaacagcttgtagggtgggtcttgacccaccatgtagccgtaacatattgattttattggtgggttaaaacccaccctacaatattcaatccatctaatatatggtttgtcaaggagttaacttcccccgcttgcgggggaagtgcccgagcgaaagcgagggcgatgggggcatttgtacatcctgaaaatgtaaataaaggtttatgattttttattaggaaaaacagtagagaaggttattatgaataaaatatttagagttatttggagtcatgctcaacaggcttgggtggttgtatctgagttagtaaagtctcatactaaaacatccacttacacggataaaagagctcaagtatgcacctcagattattttttagataaacagcaagataaatttaaattaagtcttttaagtctagtattactaagtatattttttagtccagtaggttcagctgcatattttcaagatagttctactggattgcctggaaatgacgacggtactattggtattggtaaaagtagtagggctgggagtggtgctattactattggtctggactcaacagcgcaagagaactctgttgtcctaggcacaaaagccaaagggacaaatactcaaacagttgcaataggtaaccttgctgaggcaagtgcgtcacaatctattgctatcggggcaaataccgaagcgaaggggtatggctccatatcaatcggtggagatgatttaaagcaaacgatatatggcggtagctatttcaaaacaactgcgagtggtaaagcctctgttgctattgggggtatgtctttggctacgggcgaaggatctattgttttaggtcctgtagcatctgcaaatcatgctgaaggcattgctatcggtgcgagaagtagttctaccgctgagtacggtattgcggttggtggtagtgcaagtgctgatggaaaaaacgccgttgctgttggtagggagtcgataggtgctgggacagattccattgcgataggtaattctgcgagaacaacaggggcagactctgttgttgtgggtgccaatatcgatgtgacaggtgaaaaattagtggcaattggacgcgaagcaagtgctaaaagtcattctactgccttgggttataaagcctctgccggtggtatgcactctgttgctgtgggtgaaagtgccatgacaaataatggtgctgctagagcaaccgcacttggtaataataccgttgtcagcgtgggtggcggtgtggcattgggttatggttctaatgcaagtacagctggcggtgtagaggggttaaaacaagattattcagttgttactggggagaaatcggaagctaatggctttaaatcaacagaaaaggttagtaataatgctattggtgcggtttctgtgggtaatgacaacatcaaacgccaaatcatcaacgttgcggcaggtaaagaagatactgacgcagtaaacgtggctcagcttaaatcactcaccatgcaaacaggaggcgatgacagcagcagtggcaaggtaggcatttggagtggcaaacttgaagttaaaggcactagtgatgaaatcaagaccaaagcgtctggctcaaccatcacaataggtttagatcaagacgttaagactaaactgagtgaaatcgcgaagaaaatgtcatcctttaagattaaaacaaataaggataacactgaagatacaattggggatggagatacaatccagtttaccggtggggaaaatataaagattacccgcgataataaaaatctaacttttggcgtcacttcaggtatgtttagttctaaaacagatggcaaattgtcaaaacaaaccgcagggcttgctactgttgaagctgtagtatcggcagtgaatagtgcaggttggtatctgaagattgcgaaaggggatggtcaagcaacgactcctaatactccatatcttatcaaaatgggcgataccgcaacctttaccgctggaaataatattaaattagaacaaaataacggaaatattacgatttctacgattggtaagttaattaaagagactaaaatcgaaaatggtgatttgaaaattacttataccgatggcagcaatgatactattgctaaggggaaagacggtaaagatggtgcgaaaggtgatagaggggaacaaggccctccaggggtagcaggtcctagaggtgaaccgggtcctagaggcgaagctggtccagtgggtccagcaggaccacgaggacctgcgggtccaaccggtgctcaaggtccagcaggggctaggggtgaacagggtctaaaaggagatacaggtccagtggggcctgctggtccaaaaggagataatggagctccaggtgctaggggagagaaaggtgaaactggtccagcgggtccaactggaccacaaggtgcaactggtcctgcgggtccaaaaggtgaccgtggtgaagcaggaccagtgggccctcaaggtcctgtgggtgcagctggtccagcgggaccacgaggccctgcgggtgagccaggcaagcagggtcctaggggagataaaggagaaactggtcctgtgggtccagcaggggctaagggtgaaccaggtcctagaggtgaacaaggtattcaaggacctgcgggtccaacgggaccacaaggaccgcagggaacagcgggtattcagggacctaagggtgaccgaggagaaactggccctgcgggtgcagctggccctgtgggtcccagcaggcctaggggtgaacagggtcctaaaggtgaacaaggtattcaaggacctacgggtccaacgggaccacaaggaccgcagggaacagcgggtgctcagggacctaagggtgagcgaggaaatgtgagtgtcagcggtttaccgatggcgtatgcaacggaagacggcaaatcaattatcaatatgggcggtaatttctatttggaagaacctgctaaagatggttcgattaagttaattccagtggtgaatgttaaaggtaaattctcaaccaaaacgcaaaatccagatggcagtattacgcttaagtcattagcagtaaaagtgaatttggcaaatgaaactccgatggtattaggtaatgtcgctgaaggggtagcagatacggacgctgttaatgtgaaacagttgaaatctgcgaaaactgaagtggaatctaccgatcacagtgtggtgattaaagagcgtcagggcgataatcagcaaatcgtgtatgatttggcggttgctaaaacgaaactcactgcctctaaggataaacgcaccattagtgcagcagataaaggcaaccattttgcgacaggagatgaagtcgcagtagcaattaataccgcaacagcagccgcaagaactgaagttgaagcgggtaaaaatgtgaaagtgacttcaaaaacgggggcaaatggtcagaatatttacaatgtgagcgtgtctggagatttaagcgacattacttcaattagtaatggcgatacgaaagtatctttaggtaaagataagcaaggaaatccagttgtaaatatgaatggcgccagaattaccaacgttggagatggtagtgctgagggcgatattgtgaatgttcgtcagctcaacaaagtggtttcttctgtgaatacaggatttaatcaattatcaagagatattggtcgtgttgatgttaatgcaagagcgggtattgcttctgctgtggcgatggctaatttgccacaaatttctttaccaggtaaaagtgctatttctgtttctaatgcacaatatcgcgggcaatctgcctatgctataggttattccaaaatttctgataatggcaaatggcttattcgagcgtctgttggcagtaatactcagcgggatactgcgattggaggaggggtaagttttgtgtggtaatctagcacctataaattagaatttcatgctcaatgccgttgttattttaacaatggcattgtttggcatagtagacaaaagtgttggtttttctgcaaactatgtctctaagagcctctcccacaatttgtgtaaatacctgtttctaaaatagtacattcagacacaggtattttttataatgaatgaaacgtggggaaaaacggctaaaattcactaaaataaaggtccttagcgattaagatcattgaaaatttactgcggttaatattgcattttgtttttttattcaactgctacataatgccgctataagagactttaagccactttttagtggctattttatattactcccattccgatacatgcaaaggaaaatacaagaattattctatatcctctgattgtaaatccagcaactctggcgataacacaatccctgttaaatccgcatagacataatcttcaggcaaaaaggtcactccgccaaaattaacaggggtatcaacttcacccaccattgagtcatcagctccaacaggaattggggcgagggcttgaataccaatatctaaggtttctaatacatctaattgacgtactgcaccattgacaataataccttcccagccattatccacggcaagttgggcgagttctgcatcaattaatgctcgacgcactacgccaccaccatcgactaaaagcactcgtccttgaccttcttcttccaacacttctgcaattaagccattgctttcaaagcattttactgtggtgattttgccgtagaaagatgaaagtccgccaaagctagaaaaaataggttcgacgacatcaacctgatcggaataaatatcacaaagttcagaagtatcaacacgcataacttgctccttttttcaattttattggtggaagtataaacctttgcaaaattttgttcaaatctaaccgcttgactgggttgtattatgctctcgatgtatccgccataacattctggcatcaatgtttgatgatgaaatcattgttagaaaaacggctgccccaaaatagaaagcggcttcgcccaccgagaagctgataatttgccctcgttcaaccaaagacatcatcaatgcaaggacaaacaagtctaacattgaccagcgtccgacaaagtgaacatagtgtagtagtttcatctgccagtgaattgggtgtttccagcggtaatggatcgcaagcaacaagtagaaaatcacggcaactttattaaacggcacggcaatactagcaataaagataatggctgcaattaagtaactgcccatttccataaataaaatcaccccgcccattaatgtatctgcggaagttgtccctgcaaattcggtagaggaaatcggcaaaaggttggcagggatcatcatcacaaaaccagcaatcaaggttgcccatacccgttgtagtttaatgctatcggacacatctaaattgctttcacaacgtgggcaacgatgtcgtccttttttatccacgatattttcatcaaaggtatattcgcaagccgagcagatacttggttggcaagggtgatcagcaggcagcgtatgatattcaggataaaacagttcccaccaacgttttggatctattttgataaacagtaacgtggttaaaatcgctgtcattatgaatgcgataatgtagtagtcaaactccaacttggcatattcacgcactttaaatgccgccacggcaatcgccacgagataaacatctaacatcacccactgtttcgctttgctgagtaaaatcaaggtgtagcgtggtctatggtggattagccgttgaataaagatcaacaataccaagccagcaaaggcaaaaggcataatcaccgaacagagcaaaatcataaatgctgtgtagggaaagccttccgtcgccattttccataccccaccccagacggacgcataaatcggtacgcctagtaggtcgatattcatcaacggcagccataagccaaaaggcaataaaataagaatagataaggcgataatggcacaacgtcgcaagctccaacggttaccagattgcaatacttcattgcaattcgggcaacaagcggtctgattgggtagatcttttgctatgctgacaacgctatcacattcaaggcatctctgtaagtaaatctcgtcttttttcattctttggttaatcgctgtgcaacaggggcaaaacttttacggtgataaggggttacgcccagactttctaatttttcaaaatgtagcttggttggatagcctttatgctgtgcaaagccgtactcaggatactgtttatcgagttcgtccatttcctgatcccgtgccactttggctaaaatagaagccgcactgatttcagcaacaaaactatcgcctttcacgaccgcttgtgcaggcataggcaaagttggaatacgattgccgtccaccagtacaaaatcaggttgaatacgaagccctgcaaccgctcgttgcattgccaacattgtggcgtgcaagatattcagctgatcgatttcatctggctctgctcgccctaaagaccaacataatgccttcgctttaatttcttccgccaacgtaagacggcgtttttccgagagtttcttcgagtcggcaagcccttcaatcggctgattaggatcaagaataacggcagccgttaccaccgctccaaccaaaggcccacgcccgacttcatctacccctgcaatgaactttgcttttggatattcaaacatccatcagttttcttccaaactataaggcaattcaaataatgccaagctgacattgccgacacggaaattggcttctggctcaagttctttatttagcaccacttgcaaccaaagctgttgttgataacgctgtaccgccaaaattgtccccgtgcttttccagttctcgcccaactgcatttcaatgctagaggcgatcgctggcagttcgatctcaccttccacattacccacaaaggtaaacatcgcccgtttatttgccccacgatatttcgcacgagccaccgtttcctgcccgatatagcaccctttggtaaaggaaatcgctttatcaagtagttgcagattggttgcctgtggaattagctcaaactgattagccttgtagagtaatggcacgccctgctgaatatcaatcagattccacaaacgactatcgccattggtttccaccacaatatcgccccaaaagatcgcccgtttaggctcttcgtcaaggtaacaagcggtcacattctcgttaaattttgcaatgatctcaccgcttgtcgttccaaacagagcctgatctaattcggtaaaggtcactttggaaaacaccgcatatttcttcaactgcaccagtgcctcaggcaacagatcttgttgaataatcaggaaaaattgctccgccgttgcacgatataaacggaacaacgcactcatttttcctttcggatcacaatggcaagttaagctctgctcaccaacagcaagtttcgctacatcacaagtaagctgtccttgcagatatttttccgcatcaatcccagctacttcaatcaagcgatattgagttaaagccacacacaattcaggctgttgatgtgtcactttttgacattcacatttcatcttattatctcaaaatagggttaaaaacaggcggatcatacacgatttgcccgatgggataaattgatttgctgggggaaatttgttactccaagctttcccccaaataatcagcacaatcaaggcgtaagcgagcgcagaaaccagctgcccatttagcaccgcatttaccgcaaaactgcccaccaaaggataaatcaacaacagcagattttccgccgccaccaagccgaatgtggcgaacagccgttttttatgttgcaaagcaagggttttgagcgaacggaacattgttggttcgaggggtggctcaaaggtcggttcaagatttgctaaggacatcaagccaccgtatccgttttgtcgatttgctcacggcaaaccgtgcaaaattccgccaacaacgcaaacagttgagcggtctttttctcgcctaattttgcaaaagttttatccgccaactgctgtgtcgcctgccaaactggttccgccttcgccttgccgtctgcggtcaaacgcatcattttttcccgtttatccaccgcactttcgctaaactcaatccagcctttttccttatattccttgcaaacattaaacaccgtctgtttcggcaacagccattcatcgcaaatctgcttttgcgtacactgcccattttccgccgccgccaacgaaaacagcaccgcaaaatggttataacccaagcctaatttagcaatccaagcgtccattgtggcatctacttcaccgatttgtttgcctagtttgtcgaagttgctcattgtttaaagtcctaaaaattactaaattgagtgctattttagatgtgagaaagagaaaaggcaagagatattggtattaaaatttgctttttaaaaggtgaaatatctttttatcaattgaaaaaatgttatttatattcactttttcattggaaaaagtgtgtttttagcaagattttcgttgataaaaatgtttttgctgcctaaatttaaaggggctttaaccgagcaatatgtgttacaacaattgcttgcaacccaagaaaatcccgttttttattgggcaacagaaaaaggcacggcagaagtagattttgtactacaacgcaaacaaaccgtaatccccattgaagtcaaagccgaagaaaatttgaaagccaaaagtttgaaagtgtacgtagaacaattccaacccgaacaggcttttcgtttttcaatggcggattttagggaacaggattggatggtgaatgtgccgttgtatggatgcctagcggcttagtttctgttgaatattattgtagaatattaaatcattggtgaataacaaataagaatttctattggataataaaaatggctaaaaaagaaattaaaacagatctttgggtttatgatttattaaaagatgcagaattagatttatgtccgcaaggtagcgatattgctgaattggataacgccctgaaaacagcatctaaagcacaaacaggtaaagcagggtatccagaatattgtggtgttgtgaaagattttgtcattgtaatagaagataaagctgatactgctaaccatatcaagcacaatgataaagatctaatttgtcaaaacgctacaagtgtgagagatttcgctgtaaatggggcattacattatggcattcacctagcaaaaaatacgagttataagaagattattgctattggtgtatcaggcaatgaaaaacgccataagatttcgccactcttcattaatgaacgtggagagtataaaacattggaagatgttgaaacgtttactttattcaatgaaaagaatattggggagtattacactaaaaatatcttaaaagagcagacagatgaggaaaagaccactgctgaaattttaaaagatgccaaagaattacacgaagatctacgtaattacggcagtattcaagataaagacaaaccactgattgtatcgggtattttgcttgccttgcgtgaaattgagtataaaaattttgatattgataacttaaatggtgatgaaattaaaactgatggtcagaaaatttatgaagcaattcaagcaaatttagaccgtgctcaagttaaaccacaggtcaaaaaagataagctacttagtcagtttttagttattcgtgataccaaagccattaatgaaattaattctacattaggaaaaaccccactaaagcattacactcaatttatttacgaacatatttataaaaacatcaaatatattcactctgcggaagactatttagggcgtttttatggtgagtttatgtcctattccggcggtgacggacaaactttaggtattgttttaactcctcgtcacatcgttgaattgttttgtgaactgatagatttaaaaccaacagattctgtatttgatccttgttgcggtacagctggctttttgattgccgctatgcaccatatgttacaaaaaacagataaagaagcagagaaaagaaaaattcgtaaagaacaattacatggtatcgaattgcaaccttatatgttcactatcgctacaacgaatatgattttacggggtgatggtaaaagcaacttggagcaggaagattttcttaaacaaaatccagcacaattacaactcaaaggctgtaatgttggcatgatgaatccaccgtattcgcaagggtcaaaagctaacccaaatttattcgagatttcatttactgagcatctacttgactctctaaccgcagacggcaaagccattgtgatcgttcctcaatcatcaatgactgggaagagtaaagaagagcaggcaatcaaagaaaatattttgaaaaagcatactcttgaaggtgtgattaccttgaacaaaaatacgttttatggtgtcggtacaaatccttgcattgctgtattttcaacaggcattccgcatgaaaaagacaaaatcgtcaaatttatcaactttgaaaatgacggttttgaagtacagaaacatatcggcttagtagaaacaatcagtgcaaaagacaagaaacaacatttgcttgatgtttggtttggacgtatcgaagcagaaagtaaattttgtgtagaaacgactattgaagctgatgatgaatggctacattcgttttactactttaatgacgaaatcccaactgaagcggattttgaaaaagtcattgccgattacttgacctttgaagtcaatatgataacgcatggtagaggatatttgtttggattggggaaagatgatgagtgagttgaaattgacagatagagcgtggaaaagtttctttataggagggaaacaaggactttttgaaatcaaggcaactaagagcggaatcgacaaaaataagttgaaaacatcagacataggaacaacaccttatataactcgcacagatttagataatggcattaatttatttgtgcctgatgagcaaatgccaaaatataaaaaagatggtggtaatgtgattaccattggtttggatacacaaactgttttttatcagaaaaatgcattttggactgggcaaaacattcaagttttgaaaaatcaaaacttgaattattgggtagctatgttcatcattccattattaaaaattcaaatgaaaaaattttcttggggaagtactggggcaacattaggtcgtttaaatcgcacaagaatcatgctacctgaaaatgctaacggacaacccgattggcaatttatggaagattttatcaagcaaaaagaagaaaaacaaaaatccaacttactagaatattacagctcaaaagcattggatttgatgttgctttcaggcagtctaaaagatgtgaagtggggttgttttgaagttcaagaactatttacttttgaaagtaaaccatccaaaggattaaaccatttagaaaaatgtacatctggcggtacaaattatgtaggggcaactaaccgtaacaacggtgtattggattatgtaaccgataatccaaaattaacttatcgcggaaatgctatcgcttttattcgtaatggagaaggtgcaatgggctattcaatttacaaagcggaagattttatcgctacacaagatgtttcggttggatataatgaaaatttgaataaatataatggactgtttattaccactgtcgctgatcaaattcgtggtaaatataattttggctacaaaagaaatcagcacagattaaacaaagaaaaattatctttacctgttaattcagaaggacaacccgactggcaatttatggaaaactttatgaaacaaattgagcaagataaaatttctgttgtacttaattattataaaaaatcttttaataacaataacttgtgcgggggggggggggtagagacacatctactgcctaaaaatacgtggtcaacctttgctatacaggatatttgtgatatttattcaggtgtgcgtttgacgaaacaagagatgataaatggtaatttgccatttattggcgctagtgattcaaataatggtattactgcttttattgctaacacaaatgccagtttggatcggaatgttttaggagtaaattataacggaagtgtggtagaaaatttttatcatccttacgaatgcttattttcagatgatgtaaagcgtttaaaaattaaatcagaaagagcagggaaatatgcttatttatttttaaaaacggttattttgaaacaaaaatccaaatatcagtatggctacaaattcaatgcagagcggatgaaaaaacagaaaattctgttaccagttaatacagataatcaaccagattgggaaaatattgaacgttatatgcaacaaattgagttggaaaaaattgtatgttatttaaagagtaaacattattcctaataaatatatgaaaaggtcgtctgaaataaattttcagacgacttattttttgtatacttacgaatagactaaacaagatttcagttaaggagtttgtatgaccaaatcggaaatggtttcttcggtggcggaatatctcacctttatgaccgccacaggcgagagccaagtcaatgccatttatgcggacgaaaatgtctggctaagccaaaaaatgatggggcagctttatgatgttgaagtacctacgattaactatcacctaaaaaaagtctttgatgataatgagttatcggaaaattcagttattagaaattttcgaataactgccgatgacggtaaaaattaccagaccaaacactataatctttcggcgattattgccgtgggctataaagtcaattccgagcgagcggtgcaatttcgcaaatgggcgaccgagattattcaaacttacaccatcaaaggctttgcgatggacgatgagcggttgaaaaatgacggcacacgtttaggcaaaaagtattttgaagaacaacttgcccgtatccgagaaattcgcctgtcggaacgcaagttttaccaaaaaatcactgatatttatgcgacttctattgattacgaccgcactgccaccgcgaccaaacgtttttttgccacggtgcaaaataagttgcattgggcaattcacggtcataccgccgcagaattgattgtggaacgagcaaacgccagcaagccgaatatgggcttgaccacttggaaagatgcaccacagggcaaaatttacccttttgatgtggtggtagcgaaaaattatttatccgacaacgaattggctcaactgcaacggttggtatccgcttatttggatatggcagaagatatggcattacgtcaaattccgatgacaatgcaagattgggaaaccaggctcaaccgctttttagacgccactgaccgagccatattgcaagacgcaggcaaagttaccgccgaaatcgccaaagcccacgccttgagcgagtttgaaaaatatcgtgtcattcaagatcaacattttgaaagcgattttgaccgcttgttgaaaggggaagggtaaaagagtggtaggttctggggagattcggtatttttgctggcatattattcggaggtatcacttattggcttgttgggttattttcatctagcttagctatagctgctggaattgcaataggtatgatattttggattgtgataccatctgtaaacaaaatgcaataactaagttaatatgtaatgcctccaatatgggggcattacatctcagaccgctgacaaactatatattaaacagattgaatattgtagggtgggttttaacctaccaataaaatcaatatgttacggttatatggtgggtcaagacccaccctacaagctgattatctatttatttgcaaaatcttcatgagagaataccgcttatttaattaccaagtggtataaaacaaatagatatttctaaataccacttataatattacttcatctcagccaacgccaaatccgccatttcaagcgtataagcaatatcttcgtcgctatgtgctaaagacataaaacctgcttcaaaggctgatggtgcaagatagacacctttttctaacattttatggaagaaggtattaaacgctttcacatcacatttcatcacatcttgatagctttcgattttggtttgttcggtaaagaatagaccaaacataccgccaacatactgaactgtcatcggaataccgtgtttatccgctaatgctttgaaaccttccgcaagggttttggttttctctgcaagcagttgctcattacctgcttttgatagctccgttaagcaagccaaaccagcggacattgcaatcgggttacctgaaagcgtacctgcttggtaaacagggcctgttggtgcgataaattccataatctcttttttaccgccaaacgccccaaccggcataccaccaccgatgattttaccaagcgtggttaaatctggggttacgccgtagtaactttgagcaccaccaagtgcaacacggaagcctgtcatcacttcgtcaataataaatacggcaccatattgagtacagagttcacgcaagccttgcaagaagccttcttttggcggaatgcagttcatattacccgccacaggctcaatgattagacaggcaatgtcgtttggatattgttcaaaggcttgtttaaccgatgctaaattattgtattcgcaagtgagtgtatgttttgcaaaatcttcaggtacacctggtgagcttggctgacctaaggttaatgcccctgaacctgctttaactaatagtgaatctgagtgaccgtggtaacagccttcaaatttaataattttgtcacgtttcgtatagccacgagcaaggcggatagcagacattgtcgcttctgtgccagagctgaccatacgcaccatttcgattgacggcacaagtttgcagactaattcggctaattcaatttcaatggcagtaggcgcaccaaaacttaatccgttgggtacggctttgagtacggcatcaataatggctgggtgattatgcccaagtaccattggcccccaagagccaacgtagtcaatataacgcttgccttcgctatccgtaatataagcacctttcgcactgtcaataaacacgggcgtaccaccgacacctttaaaagctcgcacaggcgagttcaccccacctgggataacacgttgtgctttttcaaaaagagattgagatgttgtcataagaatccttaacgtgaatcacgtaaaatggagttattttactgtaaattacgctttctgcgtgaaaaaaaattgagtgtttcagcggttatgctatgctagccagcattttagttttcccttattgaaaggataaaccgagtatatgtggctgacatttattgctgtatttttggtttcttttatctcacttattgcaatgcgtcctgtggcggaaaaaattggtttagtcgataagcccaatttccgtaaacaccatcaaggtgtcattcccttaattggtggtattgccctttatcttggcaatctcgctttctacttattggaatgggaacagatgcaattgccagagctgtatttgatcgcattaaccattttgttaatgattggcgtgttagatgatcgctttgatcttagtccatttctgcgtgcaagtatccaagccgtactcgctggggcaatgatttacagcggtttatccattgaaaacctagaacaactgaacgctccttttagcttggaaattggggcattaggtgtcgtactaaccgtctttatcaccatcggcatgattaatgcgttcaatatgattgatggtattgatggcttgctcgcaggactttcttcggtaagttttgctggattaggcacattaatgttacttgacgagcaatatacgctagcctattggtgctttggtattatcttggtgttactgccttacgcaatgtttaatctcagcgtttttggggcaaaatggaaagtctttatgggcgattcgggcagtaccctaattggttttaccatcatctggattttactactcagcacacaaggacaaagacaccccatcagcccaataacaggtttatggctgattgccgtgccattaattgatatggttgcggttttcttccgccgtttgaaaaaaggtaaaagtccattcagaccagaccgcttgcatattcaccatttgatgatgcgtgcaggtttaacctcacaccaagcgttagcggtaattacctttggtgcagggctttgtgcgaccttcggcgtaattggcgaagtttattactggaaccaatgggtaatgtttgttgcctttgttttccttttctttctatattcttattctattgtccaggtgtggcgaattactcgatttgttcgtcgccacaaacgccgtgcaagaagaaaacaaactgtttagaggaataatttaatgagtgagcaagtgaaaacacaacgttctagtgtaggactattttttacatctttatttttattattaatgctttctgctattggcggtgtagcgggttggtttggtgcaacaacgcaaacagcttattggaaagctgaggcacaatttgaagtccctaaagatcaactgttatgggcagccattggtggcggtattgggttactgctaggctttttcgttgtgttgttcattaatcgtaagaaaaactagcttgtggcatatcgtatcttagcggtctttggtactcgaccagaggcaataaaaatggctcctcttgttaaaaggttacaacaagaaggggcttttactatccaagtttgtgtcactgggcaacaccgtcaactgctctatcctgtgttgtctttatttgatattcaacctgactttgatttaaatatcatgaaatcaggacaagatcttgcaaatataacaagccgtattttgctaggagtaagtgaggtgttggctcaatctcagccagatctcgttttagttcacggcgatacaactactacatttgctgccagcttggcatgctattaccagcgtgtaccgattgcccatattgaggcaggactacgtacaggaaatcgtttttccccttaccctgaagaagctaatcgtcatttaaccagcgtgttagccaactatcattttgccccaacagataaggctaaagctaatttattggcagaacatcatgcagaagatcgtatttgggtgacaggaaatacggttattgacgctttaatgatgatgtcgcaaaaaattacacaaaaccgaccgctcacccaacagctacagcagcagtttccctttttagattcacataaaaagctgatcttagtcacaggacatcgccgagagaacttcggtgatggctttgaacggatttgtcatgcattacgaatattggcagaacagcatactgacatacagattgtctatcctgttcaccttaatcctaacgtaattgagcctacccaacgtttgttagcaaatattgataatctctttttacttgagcctcaaccttatttgccttttatctatttaatgcaacaagcctatctaattttaactgattctggcggcattcaagaagaagcacctgcattacataagccagtactgttaatgcgagaaatcaccgaacgtcctgaagctgtgttagctggcacagtaaagttagttggaactaatgctgagcatattgttcaaagtgtgaaggcattattaaacgatccacaacaataccaacaaatgagccatgctcaaaatccgtatggtgatggcaatgcgagtgaacgtattgtcgcggtgataaaacaacttgcacaaggaacaatgtaatggctgtatttgaacaaatagtggttgtagggttgggctatatcggtttacctacagcagcggcttttgcacttgcagggctacaagtgattggcattgattgcaaccctcgtgtgatcgaacaaatcaatcaaggtcgaagtcatctacatgaacctgaactagctcaagctgtattacaagcggtaagttcagggcatttttatgcaagcacggaaccaacctttgccgatgcatttattatcgcagttcccacccctctacaggtgaaccgtcaaccagatttaaccgcaatacaatcagcagtgaaaagtatcgcaccctacttaagacaagggaatttagtagtattagaatctacctctcccgtaggaacaactgaacaacttgctcaatggattgaaaaagaacgccctgatttatctattcccacagatgtggcggtcgcttattgtcctgagcgagtattgcctagcaatatttggcatgagctctatcataacgaccgtgtgattggcggattgaccccgaactgcacacaacaagcggtagcgttgtatcagctttttgcaaaaggagaatgtattactactgactctcggctggctgagatgtgtaaactcactgaaaacagttttcgagatgtgaatattgcttttgccaatgagctatcaatgatttgtgatcaactcaatgtcaatgtttgggagttgatccgcatagcgaaccgccaccctcgcgtaagtattttacaacctggagctggggttggagggcattgtattgctatcgatccatggtttattgttgctcaatcagaacatgcacgcttgattcgtactgcacgagaagtcaatgatagtaaagcgttttgggttattgataaaataaaaagttgcctagccgaatgtgccgttgcaacaaatcgtaaaatttctgatctgacattagcttgtttagggattacctttaaagctaacgtatccgatctgcgagagagcccagccctagcaattacagaatactttgccgattggcatcagggtaaattatggctggttgaaccacatatagctcaattgccagcttcccttgcagaaaaagtagaatgggtggattttgctcaaggtatcacagcggatgttgtcgtgttcttagtagatcatctggcatttcagcaacatgctaaaagacatctatctcctacatggttggtggatacaaggggagcgtggacaaattaatttggtttattactcagattaagtgaaagagcttgtatatataaagcaatcatctacaattcactttatcttgaagggagaaaattatctatgtttaaaattatttttacactcttttccttgagtacattttatttgcctgctactgcaagcctatttagctcacaacctaaatttctaccgggcgatcaggcatttgtgttttcatctcaacagcaagcggatcaactgcaactcgcttggcagattgccgatggctactatctttataaaaaagagatcgccatttcgtcaaacaatgccaaactgggcgagccacaatttccaactgcagagcgttaccaagatgagttttttggggaagtagaaatttatcgcaatcagctaacaatccccgttgcccttgaagcaaatgcgaaggggcaagtgctggtgcgttatcaaggttgcaccaaaggcttttgctatccccctgaagaagtgacccttgatttacaagcggcgacttccgctgataatgttgcaaaaaataccgcagatgttaccgctatttctgtcgctcaacctaaagccgaacagaaccaacttgccgaaaccttagccgaaaatcgccttgctattttttggttctttgtgttagggctggggcttgcctttacgccttgtgtgttaccgatgttgccgctactgtctgcgattgtgatcggcagtaaacagcgtccgaatagcctacgcgcgtttttgctcagtttaagctatgtgcaaggaatggcagtcacttacacgctcttagggctactggttgcggcgattggcttgccttttcaagtcgctttgcaaagtccgcctgtactgattgggctttcgttgctctttattttgctcgcaatgtcgatgtttggtctctttaccctacaacttccacaccgttggcaacaaaaattaaatcaactaagccaacagcaacagggcggatcgttttttagcgtatttgtaatgggaatgatcgcagggctagttgcttccccttgcacatcagcacccctatctggtgcattgctctatgtggcacaaagcggtgacttactgacaggcggtttagctctctacctattagccttaggaatgggcattccactgatgttagtgacccttttcggcaaccgcattttgccaaaatcgggggattggttgctgaaagtaaaaacgctgtttggcttcgtaatgttggctctgcctgtctttttgctctctcgtgtgctacctacttttattgagccactactgtggtctgctctggcgatagtctttttactctggttaaatgagcagtgcgatggtttgcagggctggaaaaaagtgtttcgtttgcttgtattggcaacgttggtcgttgcgagcaaaccttggctagatcttgcgtggcaacctacgccagtaaaccaaactcaaagcaaccattttaaacgcattcactcccttgcagaattagagcaacaactgaccgctaacaaaggtaaaaaagtgatgctcgacctgtatgccgactggtgcgtggcttgtaaagagtttgaaaaatatactttcgttgatccaaaggtgcaggcgaaattggcagaaatggcagtgttgcagatcgatatgacaaaaaactccggtgaaaatgatgaattgatgaagcattttcaagtgctgggcttgccgactatccttttctttgatgagcaaggcagggaattgagccaatctcgtgtgacaggttttatgcaggcaggtgactttgttcaatggttgaacggattaacacaatgaaaaccatcttaattacaggctgttcgtcgggcataggttatgcaacagcccattatctcaaacaacaaggctggcgagtaattgccagttgtcgcaaagccgaagatgtacaacgtctgcaatttgaaggctttgaatgtgttgaacttgatgtgactaactcagcccaaattgcccaagtctttgattatattcaacaaagcggtggtttagatgcagttttttgcaatgcaggttatggacagccagggacagtggaagacattccccgtgaagccttgcgtgaaatttttgaaaccaacgtatttggggcttgggaagtgatgaactacgctttaaagctatttcgccaacaaaatcacggacggattttaatcaatagtagcattttaggctttgccgcaatgcactttcgtggggcttacaacagcactaaatttgctttagaaggtatggcagacacccttcgccacgaattgcacggctcgaatatctatgtcagcctgatcgaaccaggccctattcaaagcaaattccgccctaattctgtggtgaaattacagcaatatattgatatagaaaattcattccacaaagaagcctatcagcaacagttggcacgcctaaacaccaaaggaaatgccaacccctttacgctaccagccattgaatgtgctaaagtttgtttagacgcactcaatgccaaacagcccaaagcacgctatcaagtgaccttcccaaccaaactattttggtggctaagacgcattctgcctacaaaagcctttgatttttgttgtaggaagggtgggggatgatagtagaaacttactatgattgatgctttttatgttagctttctcatcacaattgtaaccatatgaaaatgatacttttggattgatgtattaaataaatcctttaatagccctctacatccaccatttgtaatggattgaattctatggcttttttcacgaagtatgttcaatgcgagtttgtaaaggacagtcttttgttcatatttcaaaaagtgggcttaaagccttgtactataaggctttaagccatttttaccaacacttttgtctactatgccgataattatttcccaatacaaaaggaactaaaaatattgccgagcaaatcatctgaggtaaattgccccgtgatttcgcttaaggcattttgtaccattctaagttcttctgctaataattcacctgcatagaactgagttaattgaatgtgtcctcgttccaaatgttctgccgctgtttcaagtgcaactaaatgacggcggcgagcaataaagccaccctcagtagaactttgataacccattgatttttttagatgttctcgtaataaatccacaccgactttagtttgtgctgacaggcgaatcacagtgaaattatctgcttgaaccaaactttctgcttctcctgttaaatccactttattacgaataacagtcacgggaatgtttttcggcaacttcgctaaaaatgtcgcccattcttgttggaaactatccgcttgagattcattgctatcaatcattaataaaacgtggtcagcctgttcaatctcgtcccacgcacgtttaatcccgatcttttctacttcatcactggcttcacgcaaccctgcggtatcaataatatgcaacggcattccatcaatatgaatatgttcacgcaacacatcacgggttgtcccagcaatatcggtaacaattgccgcttcacgaccagctaacgcattgagtaagctagatttgcccgcattaggtttacctgcaattacaactttcataccttctcgcaaaattgtaccttgcttagcctcctgacgaacattagcaagttgagcgatgatctcattcagttttgcttcaattttaccatcagctaaaaaatcgatctcttcatcagggaaatcaatcgccgcttctacataggttctcaaatagataacagaatcaaccaattcattgattttattggaaaattcaccttgtaatgattttagagcggaacgagctgcttgttcagaggttgcatcaattaaatctgcaatggcttctgcctgtgcaagatcgagtttatcgtttaaaaaggcttgttcggagaattctcctgcccgagcaatacgaaccccttttacttttaaaatgcggttgagtaagagatctaaaatcacttgtccgccgtgtccttgtagctcaaggacatcttccccagtaaacgaatgaggggctttgaaaaagagggcaatcccctgatctaacactgtcccatcttcatctttaaaaggaagataatcagcaatacgaggcttagggcatttacctaagaccgcttgtgcaacctctgtagcgagaggcccagatactcgcaaaattccaattccaccacgtccaataggggtagcttgtgcaacaatggtttctttcattttaaataagttaagtataatgagaatagcatattgtaccccataaaagcggtgagattagataaaattttaccagagataggattagctaaaagggatcctatcccaaattctgtgtaaacacccatttcaacttaacggtgatcgtctaagcgatcaccaaaatcaatcataaatcgattcatcgccagtttccagttctgaatcggcattgtccatttttttgatgcatctttaatcgcaagccaaatcactttgaaaactgaatcatccgtcgggaatacatttcgttttttaatcacgcgacgaatcacgctattaagcgattccacggcattcgtggtataaatcgctttacgaatatcagccggataatcaaaaaatatagcaatatttgcccagttatcttcccagcctttatcagatgctgggcgtgctttttcttcatcaataccttggatgagtgattttgcatattctttagaggttaaccctttcgcaggaacttttacaaaatctggatcacctaaatattcagagcgatcggaataagccaatttcattgtttcagcgagatggtgaatcgttttggcgctattagaaccaaattcatttaatgggtagttttctaacatattgaggatttgtactaagtgaatcccacctgagcttggcagtggcattgtcacaattttgtatcctcgatattcaccagtaatcggtttacgttcgacggcttaataacctttcatgtcatctaaggtgatcaatccattatgtttctccatctcagcaacaatctttttcgcaatgtcgccttcatagaaggctttagatccctcttttgcgatttgacgtaatgagtttgccaaatctgtttgaactaaacgctcaccagctattaatggtctgccatctttgaaaaagatttttttactgctttcccatttacctaatgtttccgtttcttcttttaatgtacttgctaaggtgccacttaccacaaatccttcttcggcaagcttaattgatggctctagaattttttctagtggcagacttccccattttttcaatgcgtattccatgcctgcaacggttcctggaacacccacagcaaaatgggtgtaaagtgatttaccatctacaacattacctttgtcatctaggtacatatctcttgtagctttaatcggtgccatttcacgaaaatcgacagtgaagttttcgccactttttgcatcatgtagcaccataaaaccacctccgccaatatttcctgcgtttggtaatacaacagctaatgcaaaaccgactgcaacagcagcatcaacggcatttcctccttgtttcaaaatatctacgccaatttgtgtggcaagttcttgctcagaggcaaccataccgtgttttgcataaacaggatggaaaatatctttgctactgtcataacgctgggcagcaatttgcgtcattgtaggctgtgtgtttgcaagtagctctgtggatagaggcaaggctaatgccacagtcaaactgctaagtaagaaatattttttcatggttttatgcatatatactccttggtagtggctaattaaacaactttcattatgcataaattaaacaaaaatttaacatatttataacaattttattaaagagaataagacaagcggttattttcatgaaaaattttgcaaaatgaactcaatggcatgctatgatccttgagcttatatcagcatgtattattaaggattcctatgaaactttattatctcccaggcgcttgctcttttgttccgcataccgcattagaatggattggcaaaccgtatgaagcagaagcggtcaatcgtgacaaaatcaaatcaccagaatacttggcgttaaatccacaaggtgctgtgccattattagttgatggtgattttgcactatcacaaaacattgcaatcttaacctaccttgatagccttcatcctgaagcgaaactgtttggtagcgatacagcacaagacaaagccaaggcaatgcgttggttgtcattcttcaactcagatgtccataaagcatttactccgttttttcgtgtaccaccttatgcacaaggaaatgaagctttaacggtagaaattcgtcaaaatgcggcggacaatatgttaagaatgttagaaattgccaacgatcacttagagcaccacgcctttttcggtgaacgtctctgtgtcacagatgtgtatctctacaccatgttaggctgggcgaaacgtgttggattggatgttagccacctcactcacttcaagtcctttatcgaacgtgtcgaagcggataaaggtgtagatgctgtacgtgttcaggaaggcttaaaatagaacataggcgagaataattctcgccttttctctttcattctatctgttttttgattaaatcgatcagaagaggaaattcacaccatccttccctatctaaaaaatgcccacctgacggtaagcgaatataatctgctttcaaatgtttggctaattcatcactatatggatgtgggacaaccgtatcatctaacgcggcaacaacataagacttaaatgctaaacagcttggtgcaacagcataactatttgaaaacgaactcagttcaggaatcgtatccaatggctgataaaatcctgacacaaaaatagccgctttaggttttaaaaagtttctcgccaaaaagttaagccaagcgatacagcctaaactatgtccgacaacgatagtctcatcatcaatggtgatgtgtccttccaaatgtctcagccatttatctggatttgggttacttgaatctggcatattcaagcgataacactcaaccccgatttttgctaattcttgttctaaccacggaaaccaatgtttatccgccgatgcagtataaccgtgaacaatatagacttttgccataaaacctcctcaatacaagcgggtctgattttgccataaatttgcaaaaataggtaaataacgaaatattttaaattagtgtaacttagactaataataaattaacattcatactgctaatagattcttgggcattttctagtaatcctttatcgcaaatgatctggtcaaatatggtgagaggatatacaaaaaaagtcgcaaattttccatatttagaagaatcagtgacaagaatatttttacgagaggcttctataattgctagtttcacaggaattttgttttcattaggcgtggtgagtcctttaagattccatgatgaagtcgagataaatgcgatatcaatagataagttttttaagaattgtgcggcaagcatgcctgttgtagataaattttctttacagacacttccaccaatgtgaatgatttcacatcgacctgagttactaagaaaatgagcgataacaaaatcattagtgataactaagatgtcattgcgttctgctatttgatgtgcaatttctagtgtagttgttcctgcatcaaggtaaatcgtggcattatgaggaatctgttttgctgctgcaacaccaattgcccatttttggtcgtgaaataattgagatttatcactatgcgtgggttccgtcgtcagtctctcaagtgattgaaccccccctgatactgatgatattttcccttcttcttccaatttttgaatatctcggcggatagtcatatgtgagacatttaaacggttggcaagaaaattaacgcttgtactgccaaaactattaacaatttgaataatctgtctttgtctttctgctggaatcatattctttccttacattatcttcggcctgttcattatacccatctatgttaccttgagccattaacaaaatttaacaattttgttaaattttgtgagctttgtcacagattttatttttattgttatgtatgatttgtaaacataatttatgagacatcattttatgaggagttagttatgagtaaatctacttatagtattgcagtaattgggcttggtgcaatgggaatgggggcggctaagtcttgtattacaaaaggattagatacctatggtattgatctgaattctaaagcattagaaacattaaaatcctttggtgcaactgacattggagagaacgctattccttttgcatctaaattagatgctgtattactacttgtcgtgaatgctactcaagtgaaatcaattttatttggagaaaatggattagctcctcacctaaataaaggtacggttgtaatggtttcatctaccatttcggctcaagatgccaaagaaatttcacataaattaacagaattagggttattaatgttagatgcacctgtttcaggtggggcagctaaggcagctaatggtgatatgactgtgatggcatctggttctaaagaagcttttgagaaattagagcctgtgttagatgcggttgcaggaaaagtttataacattggtgaagaaattggacttggagctacagtcaaaataatccatcaattattagctggtgttcatattgcagcaggcgctgaggcgatggcattagcagcaagagcgggaattcctttggatttgatgtatgacgtggtgacaaatgctgcaggtaattcttggatgtttgaaaatcgcatgaaacatgttgttgatggagattatacaccattatcaatggttgatatttttgtcaaagatcttggtcttgttacggataccgctaaagcattgaaattcccacttcctttagcaagtactgcattcaatatgtttacatcggcaagtaatgctgggtatggcaaagaagatgatagtgcagtgattaagatcttcgatggtattgagttaccaaaaaagggggagaaataagatgttaggtgttattgcagatgattttactggggcaagcgatattgccagttttttagttgaaaatggattaaagaccattcagatgaatggagtgccaacatcaaatttagtagaacctgttgatgctgtagttattagtttgaaatcacgctcgaatccagttaatgaggcgattgagcaatcattagatgcgttgaaatggttacaaaataatggcggaaaacagttctattttaaatattgttctacttttgatagcacagagaagggcaatataggtcctgttacagatgcattacttgatgcattgggtgaggatttcacaattatttgccctgcgttaccaatcaatgggcggaccatttttaatggttatctctttgttggaaatgtattacttaatgaatcgggtatgcaaaaccatcctattacaccaatgaaagatgctaatctcgttcgtttaatggatatgcaagctcgtgggaaaacaggtttagtaagctgtgctgaattattcaaaggtgctgactatgttaaacaacgttttatagagttaaaacaacaaggctatcgatatgctgtagttgattcagtggacaatactcagttagctgttttagcagaatcgattgaaagttttaaattagtgacgggtggttctgggctggcagcatatatggctgaaagaatttcaggcggtaaaaaaggtactgatgcctttacgccaaccaaggcgaaaaccgttattttatcaggatcttgttctgtgatgactaataagcaagttgagtattatcagaaacatgcacctagctatttcttagaggctgaacaagctatcaataatcctgaatatgtagaacagctctaccaatgggtgatttctcacctaaaccaaccgcttgctccaatggtatatgcaacagtccctcctgaaacattaaaaacaatccaagcccaatttggtgcagagaaagcgagtcatgccatcgaaactacctttgctcgtttggcagaaaaacttaaagatacaggcatcactaattttattacggctggaggagaaacatcgagcattgtggttcagcaactaggtttttccggtttccatattggtaaacaaattgcaccaggggttccttggctaaaagcggtagaagaaccgatttatttagcattgaaatcaggtaactttggaaaagaggatttctttaaattcgctcaggagatgtttgtatgacggatttggcacaaaaaatccaaatggttgaacttgcaaagtcgttatttgatcgaggatacacagtaggtggtgctggaaatctttccgtcaaacttgatgataatagggtgcttgtcacacctacaggttcatctttaggacgactagaagttaatcgtttatctgttttagatatgaagggaaatctcattgagggtgataaaccttccaaagagtctgtatttcacttagcactttatcaagcaaatcctcagtgtaaagcgatagttcatttacattcaacttatctcaccgccttatcttgtttggaaggaatagatactacaaatgcgatgagagcttttacaccatactatgttatgagagttggacaacttgcagtgatcccttattacaagcctggtgatatcaatatcgcaagggagttgagtgaaagagcattacaggctaaagcttttctacttgccaaccatggtgttgtagtaacaggacacagtttagtggatgcggtggataacacggaagagttagaagaaactgcaaaattacattttattttgcaagggaaaaatattcgctatctctctgagagtgaagtgaaggatctagaaaatagggggaaataaaaatgcctaaatttgctgcaaatttaacgatgatgttcaatgaagtaccttttttagacagatttgaagctgctgccaaagcaggatttaaatatgttgaatatttatggccttatgaatatgacaaagaggtattaagacgtttattagaccaatatggtctgaaacaagttttatttaacactgcagcaggtaatgtatctgctggtgaatggggtgtttctgcaataccagggcgagaggctgatagccataaggatattgatatggcactggaatatgctttagcgctaggttgtgaaaatgtacatgtcatggcagcagttgtgccagaagatcaggatagagaagcatataaacaaacattcattgagaatgtgcgttatgcggcggataaattcaaaccttatggcattaaagtattgttagaagcgttaagtccagaagttaaacctaactatctgttaaaaagtcaatttgacaccttggaaattgtagaagctgtgcagagagaaaatgtatttgttcagctagattattttcatgcccagaacgtggatggcaatttatctcgattgacagataagttggatagcaaatttgctcatgtccaaattgcatctgtaccagatagacatgagccagatgaaggtgaaattaattatgcttatattttcaacaaattagatgaaatcggttatgaaggctatgtaggttgtgaatacaaaccaagagcaaatacggttgatggcttgcaatggtttcaaccatacaaaaatcgttaatctatttagatgaaagagaaagaaatgaaagtagtaattacaggtggacaaggttttttaggccaaagacttgctcgtactttattaaatcagcattcagagaaaattgatgagcttgtgttaattgatgtagtaaaaccgattgctccaaatggtgattcaagagttcgttgtttagagatggatttaagaaatccagaaggattagatcaaattattacaaaagaaacagatgctatttttcatttagctgcaattgtgagtagccatgcggaacaggatccagatttaggttatgaaattaatttccttgcaacaaggaatttattggaaatctgccgtaaaaataatcctgctgtacgttttatattctctagttctttagctgtttttggtggtgagttacctgatgtaattgttaatggaactgttgttactccgcaatctacttacggtacacaaaaagcaatgtgtgagttgctaattaatgattacagtcgtaaaggatttgtagatggtattgccgttcgtttaccaacaatttgtattagaccaggaaaaccgaacaaagcagcctcttcttttgtgagcagtattatccgtgagccattacatggcgaggaagcgatttgtccagtgtcacaagatctacgtttatggttatcaagcccaaatacggtaatcaataatttcatccacgcaatgacattaccacctcttccagcacgtcattggcatgtgattaatcttccaggttttaccgtgagtgtaaaacagatgttatctgatttagttcaagtaaaaggagaatcaattctagaaaaagtccgctttgattttgatgtaaacattaacaatattgtcgcaagttggcctgctgaaatagacaatacttatgctcttcaattaggttttactgctgataatgattttaaatcagttattcaacaatttattcaatatgatatgtaggagatgacattatgtttgggctaccgattcctattattgggctaattattgctgtttttgtattagtctatttagtacttaaaacacgtgttcatgcatttattgcgatgctcattgcatctgctatagcaggtttaattggcggtatgacggtaaatgagacacttggggcaattagtaaaggttttggcggtactttaggtggtattggtattgtcatcggtttaggggttatgatggggagtgtgcttgaagtttctggggcagcagaaaaaatggcatatagcttcatcaaaatgttaggtaagaaaaaagaagagtgggctttagctatcacaggttatgtagttagtattcctattttcgttgattcagccttcgttattttatatccagttgcaaaagctttagcaaaaaatggtaaacgttctttattaactttaggtgtagctttagcgggtggtttagtcgtaactcaccataccgttccaccaacaccaggcccgttaggcgtagcaggattatttggggtagatattggcgtaatgcttttggttggtatggctatggcagtattacctgttatcggtattgttttatatgcaaaatggctagataaaaaatatcctgaatttaaccaagaagtatttagtaaagaagagctaaaacaaaaatacgatgactatattgaaagtcgtgagaaaaagaatttaccaagcttaggtttatctcttctcccaattgtattgccaatcgtactaatctttattaaagcgattttagatttagtagcaaaatcaaattctacgattgcagaaatggcactttatgatgtatttgcttttattggccatccgatgattgctttagcaattagtgtcttagtcgctgtttatacgttacttccgcatgctgacaaaacgacaaccgcattacatctggaagaaggtgttaaaactgcaggtattattctattagtaacaggtgctggtggtgctttaggtaccgttttacgtgagagtggtgcaggtgctcaacttgcagagcaaattgcgaatttaccgatttctcctatcttaattccatttattgtttcaactcttgttcgctttattcaaggttcaggtactgttgcaatggtgactgcggcatcaatctctgctccaattctggcacaaattccaggtgtgaatatgatccttgcagcacaggcagcaacaatgggttctcttttctttggatatttcaatgatagtttattctgggttgtaaacagaatgatggggatcaatgatgtgaaaaaacaaatgatcgtatggtctgtaccaactaccattgcttggggtattggcggtattagtgtcatcttagcaaatttaatttggggtaatgatggctcactattcgatctagttcttcctgttgtagttatgataggtattggcttatatatcaaagctcaaaataaacatctttaatttttaatgatcaggctgtaaatactatatttacagcctgttttatttaggaggaaaaaatgaaaactttatatgctttattaggtctattttgtgtatcccatgcttatgggatagatgatcaacctcaaaaagtatcagaaaaagtagatataacttttctagcagaaactacagctaaaggtcaaaaaataaaagctcttgctttaaagtatgaagataatatcttatcaggaagtgatttgtcacaattatataaagtaacaccatatttggatggaaaacctcttaaagatagggttattttaaaagcatatgtaaatgatcaacctgatgtttcctttaaatcaaaacaaggtaaatttattattattgagatggatgttagagataagggttcagatttatacgaaattaaagtagaaaatgatactcctatgttatttagagaaaaggatattcaaggtaatatcatccctaatgagaaaaaacaggcaataagagtaccagtattctatggagaaaggctatcatataatatagaacaaacaggttttttaaagttaactaatggtaaaacattagataaagaacaatggacagaaacgattcttcggggtaatttaaaaacagacacagatagttttgtggaaggaacagttactatcgacgatccaaaaaataaattgaattatagattacatattccctcttccttaaataaagaaaaatatcctctaaccatcttcttacatggttcaggacaagtaggaaaagacaatattgctcatttactatcaagtaaaggagctatagctactttacagtatgaagatgggtttgtcttagcacctcaatacgatagtgtttttgattcttttgataattattctacaggtagtaaaggggggattcattggcaaactgataatcgtcataacctcttgtttaaaatgattgacaatacattgaaatcttatccgatgatagatcccaatagaatttatattacgggattatctcgtggtgcagaaggcgggctatatttgttattaaagcgtccagatttctttgcaggagcgcttttaatgggaggtagagaggcctatacaattgaatggatagatggtaatgcaactaaagagaatttatctccaattaaaaatataccgatttggttttttcacagtaaggaagataaagtttctccagtaaaaggctctagaattaattatcaaatacttactaaagaactaaatgctccttatgttaaatatacagaatttagcacagagaaagaaggagataatggaattattaataataatccgcataatacatgggatgctgtatttaatagtccagaagtattaaattggttattgcaacagagacgggctaattaatgtaaaaactccccaattatttggcatagtagacaaaatggttgctaattttgtaaaaactatgcctatatgacaaaggagcctctcccacaatttgtgtaaatacctgtttctgagataatacattcagacacaggtattttattatgaacgaaaaacaacttcacgccttggaagcggaatttgccaaaaacctaaaaacaccagaagacctcaatcaattttcacggatgctcaagaaaatcaccgtctaggctgcgttaaatggtgaactgaccgaccatcttggttatgaaaaacatcagcctagaaaaggtaaaaatgcacgtaacggttacacatctaagaccgtcatttgtgatgaaggtgagatagaaattgagacgcctcgtgaccgtgacggcacctttgaaccgcaacttatcaagaaaaaccaaacccgcatcacaggaatggatgagcagattattgccttatatgccaaggggttaagtaatcaggaaatcgttgaaatgttcaaagaactctatgatgcggatgtgtcaaccagcctgatttttcgcgttaccgacgccgtgaaagaacgcgtaatggcatggcaaaatcgcccacttgatgcggtttatccaattgtttacctagattgtatcgtagtttcagctttgcattgtgcatttagtgcgtaacagcttgaaattcgtttcgtggaaagattacaaagccgtcactgcagatttaaagcaggtttatcaggcccctacggaagcacaggctcgcgaaaatctgaccgcactttcgcaaaaatggcaggcaaaatacccgcttgtaaagatgcatcaaaaaaatggacaatgccgattcagaactggaaactggcgatgaatcgatttatgattgattttggtgatcgcttagacgatcaccgttaagttgaaatgggtgtttacacagaatttgggatagggtcatttttaattattcttaccaactctttttatttaaaaaatcctttataaacataatcttatgtcttttcattaatcctgtatgatgcgataatttttcctttagttgcccaaataagttttcaagtctatttgtcgttttttcgatatttaaatcgccatgcttttcataggtaaatagataatccatataacgtttaaaactatgataagcacttcttacattccgatgtttataaggataatagcccttttcattcggtttctgaccgttcttctaaaaacgctttatgttttaaataccaatgatgtaatcgtaaatagacgccttttttagaactctgtttaagcgttaatgctattgtttttaattcttttccagctatagattgatgcttttttcgtaatgctctcatcacaatagctaccatatgaaaatggcacatttgcgtcgatgtatccaataaatctttcaatataccccgtctgccgtcgcaggtaattgattgaatgttatagcctttcatacgaagtgaattaaatactattctgtaatacacatctttttccgttttgatgacacgatggtaaaccacttttttagaaagcgaatccatcaggactaaaataccaaattcacgaccaaaaaaggtggtatccgcaataatatttaaatcacgtgatagtggtggatttaatttctttttaagggtaaatgttttattacaagcattacatttatagcgttgaatattatttcttataccatgtttgcgaatgtcgctactgtggcaaaaatgacattttttgggttcataattcaaaaaagtggcttaaatcccgtaatataaggctttaagccattttttagtggtcattttgtctactatgccatttttccctctcgagaaacattagcctgcctataaagaaaactgttaaatatctcccagacaattaatatactctcacttttggtggagtataactttgaataaaactttcaatttctgccaaattatctgaaaacagtgttttgtttctatccgcttgagtgagaaagccttgttttaccatattgtcaaaaaaggcttttaaatcatcataatagccatcactattaaacaaaatacacggattggggttttgaccaattctcgcccacgagatcacttcaacgatttcttctaaagtacccggtccgcctgctaacgcaatataagcgtcacctaattctatcattttgctcttacgttcaggcatagaattgacggttatcatctgcgtcaagcccttatgtgccaattctctttcctgtaaaaaggttggcataataccaatcacttcaccaccattttccaacacagtatttgctaataagcccatcaaacccgcattaccgccaccatagactaacgtatgttgatgttctgcaatccatttacccaattcaatcgtcgcttgttggtgagccaaattattcccgacacttgctccgcaatagacggttattttcatttctttttcttcctattttgttaaagtagtgacagatggtaacaaataatcagagagaacaaaatgcactttcaagaatatcaaaaatgggtgagagaattttatcaactgcagaattggtacgagcgagatgtttttcgtcgccttgcttatctgactgaggaaattggcgaggttgcctgtgccgtgcgtgctattgagattggtcgagagcgtcctgatgaaattgagcaagatgccttacagaaaaaagaaaacttaattgaagaattgggcgatgtgtttgataacttatttatcttagcggataaatacgatattgcgattgaagatgtgattgctagacatcaacaaaaatttactaaacgttatcgtggggaataaacaagcggtgagatttgcaaaaaattttgcagatttcaccgcttgtcacatcaatagctaaagtaaaatactaccaatataagcaataataaagcctacaacaccaatagaggtttcaagggctgtccaagtttttaaggttgtcttctcatccatttctaggaaacggcttacgagccagaaacccgaatcgtttacgtgagaaagaactgtcgcaccagaagcaatagaaattacaataaagcagagatcaaattgagttaggcttgtatctgctgcaaccattggtgcaattaatgctgctgttgtggttagtgccactgtcgcggaaccttgtgcaacacggaaagtcgttgcgatgataaatgccgccacgacaattggcatgcctgtatctgacattaaagcagagagttcgtcaccaataccacttgcacggagcacgccaccaaacataccaccagcccctgttactagaataatagagcagattggtcctaaagcgttgttacaaattttttcaatttgctcatagctacgattgccttttaacagcagaatcgcaaccaccaaggtaatcaataaggcaacaggtgttttaccaatcaaacgtaaactttgaacccaaaggtctgaaccatctaccactttagcaactgttaatgtattcaatcctgtatcaaataaaatcaagaagataggtaataacagaataatcagaacacgtttaaagcttggcggattttgtaccgctgtatcattcacggccaatgaatttaaaaaggcttttggtaaatccacatggatacgtttactcacaaacatactgaataagtaagtaccaatataccaagttggaatcgcacagattaatccgacaatcaccaacaatcccatattagcccccagtaaatcaccagaagcaacagggcctggatgaggaggaaggaaggcgtgcatcactgcaaaagcgcccgctgatggtaatgcataacgtaatactgaaccgccaaactgttttgccacactgaaaataatcggcaacatcaccacaagtccagcatcaaaaaagatagggaaaccaaaaagtaaagaggccacaccaagagcgaatggtgcgcgtttttccccaaatttattgattaaggtatccgcaaggacttttgcacctcccgtaatttcaagtaagcgaccaatcatcgcccctaaacctaccaataaagcgacagatgctaatgtactaccgaagccacctaacaaggttggtaaaattttatcgacagagatccctgtcgctaacgcagttaataaactcacaataattaaagccacaaatgcgtgcactttaaatttcataatcatcactagtagcaaaataatcgctacaaccatcgtaaaaattaacatataaccccctaaggcataaattgttactggtaacatattattttgtatctaaaatgtaaacggaattctcaaatttattttaaatctgtgatcttgttcaaattttgaataaaattttcataatttaatctatcaacgtgttacattatggaaaaatctcagttatcggtaacattttgttgtaggagaaccgttatgtcagaagggaaagcatttattttaatgggcgtatcaagtacagggaaaacctctatcgggacagaagtcacacgccgtttaggtatgaaattgattgatggcgatgatcttcatccaagagcgaacattattaaaatggggaatggcattccactcaatgatcaagacagagaaccttggctagaacggattaatgatgcggcatttagcttagaacagaaaagtgaaaaaggtattatcgtctgttctgcgttgaaaaaaatctatcgagatcgtattcgacaaggcaacaatgatgttaaatttatctttctaaaaggctcttttgaattggtgttagaacgtatgaagcaacggaaagggcattatatgaaaacagatatgctgaaaagccaatttgcgaccttagaagaacctcaggcagatgaaaaggacgtgatttttattgatattgatgcaccttttgaaactgtggtagaacgttgtattgacactatcaaaccactgctttaaatactctctcccaaatgaatttggtagcctaagttgatgatactactctgctgtgcttcaccctttagacgattcaatagctcttgggctgcaactttgccgatctctaaacggggagtaatgaccgttgctaattgtggggtgagtgattgccccacatcgtgcccatgaaagcctgcaatcgccatctcttttggaaccttaatacctaagcgttggcattcaaataaagccccgattgctaaatcatcattagtacaaaaaataccatcaatatcaggatattgtgctaacgcctgttgaagttgttttgcaccaagggtaaaagatgaaggctcatcggtaatcaaactatgcggctctaaatgatattttcgcatggcttgttcatagccttgcattttcaattttgtccgtttatccatacgagcagtaaaataaacaatatttttatgtccacgactaatcatagtttcaaccatagattgtgctgcagaaatattgtcaaatccgaccgcttgttgaatgccaatttcactgctatccatgatctcaatcactggaatattcgccacctctaacatcttcaaagtacgtttagaatggtgattttccgacagaataatgccatccacattataggagagtaacgactcaattcgctgttcttctttctcttggctataaccatagtgagctaacatcgtttgataacctgccttatccgtgactaattcaatacctttaatcacatcagcaaagacttggttggttaaagaaggcaccaacactcctatggctcggctttttgcattcgataaaatatcaggtgctcgattgggaatatagccaaattctgtaatcgcttctgcaattcgcagccctgtttcatgtgcgactgcttctggattacgcaaataacgactgatcgtcattttagtaatccctaaatgatcggcaatatgttgaagcgttgggcgtttacgttttggtgccataaatagaatagataaaagaatagatggcttattctactgaaatttaagagaggttccaatagagtggcaataaatagaaatgatcaagcggtgagattcgcaaaaaattttgcaaatctcaccgcttgtattccttatttctctgaagagaaacccgatttcaccccgtgcatatttggcaactggtgagcaatccctttatggcagtcaatacaggttttaccttcttgttcagccattgcgtgcatttttgccgccacatttttttgctgagtgaagtccatatcgctgaagttatggcagttacggcactcttgtgaattgttggctttcattctcgcccattcacgttgagccatttctaagcggtgtgcttcaaatttctctttggtgtccactttgcctgttagatgagcaaaaacttcacgagatgcgacaattttgcgtgtccatttcggaataaattcgtgcggtaagtggcaatctgcacagtccgctttaacaccactgcggtttgagtagtgagcagatgctcgatactcaggaacaacatcattcatatgacagcttgaacaaaactcttctgtattagtgtgctctaatgctgtgttaaatccaccccagaataaaataccgccgatcgcagaaacgacaatgagaaaaccgatgccgattttgcttggggttttaaaccacgtccaaaattttttgatgagcttaaacattatttacccccaaatgctttggtcggttcaaattggttttcgataattggatcaacatttgcttgtggaacgtggcattgtaagcagaaataacgacgtggtgatgtgtcaccagttactttgccgtcacgatccataaagtgtgttgggctaatgcgtggtgcacctgtggtacgatagttctctacgccgtgacagtttaaacattggttggtgtttttggtcacttggtagcctttaatgctatgtgggatcattgggggttggttcacatagctaagcggtaactttccttcatcttttggcatattgtggaaagcaggttcaatcgcttcaacacctttatctgcacttgacgggactttttctacattcgcaaaagccacacctgttactgcgattaataatagggcgagatattttttcatttttcactccgttcacgttcaaaacgtgttgtaaaactaaatacattttctgcacagacatcaacgcaacgtccgcaactaatacaatctttcgataacactatttggctatcttcgggtttaccatttaagggtaagcgtagtacctgtggttcagggcaaacgtggaagcaatccatacagcgatcacacttcgcacgatcaacaacccctactcgtacaatgctttttgcaccgattaagccgtaggtcgctccgattgggcagagatgtccgcaccaaccgtgttccacaatcaataaatcaaataagaaaaccgctaacactaaccaaagcgttgcaccaagaccaaagacgaacactcgaccaagtgctgcaacggggttgatccattcccataataatgtgccagaaattgctgacccgactaaaatcatcgctaaaataccgtaacgtaatgaacggggtaatttagcagattggcggatccccagttttcgtcgtagccaagctgcacaatccgtgacaacattgacagggcaaatccagccacagaataccttgctggcgagtaaggcatatattgccacgataatcgctgcccccagtaaggttttccattcaggcaaatagcctgtggcaaggctttctgcggtaattagtggatcggttaaggggataagatcaaacagcatacttgagctgtaattgccttttaagatccacacattccacatcggaccgcttaagaacattaacactacactgagctggcttaatcggcgtaaaattaaaaagcgatatgcacgccaccaaccgagtttttgtcgggcttcaagccctgcatctttcggggaatttgccattacttcaccccctctggcattcgtgttggtagggaaataatgccttctgggttggtttcatcaagcagagaatgccctgctttctgtttttcttcccaaccaagtcggtaatgtttacctaacattccttttgccaacgacattggtaatactttgattgcggcttcatctaacacacaggcttcttcacacttaccacaccctgtacacgcatcggaatgtaccgttgggataaacattgcgtgcttacctgtacgatcattgcgttgcatctcaagggtgattgctttgtcaattaacgggcaaacccgataacacacatcacaacgtaagccttgccagttcaaacaggtttcgtgatcaagcagaacggataagcccattcgagcatcatcaatattcgttaaatttggatctaacgcaccgcttgggcaagccttaacacaaggaatatcaggacacatttcgcacggtttatcacgagcgataaagtaaggtgttcctgcttccattggcgatagtaatgaagccaaatgcaacatatcgtaagggcaagcctgtacacattgtccacagcgaacacaagcggctgtgaaatctttatcatcggctaatgcacctggtggacgcagtgccacgccttgtcgagcaaggctttggttttgttgtaaggctaagatgatccccacaccacaaacaccgcctgccgtgcgtgtcgcattttttaaaaattggcgacgatttggatcgagtttcaatgcctgttccttatttgcaaattgttgctcaaatctaaccgcttacggggtatctgatattcttcccccatttatgggggaagtaccgcctcaggcggggatgggggatatcaactatgcccccatcggtttcgcttcgctcaaccacttcccccacaggtgggggaagtgttcttggctaagccttcacaaccttaaccgcacattttttgaagtcggtttcttttgagattgggtcggttgcatctaaggttaatttattggctaactgacctgcatcgaagaaagtggtgtaaattaagccttcaggcactttgttacgaccacgagtatctaaatgcgagatcatctcaccacggcgtgaaattactttcactttgtcgccgtgacgtaaacctcgtttttgagcgtccgttgggtgcatccacactaagttattcgggaatgaacggtgtaattcaggtacacgacgggtcattgagcctgagtgccagtgttcaagtacacgccctgttgataaccataaatcatattctgcatctggtgcttctgcaggtggttcatacggtacggctaaaatcactgcacgtttatctttattgccgtagaaagatacgccttccccagcttgaacatatgggtcatagccttcacggtaacgccataaggtttctttgccatccacgaccggccaacgtaaaccacgtgctttatgataagtttcaaagtctgctaaatcgtgaccgtgaccacgaccgaatgccgcatactcttcaaataaacctttttgtaaatagaagccaaaatgggttgactcatcattgatgtaatcagctttatccgttggtacttggaatttatccacttgaccattgcgatataacacgtcgtatagtgttttacctttatattcagggtttgctgctaatacttctgctggccacatttcatctgtggtgaagtatttagagaactccactaattgccataagtctgatttcgcttcgcctggtgctttcacttgttggaaccagaactgagtacgacgctctgcgttaccataagccccttctttttctacccacattgctgttggaagaattaagtctgcagaaagtgcagaaactgttgggtatggatctgacacaacaataaagttgcgttcgttacgccagcctggcatacgctcttggttaatattcggaccacattgcatattgttgttacacattacccagtaagcattgagtttaccgtcttttaatgcacggtcttgtgctacagcgtgcaagcctactttagtttggataacaccatttggtaacttccataatttttctgcggttttaacgtgttcagggttagtcaccactaaatctgctggtaagcggtgaataaaggttcctacttcacgcgctgtaccacaggctgatggctgacctgttaatgagaaaggcccacaacctggtttagaaattttgcctgtcagtaagtgaatgttatagatgagatggtttgcccacacaccacgaacgtgttggttaaagcccattgtccagaatgaaacgatgttcaagtttggatccgcatacattttcgcaaggctttctaactgatcttttggcacacccgataattcgtgtgctttatctaaggtatattcagaaacaagctgtttaaactcttcaaagctactgtcgtacattttgcctgcagtttttgcatttttagccacttgttctaatgggtggttgtcacgcagaccgtaaccgatatccgtttcaccacgtttgaatttagtgtgtttttggataaagtcttggtcaatcgcattgttttgaatcaagtaatttgcgatatagttcataatcgctaaatcaccttgtggtttaaatacgataggcaagtccgcaagttcaaaagaacggtgttcaaaggtagaaagaaccgcaacttttgcatcttgtttggataaacggcgatcagaaatacgcgaccataagatcgggtgcatttccgccatattggatccccaaagcacaaatacatcggctttctcaatatcgtcataacaacccatcggttcgtccataccaaaggtacgcataaacgcaaccgctgctgaagccatacagtgacgtgcattcggatcgatattatttgaacgtaaacctgctttaaatagtttagattttgcaaccccttcaaagatcgttgattgacccgaagtgaacatacctacaccatttggaccttgctctttaatcgctttcttgaatttttccgccataatggtaaatgcttgatcccaagaaacaggggtaaattcaccatttttgtcgtatttaccgtctttcatacgcaacattggcgatgttaagcggtcttttccgtagataattttcggcaggaagtaacctttaatacagttcaaaccacggtttacttccgcatcagggtcaccttgagaagcgaccacacgtccattttgcgtacccacaagtacgctacaacccgtaccgcagaaacggcaaggtgctttatcccatttaatgctattgtcgttagcgtacacatttttcacaggtaacgtaatacctgcggcgagagctgctgctgccgctgcatttgctttcataaaatcgcgacgattgagttccataaattccccacaaaataataggtaataccaaattaaagtgtttcatcttggtggctataaatcagcgacaccacgataaccccttcaatatctttaatcatctccatacgatcaaccaaatcaggttgataactggactccaaaacaaccacgagcttactctcttcaagtttcaccccgtggatttccgtattcggtaactcagttaaggcttgcttcaccaagtccaacttttcaggtttcacttgaaccacaaggctacaaacataccagttgtctgcttcatcgtagttcaacttatcagatacatttctcatttcattcacttaacgggcttgcaacatttctcaccaaagtgaccgcttgtgtcggacaaactgccatacaagccccacaaccattacaactttccacatttaattcaggcattgccactcgccccacttgtcgcttaaagcgaatagcgcggctttcacaactatcttcacaactacggcattccacaccgctaaacatcatacagctttgctgaatttcaacataatgaaaccacgctcgctcatctgttgaacgaaacacatcggcttcacacgccttcacacacgcctgacaaaaagtacactccccacgaccattcataaaattgacttcaggataaccaccagcccctttcactaaaatttgcgtttcacacacagcaatacacttatcgcaagcggtgcatttatcaaaaaaatttgcaagatcagtccaaggcgctcgaacggcttgatgcccttgctgagccactttttcgtcctgaagtgatttcaaaaaatgtccacgcaaaaagctacggcgaggtaaagtcgtttctgtaaaattagccaaaaatagtttactaaatggataggttattgatgttaatgattgtaacatttataaaacataaaaaatgcaaacaaaatacattttatgaatgttatttgacaataatcaataaaaaagcggtaaaaatgatttcattctcaccgctatatatttaattttataatgatttttcttaacgctgtcttgccttaaagcgagggttcgttttacaaatcacatataatttacccttacgacgaaccacttggcaatctgggtggcgtgatttcgctgatttaagcgaatttaaaattttcattttgtccccttttatttcttattttttcgttaagctcgaaatgcctttaaagcgttcattgaatttgcttgcacgtccttcagtattcgcttcacgacgtttacccgtataaacagggtgagaagcagaagaagtatctaatggataaagcggatactctttgccatcttcccataccattgttttattggttgccgcacaagagcggataatccagccttgttgcacactaccgtcgtaaaataacacttcacgataattttcagggtgaatcccttttttcatatattctcctagtcaaaaactcagacttaaaaccataaattaaatacgggattattttgcctgaaacaaaataaaaaagctataatttttttatggtctttgttaattttttcaacttaaacgaaaggaaataacgaaattgcgaactggatctaagtttcttcgcgataaatatgctaggctattgctattttgtaagtaggagatcagacaatggcaaaacaaccttatctaatcgctccgtctattttatctgcggatcttgctcgtttaggcgatgatgtggcagaagtattaaaagcaggggcggatttaattcattttgatgtaatggacaaccactatgtgccgaatttaaccttcggacctgcaatttgtaaagccctacgggattacggcattacttgcctgattgatgtacatttaatggcaaaacctgttgatcgcttaatccctgattttgcaaaagcaggggcagacatcatcactttccacccagaagcaacagagcatattgaccgctcgttacaacttatccgtgaacacggttgcaaatcaggcttagtatttaaccctgcaacgccgttaagctacttagactatgtaatggataaagtcgatgtgattttattaatgtccgttaatccaggttttggcggacaagcattcttaccatctaccttgaataaattgcgtgaagctcgtcgcagaattgatgccagtggatttaacattcgcttggaagttgatggcggtgtgaaagtcaataacattgctgaaattgcagaagcaggggcagatatgttcgttgcaggctctgcgattttcgatcaaccagattataaagctgtgattgatcagatgagagcggagttggctgtaaaataatactgtaaaatatctaagaggttaaccagattaaaactatttattatatctatcaggttaaccccttaatgcccttaaatttcatcaataatccgatacacccaattctcaagcgggtcgttcagacgtttcatttccaaacgcatctcttcgagcatctcttttttgattgctttgtaagcgtcatcatagaagagattgtgcatttcctcaggatctttacggacatcatagagttcgcagaggtcggtggcgttgaataccaatttgtagtctttacgtcgccacatacgctgttcaaagtaaacaaagtgtcctgcaagttggcagagcaagcctttgcggtcgttctctttgttttctctggtgatcggtaaaatggtttccccttggaactctggcggtacttcttgcccagccacatcatagaccgttgaggtgaggtcgtgaagatagacgaggttgtcatcaacttcattgacacggttagattgtgggtctttgatgatcagtgggacgttgtaggtggtttcaaacataaactcacctttttcaatcatacgatgtgcacccattgcatcaccgtgatccgctgtggcaacgaggaaggtgttttcgtataagccgttttcttccaagaaggtaaacagctcaccgatggcatcatcaattaaggtgatgtaaccccagaatttggtgatcacttctttccaactctcttcgctggcttcccacattccccacatttttgagatggtgcggaaatgccctggtttgccttcaagcggtttgaagaaactttcatctagcacaacatcttttggatcgtacattgagtagtaaggctcaggcacgatacaaggggtatgtggcccccagaagttaatccaagtgaagaacggtttgccttcagccagcgactcgcggatatattttttcgcttcgtcaatgatgaagtattcaatggtttcttcttttgtgccagagagcaaaccacataactcttgtacgcgtaaatgagggttatcgccaaagtaagctcggctgacttcagggatttcatagcctttttcttctagccattcacgataacggttagagtgtgtcggcggttggttgaacactagatttttatagacttggctacctgggtaaccgtagccatcaaaattgtgtcctttaatcccgtaatcttcaggaacagattttgtgccgacgtgccattttcctacgacataagagttgtatccttctaaattacagatgtttggtgcttgttggctgatttcccctgtgccacctttttcaccgtttttaataatcccgtgactagaaggcattaaaccggtaaacaatgatgttcgggcaggtccgcaaacagaagcaggcgtaaacgcattattgaaacgaataccgtccgccgcaagtctgtcaaggttaggggttttgacaatttggtgtccgtaaggaccaagcatatctttgcggacttggtctaaaagaatgtaaacgatgttgttcatagcaatatccatttttgaatttccttcccccgtttacgggggaaggtgccgaaggcggaaggggggctacgctttatctaccactttctttttaccgaagaaaatcaggataagcacttgcaccacagcccatacgcccataatcattgtcgcattgccttctgtggaagctaaaccaagcggtgataatactaagtgtaaggtaattaagcctaacactaatgaagccacagctgttcttgcatattcccagtgggttaagtccacgtttgaatggttgatttggttatcttcgtatggggtcgcacgttttaagaattgacctaagataagcattaacgccacatcaaagacaaagagtgaacccattacatacacgaaattcactttgacattaatcacccacactaaagtgaagtaaagtacaacgtgagctaatagggtaatacgagccgctaaacctgatacatagcggttgaacaatccaacggcaaagagtgccacgataggaatgttaaagaagcctgcaaaacggcgagtaaacaagaagataccgtctgtaccgaacattaataacggtgcaacaatcattgtgatgatcgccattacggtaccgatttttttcgcataggcaataagttcttcatcgctgcgttttactttggtaatcgcaggtaataagtcgttacagtagatggttgcggctgaatttaagaatgagttgaaggtacttaaaatcgctccgaataatgcagccacaaagaatccttgtaaccaagtcggtaacactttattgactaaacttgggtatgaggcatcaatcggttttaagccttcgcccagaatgtgatagctcaataaacctggtaagttaaggattaacggtagcaacaagaggaaaagtgctgcaattaaaatccctttttgacccgcttttaaatctcttgcccctaacgcacgttgtactatcgcttggtttgttgtccagtagaagaagttgacgattaagatacccgtgaagatagctggccaaggcacagcgtctgtggcactaccgatagcattgaatttttcaacgtgggttgtgctgataatgtgtaaaccttctgaaatgctaccgttacctaaataagcaagggcaaagataggcacaagtaaagcaccgatcactaagatcaccgcattccaagtatccgatacggcaacggctttcaaaccaccgaaaatcgcgtaaattgcaccgatgataccgattgcaattacggtgtaagtaatcgcttcgccatagctgagattaaacacttcttgtaggctgaagattttattaaatgcaatcgcccctgtataaagtgcggttggaatagcaatgaaaagatagaagaacaagaagagcgtggacataatcaaacgagtttgtctgtcaaaacgtgcttcaaagaactctggaatagtggtgtaaccgttacggatatattttggtaacagatataatgcaaggaaacagagtgggataacagattgtaccgtccacgccataatcgagaagttacctgcataagagtttgcattgatcccgattaactgttccgttgaaagtgaggttaataccattgagcagccgatgactgcaccactcaatccacgccctgcaaggaaataaccttttgaggtgcttaaatcatcatctttggttttataccaagagattaaaccgactgcagcggttacgatgataaaactgactatcgtaagaaacatatagtcctccttagtttcagataaagtttatgaagttgctattctagaaatttagaacagctttagcataatctcgttagatgtaaataaattatgataattgtcataactgtaaagtgatcttgctcacaaatttagaaaataatgaaatttcactcggaaaaatatgaggacgatcataatgggatagcagatttcactttcataatagaagctgtaggactttcaacacctctatattagagggcatttatgacaataaccacaattttgattttaatcgcctgtggcatactgactaatttaatgtcagcactgtttgggatcggcggcggtgtgctaatggtgccgattttacatacactgtttcctgaattttcgttgcaaatggttgctgccacctctttaatgacagtgatgggaacagcaacaatcaacttagtctatttctataaacagcgtgttcctgtcaaaatgaaatctctgttgctgtggtcaattggaatgattatcggcgttcagcttgggtttgaaatcagttttttcattccaaattgggcaattgttgcagtgtttgtgactacacttgttgttcttgcattatgtcttattctcgcaaaaaaatctgagaattccaccgcttgtagctcgttaaaagagaacattaagggaatttcagtgtgcttatttggtggaagtgtcgcaggaattacaggtattggcggtggctcaattatggcacctcttattagtttgttaccaagcgtcaaaccacatcaaatcgccgcttatagcaactatatgatgattattggtggattaggaaacttatacggttatctaagcaaaattccaccagtctatttagaaaactcttggcaagtgggatatgtgaattttaccgttgtgtctattgtggtgctatgttcatttttaaccagtttcttttcaatgaagctgagagggattttaaaaccgcttacaatgcaaaggctgttaagcggtattttgttggtgattgctggttatatgttgatcttgcagggtgttcgttattaggctggtaaatattatttagatagcgtaatttgatgttatgctctatggtatatttaaaacattaatattttgtcatcaaatatggcataatttaattattgatttaatggggactaatattatatgaatatccgagatctagaatatctaatcgctttagctgattttaaacattttcgtaaagcagctgatgcttgtaatgtaagccagcccacactgagtgggcagattcgtaagttagaagatgagctcggaactgtgctattggaaagaactagccggaaagtactctttacccaatcagggcttaccttagttgaacaagcaaaagctgtgttaagagaagtgaagattcttagagaaatggcaagcaaccaaggtaaagcaatgtctggccccttacatattggtatcattccaacattaggaccttatatttcaccgataatttttcctcaactaaaacaacttttccctagattagagctttatatttatgaactacaaacatcattacttgtggaacaacttgagtcgggacaactagattgcgttattttagcttttgacaaagaaagcgcgccatttatcgaaatacctatttttaatgaaaaaatgctacttgcagtatccaatcagcataaatgggcaacaacaacctcaatagacttatcaaaattacgcgatcaagaaatgttgatgctagatggagggcattgtctacgaacacagttgatggactattgcttatcaatcggagcaaaagagaacagccactttaaagcaaatagtttagaaacattacgtaatatggttgccgcagatgaaggaattgcgtttatccctgaactagcagctaaaattggaaaaacagataatttacactatattcattttaataatcctgaaccatatagaacaattgggttaatctatcgccccggctccccattacggttgcgatatgaacgccttgcaaaagagattcaaagaataatgtcagagattcaataatgagtagtggaatcagagcaatccaaaaagagaaaactcgccgtgcattagttgatgctgcatttaaccagctaactgcagacaaaagtttttcaaatttaagtctacgtgaagttgcccgtgaagcgggcattgcaccaacgtctttttaccgacactttaaagatatggatgaattggggttagcaatggtagacgaatcagggttaatcttacgtcaattaatgcgccaagctagaaaaagattagaaaaaggggggagtgttattgctatctctgtagaaaccttttttgaacttattgaataccgccctaatatgtttcgtcttttgctgagagaacgatcaggaacctcgcaagaatttagaactgccacgtcacgtgaaatccagcattttgtagcagaactcgcagaatatattcaacaaagagatcacgcaataactcaggaactagcttatattcaatctgaaggacttgttactctcgttttcacagcaggttcccatgctttagacttaaatagtcaagaacgagaaaaattaaaacaacgtgtaattacacaattaagaatgctagctagaggagctgcagcttatactggtggtaagaaataaaatgaaaaagcatggcattatcaactgttctatgaaaaatattttgttatttgtgagtttatttgtattgatcaacactgcagcagattggtttcgtagacccaatccctctcatcaatttgcagaacaagttttatatgatttggagaaaaatcctcaaattattgcacaactaagccaccaaaaatcactgttactctatttttggggcagttggtgcaaattttgtgaatatacctccccatctatttctcagcttgtactagatggcgccaatgttttaagtattgctctcaaatcgggaagtgatgatgaagtaaaacagtatatgaaaactcatcaatatcattttgtgactatcaatgatccaataggaacattttcaaaaagttgggatattcaagcgactccgacattaattattgtaaaagatggcaaaatgattagccacactactggcttctcaacctattgggggattaaaattcggttatggttagccgattgggtgagataaaaacaagcggtcagactgaacgcttgttttgcaaatacactctattttttcactaaaaataaaatcgcatcaatataacgttgaacaaattcgttggttgagcctgaatcggagaaaccttctggatttagctgatattgttcattcacaaaaaatgctggcacgccacgcactttaaattcttcagcagcttgagtttgttttgtcactaaaccattcaccgcaaagctattaatgccgccgtcaaattgttctgcggtaatgccatttgctaagaaaatcgcacgaatgtcgtccatcgatttaatcgcatctttttgtgccgcttcaaataatggggttttcaccttatcttccgcgcctaatgccattgctaatgcccacgctcgtgttaattctgtcgattgacgacctaaaaaatcaacgtggtactgttttaacacagccccttcaggtaaacctgctttgactttacttggaattttgtaattcaattcaaaatcatagcagtgtgggcaatagaaagagaaaaattctaacacctctttttgagccgaaggcacttggcgaacttcgagatactctttatttgcaacaggatcttgtgccattgcggttgttgaaaaagcccctaatgcagaaagggcaatgaatacggtttttaaagcaaatttcttcataaattcctcgagttaaaaaagtcgatcctatgacaacattaatcatttaaaattccacgcgcttttaataaagcggttttaaaatcttcttcataatcttttttgataccagggatcacttcggttttatctttttcactcattttgagttgataaattaacacttcatcacgcagtgcatctaaatcattcggtttgccaacttcttcagcaagtttgtgtaataaatcaagtaagtgaagatcgggttctttacgccaatgttcacctaatagctctaacacttcgtctaaacgtttacatttcatcagaaaatccttaaaaaatttggaaaaaactaggcaggatcatatacttttaaggttaattttgcaaaaacaaggggaaaataaatgcaatttaatcaaattcaaggggtaattttagcgggagggcttgcccgtcgtttgaatggggtacaaaaaggattgcaacttctacaaggtaaacctctgatttctcatattttggaaagattatccccacaaatttgcaaaatctggttgaatgtgaaccgcttgcaagcgcagtatcagcaacactatcctgatattccgctttatgccgattgtcttgaaggctttcaaggggcattaagcggtatgttagctggctttgagcaaattgatagtgaatatttgctatttgtcccttgcgatagcccatttttacctgaaaatcttgccgtaaaactaagtacagccttacagatcaacaatgctcaaattacctttgcccacgacggtgaacgcccacacccgacttttgctttaatccatcgttctgtcgtacctgcattgcaagattacctgaataatggcgaacgccgtctatttcagtttttccaaagccaacgcagtattgccgttgatttttctgaacaaaaacaggcgtttaaaaattttaataccccagaagattttcttccttattctctccctccgcttgcggggggaggtgtccgtaggacaaaggggggcattccgttacttgcagtgacaggctatagtggcacgggcaaaaccactttacttgaaaagctaattccccagttaaatcaaaaagggataaaggtaggtttaattaagcactctcaccataatgttgatgtcgataaagcaggaaaagacagccaccgcctacgtttagcaggggcaaatccgacaatgattgtgtgtgaacagcgttgggcgatgatggtggaaacgaatactctcgcgtcttttaatgtactggtaaaacagatggaaacacaaaatgtcgatctgattttagtcgaaggcttcaaacacgaaaccttgccgaaaattcagctacaccgaaaagagatggataaacccttacctgagttagatcctttcacccttgccaccgcaacggattatccgttggaaagagaaaatctgttggatattaataatgtggagcagattgcggagtttatggtgggtgttttggaagggtaacgtattggagctaataaacgacatagtaggaaaatttatgtagcaactgctacataatatcgatagtacaaggctttaagccctctttttgaaacatgaacaaaaaactgcccattttgccaaagcctgaaaataaaaaacataggacatcaaataatattcaacgatatttttgtcataagtgtcataaaacattttcccttaagaataaattagatccaataaaaatttggactgattacacatctggaaaacaaacctatcaacattccttataaatatcgtaatgtaagaagtacttataccagtttaaagcattatatagattttatttttacctatgagaaatattctgaattaaatatagaaaagacaataaatcacttagagggattatttagaaaacttaagtggaaatcaaataatcacaaggggttgacgaaacctataacaccttgtttataaatgatttttcaaataaaaagagttgctaatatttaaagaaaataaacattagcaactatttcgtctactatgccagatatctatattagcatataaccataaataatagtttactgcttatagtaaatcacctccttagccaccaatctatactttatattctaaattactttagattagacatagtaagtcattggtaagattaaatttccttccaccctaactcctgcgaaatagcttgtgcagtttgttgtacctcgcgtagaaaatcccccatcgtatattcattcaaacgatgaatagaagttgaaactgaaatggcatattccactctgccaaggtgattaaatacaggtacagcgaggcagcacacgccaagttcattctcttctctatccattgcaaaaccagatttaagaatatcgttgagttcttgacgcatagcttgaatgtccgtaatggttttgcaagttctctgctcaatctgaccgctatgtgcctgccaataacgatctaaatattctttattttcttcataagcaagataaagtttacccattgcagaacaataaagtggcaaatgttgtccaatataggcgcgcgttttcatcatacccattgttggctcgagcttgtaaatcataatcgcgtgatcgtcttctcgctttgaaaaattgacggtttcacctaaggcaagatttaatcgttctaaatgcgaggaagctaaatgaataatattcattgaagcaagggttttctgccctaaacttagacattttgttgttaaacgatagctaccaacagaacttgctgctttcacatacccctcgttttgtaacccttgcagtaaacggtgtacggtacttttgttaagttctgaaatttcagccaatttcgctagtgggcaaccatttggaaagttacttaaaatatccattaaacgtaaaccacgaataaggctttgatttccaccacttttttcctctgccattttgttctcctcttattcattttatgccacctatcatagcatatttttctgtttcatattttggaatgcaatcccataaaaatgagatcttgctcacaaaactaaaactttacaaataacatattgattttaaatggtttttatttttatggtttgattgacttttaatctgtttaggtttaatttatgaaatatcattttgatatatgaaacaaaggggttactaatgaaagtatcatatcaagagcttaaagccgaatttaaacgtgtgctacttgcccgcaatgttcgtgaagagattgcagaagagtgtgccacaatgtttgctgacactacccaagcgggtgtttattctcacggtgtaaaccgttttcctcgttttattcaacagttagaaaagggcgatgttattcctgatgcagtgccaaccaaagtgctttcgttaggggcaattgaacaatgggacgcacatcaagccatcggtaacttaactgctaaaaaacagcgaaatcggtcaaggtttattaaaagatttagaagcacaaggattaaaaggcttagctttctgggaagtcgggttccgctcatttactaactcaaaacacccagttaaatcacctgaagacatcaaagggttaaaagtccgtactaaccaaaacccaatgtatattcaggcatttagcctacttggtgcaaatcctgtgccaatgccactctctgaactttatactgcgcttgaaacacgagcagtagatgcacaagaacacccaatcggtattttctggtcagctaaactttacgaagtacaaaaacatttaagtttaaccaatcacggttatactccattaattgttgtaatgaacaaagcgaaattcgacagtttctcaccagaattacaacaagcaattcttgatgcagctaaagaagcaggcaactatcaacgccaacttaatttagagaatgaaaaagagatcatcgctaaattacaaaaagcaggtattcaagtgattgaagaagtagataacaaaccgtttaaagccatcattgaagcagatgttcgcaaagcctttattgagaaaaacggcagtgaattagttgaaaaaattgatgggttagcgaaataatacaccttctctatccccctttttcccaaaagggggatttgctaatacagaaataaaaaggaactcaaatgaactactacttaggcattgattgtggtggcacttttattaaagcagcactgtttgatcgtcacggacaaatctgcggacttgctcgtgaaaatgtagcggtcatcagcgaaaaagcaggttatgcagaaagggatatggctcaactttggcaagtctgtgccaatgttattcaccaaacacttgaaaaaagtgatgtagagccaaccgcaatcaaaggagtaggcatttcagctcaaggaaaaggtgcgtttttactggataaaaataaacaaccactaggtagagcgatcttatcttccgaccaacgttctatcgacatcgttaaacagtggcaaaaagaaggcataccagaaaaactctacccaatcacccgccaaaccttatggacagggcaccctgtttccattttacgctggataaaagaacacgaaccagaacgttatgcacaaatcggttctgtattaatgtcacacgactacttacgcttttgccttactggtgaattacattgtgaagaaaccaatatttctgagtccaatctctacaatatggcagaaggaaaatacgatctccaacttgctgaaatacttggtttgcaagaaatcattgataaattgccgcttgtgatcgccccaaaccaagtggcaggttatgtgaccgaaaaggcttccgctctttgtggtttagcggtgggaacacctgtggtcggtggcttattcgatgtcgtctctaccgcattatgtgcagggttagatgatgaaaccaaacttaatgccgtactcggtacttggtcggttgtcagtggtatcacagaccatatcgatccaaaccaagatttaccgtttgtttacggacgttatgcacaagcgggcaaatttatcgttcacgaagccagcccgacttcagcgggtaatttagaatggtttatcaaacagtggaatttagattacgctcacattaatcaaacgattgccgaactcgcgcctgccgctagctccgtactgtttgtcccattcctttatggctctaacgcaggtttaggtatgcaagcaggtttttatggaatacaagcatatcatacacaagctcatctactccaagccatttacgaaggcgtactgttcagcttaatgcatcatctcaaccgaatgctacaacgcttcccgaatactcagatactccgtgttacaggtggaccaacgaagtcgccaatttggttacaaatgctggcggatttaacaggagtgatcttagaagtaccaaatattgaagaaacaggttgcttaggggcagcgatgatggcaatggaagcggctgacgaaaatcgcccagaactattgcaacaagcaatgcgtcaagtgcaaccaaatcctgaacattttgaagcctatcaacaaaaatatcagcgttatcaacagttagttactacactgaaagcattacactagataagttcaagcggtaagatttattgcaaatttagcaactgctcttaccgcttgtacatttccaatcccaaggctcctacaaaacaggcaattttgcactctccacaaccgttgtataccgatacaaacagatgttcggggcaagaaaacggcgggcgggcaacttggcgagcgatttccgtactcacacttttttgcgtaccgccaagcaaactgcgaaatagccctctgcacgaaagggggcagtttttgtatcgggattccatcaacctctacccaatttgcctgaattaaccacgttctctaatgtttatgcagtttcacctgactgccagccgtttaaatcttatgttgtcgcttcgcttgatgatactgttgtgccacatcaatatagtgatgatttagccaaacatttaaaagcagactatatccgtttgccaactggggggcattttttagatcgggaaggttggaataaatttgagcttatacttgaattaatttgtaaattaaaaggatatacagagaagaattagaaaaataagacatttatttaacatctaactttggcatagtagacaaaatgccatgcctgtctactatgccgcctatttggctaaaaatagcgataggcttcctttacttattgcaataatatttattaagtattttgcttctctacctgattaaattcaagttcaacaggcgttgctcggccaaaaatggaaacggacactttgacacgacctttttcataatccacctcttccacagtgcctgtaaaatctgaaaaaggaccttctttaacacgaacttcttcacctgggtggaactctgttctgtgacgtggtttatccgccgtttcttgaacacggttaaggatacgctctgcttcacgctgagaaattggtgcaggcttatccgcagtacctccgataaagcccattacacgcggcacgctttttaccagatgccacgtatcatcattcatttccatttgaactaacacataacctgggaaaaatttgcgttctgttttacgacggcgtccaccaacattctcaaccacctcttctgtgggaacgagcacctcaccaaattggtcttgcatattatgcaatttaatatactcacgaagagtcattgcaacacgggcttcaaagcccgaaaatgcttgtaatacaaaccaacgcattttgcttgtatctttttcttgttcgactatttcaatctcgctcatattagaatctcaaatttgttaggaaatcaacaattaacacaataatagagtcgataccccataatgctaatgccactacaacgcacattgcgacaaccattaaagttgtttgcgtcgtttcttggcgatttggccaaataattttacgtaattcttgccgcgaatctttgataaaatcaattgattgctgaccttggttagtcattgcagcaatacccaatgcagcaacacatagcacaactaacagcaatatacgaacaattaatgaaaagtattctgcaaaataggtatttccaatagctgctattgttaataatgaaattgaaaatacccataatacattatttatacctttacttttgacacccttttctactttatccagggttatgttttgaatttctttagccatagacaacctaaaatttattacaaaagtgaatattcaattataaatcgcgcaattctaacattttctgctggtgttgccacgatcttttcacaaatttcttgtgaatcttattattttttgagtgttacaaggattttcaagtacgttattactttgcactataaccttgtcatctatttttagaatcattctaaaaaataccataaattcaatctgtgataatttcaactagtaagcaaaaataaagcacatctacccccttccccccacagtaatcttatccaacttcaccgtaggttgcccaacgccaacaggtacagattgcccttctttaccgcaagtgccgatacctaaatccagttccatttttttaccaaccattgacacctgttgcattgcttcgataccactgccgattaaggttgcacctgtgactggtttggtgattttgcctttttcgattaaataggcttcggacgttgagaatacgaatttgcctgaggtaatgtccacttgtccgccgctgaaatggggagcgtataaaccaaagtccacggattcaatcatttcgtcgaactcgtgattgccttctgtcatataggtgttggtcatacggggcattggtaagtgggcataagactcacggcgaccgttacctgttggggcaacgcccattaaacgagtattgagcttatcttgcatatagccttttaaaatcccgttttcaatcaatacattacgttgtgaaggtacaccttcatcatcaacggtaatcgaacctcgcatattcggtacagtaccgtcatcgacaatggtacaaagtggtgatgttacaagttcgccgattctgcctgtgaacattgatgattctttgcgattaaaatcgccttctaaaccgtgtccaaccgcttcgtgcagtaaaatccctggccagccagcacccagcacaatcggcattgagccagcaggtgcagcgaccgcacctaaattcacaaccgcttgtcgcactgcttctttagcaaggtagacggcacgactgtcgcctgtatagtgtgttgctaagaaccattccaagccaaagcgtccaccagcccctgcactgcctcgctcacgtttaccgttctgttctactaataccgaaatagataaacgtactaacgggcgaatatccgcggctaaagtgccgtccgttgcagacactaacatttcttcatatacggcagacagatttgcgttcacttgaattacacgaggatcttcggctctcgccactttatcgactaaatgtaatagttcaactttctgttcacgacttaaggtatcaaggggattgatcgaggcatagcgtttgatagcggtcgtttctttgaaaggttttaccaacaaccgaccgctttcttgcgtgatactacgagcagccattgcacattgctcaagctggctaagcgaaatttgatcggcataagcaaagcctgttttttcccctgacaccgcacgcacaccgacaccacggtcgatataaaaaccgccttctttgataatgctatcttctaacgaccaactctcatcttggctaaattgaaaatagagatcggcatagtcgatttgacggctagaaaaatgatccaacactttcgtcagatcggataattgaagtccgctaggtaacagtaaactgtttgaaacttggtttaacattggttttctctaaataatgataggcggtgagattttaacggatttttacaaatgatagggaaatttttaggggaaagatgatttgtgatatacttgacccgattatctgttttatccaagaagttttacaatgcgagatcctcttcaatattatttccttgaaatgcgagagcattatctaaatgtaccttatctcaaccaacaacgccgaatccgtgtgcttttacccaaagggtatcgtgaagaagcagggcattatcctgtgttatatatgcacgacggacaaaatattttttatagcaaagagtcttattcgggacattcttggaaagtgattccgacgattaaaaatcacaaagaatttccaaagatgatcattgttggtattgacaatgcaggccctgatcgtcttgatgaatatggtccgtggcgaacagacacaggctctacccctgaaacccaaaatgctggaggatatggaatggcgtacgggcgttgggtggttgaaacggttaagcctttcatcgatcaacattaccgaactaaacgtgatcgtgatcataccctacttgcaggtagctcaatgggcggtattatcactgcttatatgggagcggaatatcctgaagtattcgggcatttaggcgtattttctcttgcctcgtggtttagtgaacctgcctttatggaatttattcatacacacccactcaaccgctcaagcaaagtgtttattcaagtgggaacgaatgaaggcgatgaagtggattcacattttatttcaaatatgaatcaggcttatattgactgtacgctgcattattaccaagcactaatccgcacgggacatcctctcgataatattcgtctaaaaattatggcaaatgaaatccaccacgaaatgcactgggcggatcattttgtcgagtttttacggttttcgttgatgaatcattaaaaagttattggaataaatacccaacacttctatacatcatttcagattatctatatacgctataaagtataaaaatcatggttatactttacagcgtatatttcataaattatacttcacttagtataaaataaatttggaagaaatatgttaatcacgacaccagatatgcttggaaatagcctacgcgatattcgtaagcaaaaaaagctttctcaaatgcaaatagcaaatcaagtagctttaagacaagccacgatttccacctttgagaaaaaaaccgataaagccactattgaaacattattcaagttactttcaggtttaggctatgaactacatatccaacctcgtcctgaaaaaacagaggggaacgatgaatggtaatgcgattacgagtattaatgaatggcgaaatggttgggtattttgaccgcactttatcgggttcccaccattttacctatgctgaaagttggctaaattccccattagctcgcccgatttccctttctatgcccctgcaaagagcaacatatcaaggcaaagaagtgattaatttctttgataatttactgcccgataatcctcaaattcgagcaagaattgcgacaagatttaatgctgaaacacaacaaccttttgacttacttgctaaaattggtcgcgatgctgcgggtgctattactcttttaggggaagatgaacaaattcctaatcatcgaataattcaagccacagaattaaacgagagtgaaatggcgaaaattctacaaagttatcaatacaatgccccgcttggtatgattgataataatcaggacttcagaatttctattgctggtgcacaagaaaaaacagctctgctttggcataacagcaaatggaaattaccacacggattgaccccgacaacgcatattttcaaattgcctatgggagaaattcgcacccctaaacacctgcttgatctgtcaaaaagtgtagataacgaactcgtctgtttgagattattttctgctttcaatatcccttccgcaaacgttgaattattggaaatgaacgatatacgggcattagctgttgaacgttttgatcgccgtcttagtcaagatggcagttattttttacgtttaccttacgaagatttctgtcaggcattcggcttatcgccaacgcaaaaatatgaaagcgatggtggaattggtattggggatatgatgaataagttgctctactccagtaattccaacgatcgccgtcaatttatgcaaactcaatttctgttttggctactggctgccattgatggacacgctaaaaacttttctctcgccattgaaaaacaagggcgttatcacttatccccagtgtatgacgtactttctgcttatccaatgttaggcggaaaaggttggcatcacagtgaattacaaatggcaatgagcttgcgtagcacgcaaaaagggaaaaaatggcattggagtaaaatttatgctgaacatttctatgccacagctaagtttgtcggatttagctcaagtgatatgaaacaagtgatagagcaaatttgcgatacagtgcaagaaaccattgatagcgtagcaacaacactacccaaacagatagatgaaaatgtacgggatcaaatattcacgggcataatgaaacaggtgcaaaaagtttctatgaagtaaccgctattttgctaacaccctcaccaaaacccctaacgcctgttcgatctcttggttccaagcataagaacaattaaccctaatccctttatgctgcgaagtaggcaaggtaaaaagctcacttgggctaatgctgattttttcttcgagcaactcttgataaatctgcatactatccaaatgttcgggcaggtgtatccaaaggaaatagccgctgctgtggtgttcgataggacaacttgcaggcaagtgctgacgtaggtaatccaaacactgctttttgtttttttctaaatgacggcgaaggtgtcgcagatgtttctcgtagtggtgattagagataaattctaccaaggcttgttgaattaaagcgttagcagaaatggtactcatcagttgcaaatgttggattttatcggcaaattgccctgcgtgaacccagcagatacggaagtttgcccctaaaattttagaaaaagaagaacaatgcaacacccagttttgtgcatcaaacgccttcatcggcaagggcttttcaccccgataataaagctcttgatacacatcgtcttcaattaaatgcacttgatattgagctaacaattccccaatccgctgtttgatttcggggctgacggtaaaccccagaggattatggcagttcagaataaaccaataaaccttgatcggataacgctgtaaggcttgctcaaacgctacaaggtcaaaaccgcttgggtggtcgggcgaagtaacaacatttaaacctaacttttccgcaatctgccacaccccataaaataccgtctgctgtaataaaatataatcgccctgttgcgttaaggcttgtagcgaaaggttcaaagcgtctaaacagccggacgtaatcacaatatcatcggcttgcgtaggaacaccttgcaagcggtaacgttgtgcgattaatttacgcaagtccacattgcccgacaacacaggctgtggctcaatctgcgttctatcacggctaagctggcttagaatttgtagcaatttgggcggattgagataatcgtggctcggaaaaggcgaccccaaaggctcaatatccgtaatggatttcagataacgaaacaccaacgaattaatctcgacttgtttgttcaacctaatttcactgttggcgtgcggacgagaagacgggtaaaaaggtgcaacaaaataaccgcttttttgcaccgaataaatcaccccctttgcccccattgagaatggcattagactaaacaggatttcagttaagaagtttaaatcggaaattgtttcttcagtggcggaaaattcagttatccaaaaattttggataactactgaaacgtgaactgattttaaatttgtgcagcaggttgctgcacaattgctatggctaaccactttaccaaccgtagaacaactcgaaagcgagctgtcggattggtaaagtgaggaagataaagtttggggatttaggtaggtaaaagagcggtcgtttttgtaaaagatcttgcgaaaacaaccgcttgtcattctatcttctgaataggtaataactacccttctaactgcagcatcacctcacgcaaccatttttgcacagggtcgtgttgagttcgttcgtgccaagtcatcactttatcgtatccttccacttcaaaagggatttctttggtgataataccgtgggcattttgaaccagatgataaggcacaacggcggctaaatcgctttgtcgcaataattcgggaacaatggcaaaactttgcaccgataacaccacattgcgagatgaaccaattttttccaaagccctatctgttaccccaacaaagctgtcgctaaacaaggaaaccagcacaaaatttaggctacaaaagctgtctaaagtccatttttgttgcaatatcgggtgctgttcacgcattgcacaaacgtagcgttcgtgatgtaaacggcggacaaataggttgggagaaaccgcaggatcgcaaaattcggatattaaattcggctggggctggtgggcgaaatttggtgaatggtcgtgggggattgaggtgacgtttatggcggtgttgctgggctatgcgtggtttaaatccactaaaaatggtgtgaatttaacgtggcaagtgctgtttttgagtgtgactgctatcaatatgtcgccgtggttatcgccgatgaaacacgttgcggtgttgcctgaaccttggtcgcatttaattcacggttttttggttacgattggctatgttattccacctttgattttggtgtggatgtatgcccgtcagcgtaaagaaataaaatggtattgggcttaatttaaggcttgttaagtgcgtatgaacgcaccttttttgtctaaaattttattttgtgatcttgatcgaaaaaatcaccgcttgttattttcttggttgtggttttattctatgtttacgcaaaatttaaccgttgcaaaaaatgaaacaactgcttctgatggaaaagtttatcaagtagattattacaatctcgatgttattatttctgtcggctaccgagtaaaatcaatgcgtggcgtgcaattccgtcaatgggcaacccaaacgctgaaacagtttttggtacaaggttatgcgattaaccaaaaacgcttgcaggaaaaaggcgtggaatttagccaagcagtggcattgttaagtcaaacactcaccaaccaagccttgattagtgatgaaggtaaggcggttattggtgtggtgcaggactatgcgagaacttggagcttgttgcaggcatatgacgagcaaaatctagcggcaatttcggtgcaacagcctgaaatgaaaccgttagtgtttgaagatgtcttaaccgccatttcgcaattaaaacaagaactaattgccaaaggcgaggcgaccgagtctgtttttatggtatttacaccaaaatcaagccctgcttgccaaacccgttaatgaattgattaacgataacaccttggttgcccttgccttgttggtagcagaaagtttgcctgaacaaaaagagctaatgatccgtttggtggagcattttattttgttgaaagggtagtggtgcattagcaaacgcctcctaccacgctttcccttcaaaactctccacccaaaaggggctaatctacgtcagccctttaaagcaacataacggctgatcatcggtttggaaatctctaaccgttctgcagtggcggtaaaactgcctgtttcggcaacggtcagaaagaccttgattgcggtgagtttgtccatagttatcctttttgtttcttaatcggaaataattgtattctaaaatcgcactttttctctctttttatttcattaaaatgcacaccatcaatagcaatcaagctgaatgtataatccaacaaaaggaaaacaaaatgaaaaaattacttttacttttaactgcacttttctcatcaaccgttgcaatggcacaaactacgccagagcaaaataaagcgaatgcattggcgttctatgaaatggcgtttaaccaacatcaattacaagacgcagtggataaatatatcggcaaagagtatttgcaacacaacccaagtgtagccgatggtggtcaagcctttattgatgcttttgctccgtttttgaaagaacacccaacttcgcgagcaacagttaaacgtgtattagcggacggcgatttagtagcattacacgttcacagccagctcaatgaaaaagataaaggcgaagcggtggtggatattttccgtttcgatgaaaacggcaacattgtagaacattgggacgtaatccaagcggtaccagaaaaaacagaaagcggacgtggaatgttttaatgaaaatttattatttattcgatcccctttgcggctggtgttatggtgcgtcagcaacattgcaaaaactcaatgaaatctatccgcttgcacttgtgccaacggggctgttttaccaaagcggtcgtaaaatggacgccgatttcgcccgctatgcgtgggataacgatcaacggttgcatattgtgccgagccagttgttgtatggggctggtgcaaaccttgtggactatgtggactatgtgcaacggctttaataaaaaacgtaaggttttattgtaatagataaatccctaaacagagcaagctgacctgattcttgcatagatttagaacagtctatggaaacttttttatcaggtatggaacaacgtttggggaaataacaaaacaacaagcggtgggattttgcatatttgagacaatcccaccgctttgtgttatcaagtcctcaccaacctactcaccacctgtcctgctgttttttctttaattacctgccaatgttcaggcaagaccaacagcgagtgatttttttctgtttcgacataaatcaaggcgttttcagccagccagccgttttgttcgagtgccgttaagacttgcggtacaaagccttgatgaaatggcggatcgacaaaaaccagatcaaaaggcatttcgctatttttctgtgcaagaaattgtagggtatccgtttgaataactttgccattttcagcttttaggctgactaaattctttttgagttggtttgctgcgtctgcaaatttttctaagaatacaaccgcttgtgcttggcgtgagagtgcttcgatcccaagtgagccactgcctgcaaagcagtctaagcaacgagagccggcaatatccatcatcagccagttaaagagcgtttcttttactcggtcagtggttgggcgtaatccttcggcgtttaacacaggcagttttcgcccacgccataagccagcaatcacacggacttcgccagcaggtctgttttgtgtggaaattcgagtttttttcatactaaatcgtaaaaattagggttaaaaatgatagactaatacaagtttattccatttttgtcgaaaatggattttttaattttaagagagagcaaaaaatgtcagatgaaaagaagaaaaaaggcttttggtcttggttaggtttcgggaaaaaagaagatgttgaacaaacggaaacgaccgaagaaaaagtagaagagaaagcagaagttcagccagaggaaatcaccgaacgagcggtcagttctaagcaatattttgcaaaagatgaagaagttatcgaagaaaatataacaaccgaaaacgtgactgaagtcccaactgaagttgtcgaagatgttatcgttgaacagacggcggaagaaacagttgaaactgtcgagcaggcggttgttgaacccaccgcagaaactacagaaaactcagatgaacaaacggaagagttgcaaatttctgagcaaaatccaccgcttgtcgaagatgaaagtccagtcgaagaacgtgttcaggcagatgaatatcaagaaaaaccaaccagcgaaggcggttttttcagccgtttaatcaaaggattaatcaaaacgaagcagagtatcggctctggcttccgtaatttctttagtggtaagaaaattgatgatgagttgtttgaagagctagaagaacagttattggtggcggatttaggtatgccgactaccacgaaaatcattaaaaatttaaccgaacacgccacaaaacagcaattacgtgacgctgagttgctctatcagcagttaaaagttgaacttgccgatgtgctgaaacctgttgctcagtcattggtattggaagataaaaaaccttatgtgatcttgatggtgggggtaaatggggttggtaaaacaactactatcggtaaattagcacgaaaattccaagcggaaggaaaatcagtgatgttagcggccggcgatacgttccgtgcggcggccgttgaacagcttcaagtgtggggcgaacgcaatcacattccagtcgtggcacaaagtacgggggctgattctgcgtcagtgatttttgatgcaatgcaatcggcagcagcaaaagggattgatgtgttaatcgcagacaccgcaggacgtttgcaaaacaaaaataacttaatggacgagttgaaaaaaatagtgcgagtaatgaaaaaatatgatgaaaccgcaccgcacgaaattatgcttacccttgatgctggtacaggacagaatgcgatcagccaagcgaaactgtttaatgaagcggttggtttaacggggattaccttaacaaaactggacggtactgcgaaaggtggggtaatttttgcgattgccgaccaattcaatattccaattcgctttattggggtgggtgaaaaaattgatgatttacgcccatttgatgccgaagactttattgaagccttatttactcacgaggacgagaagtaatgatccgatttactaatgtcagcaaagcctataaaggcggtggacgaccagctctgcaagggattaacttccaccttgcagaaggggaaatgaaatatatcacggggcattcaggggcaggaaaaaccaccttgctgaagctgattatgggcattgaacgagccaatggcggacaagtgatgttcaacggacacgacattacgctccttgcagaacgagaattgccgtttttacgtcgtcaaattggtatggttcaccaaaattatagcctactgagcgaccgctcgattttagataatgtagcattacctttgatcattatgggcgttaatcaaaccgttgcagaacgtgaagctcgccttgctcttgctcgtgttggcttggaaaataaagcgaacttccgaccgcttaatctgtcaggtggggagcaacaacgtgtagatattgctcgtgcgattgttcatcgtccgctgttattacttgctgatgaaccaacaggcaatttagacgacaaactctcttttgaaatttttcgtttatttgaagaatttaacaaagcaggcacaacagtattgattgccacccacgatacaaacattatcgcccaacgccctaaaccgtgtttagagttggaagaaggacatttaaagtaaggatcgacaatgctaaattcacttaatgctcaaacccgttttattctgcgttcagtgtggcaagatctactcaaacgtaaatttggcactttcttaacggtattagttattacggtgtccttaacgataccgaccgtcagctacttgctatggaaaaatacgagccacgcagcgacggaattttatccagagccagaattgacggtctatctacataaaaacctagcagaacacgatattaatgcagttgttgaacggattcgtcagtttgataccgataaggtggactctcttaattacatttctcgccaacaaagcctagatgagtttcgttcttggtcaggatttggggaggcattagatattttagatgacaatccactaccagccgtggtgctcttaaagccgaaaaaaacctttacctcacctgaaaatatgctggaacttcgcaatggtttgcagaatattaaaggggtacaggaagtgcgtttggacaatggttggttagaaaaacttacagcgattacccaactcattgctcgtgtagcggtcacttgtacgctgttgatgctgattgccgttttccttgttatcagtaacagcattcgttctgatgtgtctaatagcaaagcatctattgatgtgatgcaactattgggagcgacggatcattttatttcacgcccattcctatatattggaatgatttatggcttgctaggaagtcttttagcaatgttgtttagtttaatgactatcagctatttcactggggtagttcgttatgtatccgatatgtttacggtgaaatttgaactacacggctttgatgtcagtgaagtgatttttattatggcactgagtatctttcttggctggttatctgcgaagattgcaacgaataggtatattcagaaaattggtggaaagtggtagaagattttatgaaagatagaatagctgttaatttttggcaaagcgatataagaaaatgcgctgcattagagatgtagaggctgtaataaaataggagactgacgtagattgaccctatcccaaattctgtgtaaacacccatttcaacttaacggtgatcgtctaagcgatcaccaaaatcaatcataaatcgattcatcgccagtttccagttctgaatcggcattgtccatttttttgatgcatctttaatcgcaagccaaatcactttgaaaactgaatcatccgtcgggaatacatttcgttttttaatcacgcgacgaatcacgctattaagcgattccaccgcattcgtggtataaatcgctttacgaatatcagctggataatcaaaaaatgtggcaatatttgcccagttatcttcccagcctttcgccacaagcgggtattttgtctgccatttttgtgaaagtgcggtcagattttcgcgagcctgtgcttccgtagggggctgataaacctgctttaaatctgcggtgacggctttgtaatctttccacgaaacgaatttcaagctgttacgcactaaatgcacaatgcaaagctgaattttcgttttagataaccaagatggtcggtcagttcaccatttaacgcagcctcgacggtgattttcttgagcatccgtgaaaattgattgaggtcttctggtgtttttaggtttttggcaaattccgctgccaaggcgtgaagttgtttttcgttcataataaaatacctgtgtctgaatgtattatctcagaaacaggtatttacacaaattgtgggagaggctccatatcggacacagcctaatttaaaaatttaaaatgggttttaaaatttcttaaacccattttaaaaaccgatcaaacctgcccaaacctatgaaaaaatattgcaaaaactgcccattttcaaccatttttgcccattttactttttgcataactccccccaacaaaaaaatgcggtaagccccatcacacaaagccccaccgcattttttcagcccaaattttttctttctttctatgcaaaaatagtcagtaccccacatctccacacgaatttaggggctgatgtaagttagccctaaatttcaggcatagcaaccatttttactatgtcagttttaatgaatatgctatctcatatagttgcgattgatgcttttttcttaattttcgcatcataatctccaccatatgaaattgacacatctgtgctggcgtattaaataaatctttcatcaaaccactccaaccatcgaaggtaattgattgaattatatagcctttttctcttaacctatttagagcaagtttgtagtaaatatctttttcggttcggacaaaataatgggcaatgacgttatttgaatttgaatccattaataccaatacaccaaaataacgaccgaagaatgtcgtatccataatgatgttcaagtatcgatttaaaggtggttttaaagctgttttaggggctttattgatatatcttggaatcgttctgactgaacaatgatatttaacggcaagttgttgataggtttgttttccagatgtgtaatcagtccaaattttaattgggtctaatttatttttgaaggaaaaggttttatggcatttatgacaaaaatatcgttgaatattatttgatgtaccatgtttctttattttcagactttggcaaaatgggcagtttttgttcatacctcaaaaaatgagcttaaagccttatactataaggctttaagccactttttagcaacaaatttgtctattacacctattttttaaggttataaaaaagtaatctgcactcaaaaagttggactaaacaaccaactgattaatgtgtagattttttatgaccaaatataacaaactattcaaacaacaagtaatcgagttttatcctcaaaatggcaaaaatcgatctctcactcatcggcaatttcaactcaaagacacaacgctatgtcgttggatttcaaaatataatcataatggaatcaatgagttagaggttgtcagcaagaatcaaaatgagggcttgaagccttgtagtataaggctttaagtcactttttaccaacacttttgtctactatgccaaataaaaacaacctgtatcaaacaagaaacacaggttgttatatcaatcttgtactaaatcttcgaatatatctcagctattgccaatattttttctttgaagtttgtccgatacctgggttaaaactatttgttggatcaagatgttgatagaatttacgtaaagtaggttttgcttcatacaaatgtcctacattatgctcagcaggatactgggcaccacgttggtcaagcaattctaacattttatgctctaatgctacgcagtcatgaccttttttcacaatataatcctgatgaaaaacatggcacataaaatgaccgtaatagagtttatggctaattttatcgttgatctctgttggtaatacttcaaaccattcactatcattgcggcgcaacgcaatatctaaagcaacaatatcctctacctctttttcatgaatagctctgtaacgtactgccgcagaagcaacagcaaatctgtgaagcattgccgcttgagtttcttccgaattacattcgaaataaccacctttagcactttctgcgaagtaggtttttaaatattctcttgcttctgtaacaccctcccccccccccccccacttttaacgattaaatgatgttcatatttatctcgatattgacgaagacttaaaggtaaatgctgtggtaatactttagaaattaattgtaatgctttatcactcaaatggttaggtaaaaaatgatattttttagctaaacggtctactctcgcttttagtgcgaataacattggtaaacgatgagtacccagctttttaattacccaaaatgtatctttaccatattctgcagccatatcaaaagcatcacgatgaatatattctcctgaaattggtaactgctgaaaattagctagcatataacggcgaatatcattaagaacttcagttcgatttgttccaatataaaatacagccgtttctttttctgcaggaaaagtatctaaacgtacagcaaaaatagctaacttccctgcacttccggatgcttcataatgacgagccggatcagcattaaaacgagcgggtgaatcttcgtctatttgacgaacatgattacagtaagcatgatcatgtccttttccacattctagttgaatatccttacgttgataacgctgttcttgtagattttgtaaaatctcttcaggtgtttcacctaaatcaatccctaagtgatttttaagttctaattcacctttttcatttaattgagcataaagtgccatttcggtataagccggtcctcgttgtactaaagcccctcccgaattattgcaaacaccaccaataaccgatgcaccaatacatgatgagcctattacagaatgtgcttctctattgtgaggttttaatgcattctctagagcattaagagtagaaccaggcaaacacacaacctgactcgcattattaataagttgaattccattgattctcattgcattaataatcacgatatcccgatcataatcatcgccattcggtgtcgaaccccctgtcaaccccgtatttgcagcttgggtaatcactataacatcagctgcaacacaagcctttaatatttcccaaaactctagtaatgtcgctggacgtacaacggcaagtgcatttcctgatccaaaacgataaccacttcgataaacttctgttttggaggcttcagtaataatatatttctcccccacaatttgagtgagtgtactaataagcttctgggctgacacataaattccttatattggttaataattaacaaaattataacataattgtagaaatatctacattatgaagtcaaattcaacgaaaaaactcaattttttccaccacacttttataaacttgaaaaagattaattgggttaaaatcccttagttttgttttcccgaacaaaaagcaaaaaccccagtatctctactagggtttaaattaatgccctgatggtgccctactctcacatggggaatccccacactaccatcgacgttacagcttttcacttctgagttcggtatggagtcaggtgggacaactgcactattgtcgtcgggaaaatcttttgatgattctctctatcttcttttttctgttctttaagggcaaatgtaatttgcccctacatctttctgttctttaagggcaaatgtaatttgcccctacatctttctgttctttaagggcaaatgtaatttgcccctacatctttctgttctttaagggcaaatgtaatttgcccctacactattctaatttcgaaacaagctgttctgagtctctttgttttattttgtttagttagtttgttgcttttattcagctctctaactctctcacgtctacttcaaaaacgcttgaggttgtatagttaagcctctcgggcaattagtatctgttagctcaacggctcacaccgcttacacaccagacctatctacgtcgtagtcttcaacaacccttactagcttatagctagggagaactcatcttaaggcgagtttcgtgcttagatgctttcagcacttatctcttccgcatttagctacccagcaatgcctctggcgagacaactggtacaccagtgatgcgtccactccggtcctctcgtactaggagcagcccctctcaattctccaacgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgacttgtctgtctcgcagttaagcttgcttataccattgcactaacctcacgatgtccgaccgtgattagcaaaccttcgtgctcctccgttacgctttgggaggagaccgccccagtcaaactacccaccagacactgtccgagaccacgtttcgtaatcttcgttagaacatcaaacgttaaagggtggtatttcaaggtcgactccacaagcactggcgtgcctgcttcttagtctcccacctatcctacacatcaaaattcaatgttcagtgtcaagctatagtaaaggttcacggggtctttccgtctagccgcgggtacaccgcatcttcacggcgatttcaatttcactgagtctcgggtggagacagcctggccatcattatgccattcgtgcaggtcggaacttacccgacaaggaatttcgctaccttaggaccgttatagttacggccgccgtttactggggcttcgatcaggagcttctctttcgataacaccatcaattaaccttccagcaccgggcaggcatcacaccctatacgtccactttcgtgtttgcagagtgctgtgtttttaataaacagttgcagccagctggtatcttcgactggttcagccttcggaggtatactcctacaacctacgccagcgcaccttctcccgaagttacggtgctattttgcctagttccttcacccgagttctctcaagcgcctgagtattctctacctgaccacctgtgtcggttttcagtacggtttagtaaagcctttcgcttagtggcttttcctggaagcgtggtatcagttacttcatttccgtagaaactcgtcatcatctctcagtgttatggaagtccggatttgcctaaactccccacctaccaacttaaacagacatccaacagtctgctaacctaaccttctccgtccccacatcgcagctttaccaagtacgggaatattaacccgtttcccatcgactacgcttttcagcctcgccttaggggccgactcaccctgccccgattaacgttggacaggaacccttggtcttctggcgaacgagtttttcactcgttttatcgttacttatgtcagcattcgcacttgtgatatctccagcatacttctcaatacaccttcatcgacttacacaacgctcccctacccaacaggcgtatcacaaatattcctctgatttctatccgcactttatgccaactcaacgtgttgggtgcttgaccaacatctcattccgtttcacttcattcgatgttgttaatcgaaggcgtatttgtgatacgcctgatgccgcagcttcggtgctatattttagccccgttacatcttccgtgcaggccgactcgactagtgagctattacgctttctttaaatggtggctgcttctaagccaacatcctagctgtctaagccttcccacttcgtttcccacttaatatagactttgggaccttagctggcggtctgggttgtttccctctccacgatggacgttagcacccaccgtgtgtctcctatgcattactcttcggtattcgcagtttgcatcgggttggtaatccgggatggacccctagccgaaacagtgctctacccccgaaggtattcacataaggctctacctaaatagatttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccttgcaactatccgcccagttaagactcggtttcccttcggctcccttattcagttaacctcgctacaaaatataagtcgctgacccattatacaaaaggtacgcagtcaccctttcgggctcccactgcttgtacgtacacggtttcaggttctatttcactcccctcactggggttcttttcgcctttccttcacagtactggttcactatcggtcaatcaggagtatttagccttggaggatggtccccccatcttcaaacaggatttctcgtgtcccgccctacttgttgcaagtttagtaccacaacataaacttaaaatacggggctatcaccctgtgtcgcttggcttcccagccaattcttctgtctttgctgctatcacttgctggctctttcgctttcgctcgccgctactgacaaaatctcggttgatttcttttcctcggggtacttagatgtttcagttctcccggtttgcctcaacagactatgtattcatctattgatagtagattcttcatctactgggtttccccattcggatatcttggattaaacgcttcttatcaactcatccaagcttttcgcagattagcacgtccttcttcgcctctgattgcctaggcatccaccgtgtacgcttagtcacttaactatacaacctcaaacatttttatctaaaagaaaaaacatttaagactgatattaactactaaacacttaactgcttttgttcagttaagattttttactactcagactttcttgtttcagggcaaatatgatttgcccctacagaaaatctctcagttttcagcttgtttccaattttttaaagaacaatcgataatcacctttcggctaatcatcatatttaaataaacaactcactgttcgcttaaatatgatgattggtggagataagcgggatcgaaccgctgacctcctgcgtgcaaggcaggcgctctcccagctgagctatatccccaatgtcatcacatcgctttcttcgtttcactcactattcagtatagatttctcttcaccgtttagagtggtgggtctgagtggacttgaaccaccgacctcacccttatcaggggtgcgctctaaccacctgagctacagacccaaaaggatgtcttcgttctctttcttgtctacaattaccaaacaatctgtgtgaacacttgcaaatctcttcattcaggtaaggaggtgatccaaccgcaggttcccctacggttaccttgttacgacttcaccccagtcatgaatcataccgtggtaaacgcccccctttcagttaagctatctacttctggtacaacccactcccatggtgtgacgggcggtgtgtacaaggcccgggaacgtattcaccgcgacattctgattcgcgattactagcgattccgacttcatggagtcgagttgcagactccaatccggacttagatgcactttctgagattcactccacctcgcggcttcgtcaccctctgtatgcaccattgtagcacgtgtgtagccctactcgtaagggccatgatgacttgacgtcatccccaccttcctccagtttatcactggcagtctcctttgagttcccgaccaaatcgctggcaacaaaggataagggttgcgctcgttgcgggacttaacccaacatttcacaacacgagctgacgacagccatgcagcacctgtctctaagttcccgaaggcacaaactcatctctgagttcttcttaggatgtcaagagtaggtaaggttcttcgcgttgcatcgaattaaaccacatgctccaccgcttgtgcgggcccccgtcaattcatttgagttttaaccttgcggccgtactccccaggcggtcgatttatcacgttagctacgggcaccaaacataaagcccaatccccaaatcgacagcgtttacagcgtggactaccagggtatctaatcctgtttgctccccacgctttcgcacatgagcgtcagtattttcccaaggggctgccttcgccttcggtattcctccacatctctacgcatttcaccgctacacgtggaattctacccctccctaaaatactctagccacccagtatgaaatgcaattcccaagttaagctcggggctttcacatctcacttaagtcaccgcctgcgtgccctttacgcccagtcattccgattaacgctcgcaccctccgtattaccgcggctgctggcacggagttagccggtgcttcttctgtgactaacgtcaatgtaatgctctattaaaacatcacccttcctcatcaccgaaagaactttacaacccgaaggccttcttcattcacgcggcatggctgcatcagggttccccccattgtgcaatattccccactgctgcctcccgtaggagtctggaccgtgtctcagttccagtgtggctggtcatcctctcagaccagctagagatcgtcggcttggtaggcctttaccccaccaactacctaatcccacttgggctcatcttatggcaggtggcccgaaagtcccaccctctagtccttagacattacgcggtattagcgacagtttcccgtcgttatccccctccataagccagatccccaagcattactcacccgtccgccactcgtcagcaaagaaagcaagcttccttcctgctaccgttcgacttgcatgtgttaagcctgccgccagcgttcaatctgagccatgatcaaactcttcaatttaaaaagtttaatcgctcaatatgtactgactataaaaaaatcacgactgaatttattcaatcattatgaatttcaagttaagcacctatcaagacttcaaaattaaaaaaatatttttaaacaaagtcaatcaacaagtgcccacacagattgtctgataagttgttaaagagcaaaataaagtggtcggcgagataggatttgaacctacgacccactggtcccaaaccagttgcgctaccaagctgcgctactcgccgtctgatatgccactgcatatatttaatggggtggctaatgggactcgaacccacgacaactggaatcacaatccagggctctaccaactgagctatagccaccatttctagtcgatattgcattacctctggcgcgctcgacaggatttgaacctgcgacctttggctccggaggccaacgctctatccaactgagctacgaacgcgttgttttcagtactgcgtcgcaacggaggcgtatattagtgatttcactctcgcttgtctagcacttttttaaaaaattttcttgtatgctcttaatttattcaaaatgtctagagcgtgttgatcttttaagtacaaaaaaacaaacgacatagaaatttggtataatttagttcgccaaaacctaaccattccatacaaactaagcggtcaaaatccgcaagcgattggcaaaagtgtggcgggtaatagcacaaaaattcatttagcggtagatagttgtggaaatcctattgattttgttctgacgggggtgaagttcacgacagtaaagctgcgcctgagcttgtggaattgttacctgacagtgagaccattgttgcagacagaggttatgattgtgaagccttacgagcacttattttgacgacaacaaaagcagttccggttatacctcgtagacgaaattcaaaggtgggtaatgaggatatagactggtgtttatatcgttatcgccatttagttgaaaatgcgtttgcttttttaaaacaataccgagccattgcgactcggtacgataagttagcaagaaattatgcggcatcgctagcaatgatttgttgtattcgctgggggaaattgttgtttggttaagatttaaactcaaaagatcaacagcccctaaggctttaattgtattggtttcatcgcctacgtcttttatacgtttcagcacgtcaaatagaggagcggtacaacaagaaaataaatcggctaaggcttcatagcttaatgaacggttattattcacttcaagtagcatttgctcaaaagcggtgcaagctcctttcattcgttcaagtgcaacaaaatcatcttcactaattaaaaaatgatggtcatattgaaaataagtatttaaaaaagcattggtttctacaataaaacgttgttggtttatcgctggccgtagctcgtttacggctgatttattcattttgcgtaattcgcccaaggcttctaagcaacgtttgataattggtgtccagcagtctgttgttttatctataaagctaatggcggtttcaatggaaagccaaaaatcaagcgtttcattccgtgctttattttgaataatcaaataatcttgttcagcctgaaagcctaatttagttaaatgttgttggctttctttggtggttggatgccagctaaaagcaacgtgtgcaagctcttttaatgaaataaaagattgttggcgattattgataagttttgtttgaagagaaaaggggaactgttgagcgttcataatgaactcctttgtgtatttacgaaattttaccctataaaatagggtgccaaggggttcgtaagccacacaaagacggctggagttatttccctttcgggtgttgtattcctcgccccctcggtattgagtttaaataaattgtgccttttgccccaaaattgcaaattttaggtacaaaaaaccgcttgatctatcgggtgcggttatccgctttgtgtaaggttacgacaccttgagaacagtcatacgcgttttaagataaatagcaagtgtttaattaaaaaattgaatgttcaactttaaaatcattgttgtttactcataactatttgatttttataaaatagaatttctttcattaagttgaaccattcaaatcttttcttgcaagcggtcaaatttcccctaaattttaccaatccccacaaaaacgcccttttaagccctttttctgtttaagccgaacaagtgtagctcttttgtcttttagtgtgtttataaacgctcgtaaacgccttaaatttgattcttgcttgttgtatttggcattagttatgtattgcagtataagtgttttattaaagtagtttaaaagagcagttttataaatcagtttaaagtttgcggtattggttgaatgattaaaacagagcgatatatgaacaatgctgaagttgcttacaataatttaatcgaaactttagacagttgtattgaacaagcttacgaaaaggcacaaggtgataaagcaaagtttaggtttcattttttagaattatttgggaaatttaatggaggtttaaatttgtatattcctaaatttgataaccttacaaaagaagcgggcaaaatcccacagtttgggcgtttagcttttcgcactcgttcaaccgttcgagaattacacggcgactctaaccgcttaacgcctgaagatgtaacaagtttaagcgtagaattaaaagaacacgatattgaataccctattgattatcgtgaagataatgatgccagctatcctttgaaaaaatacgctctttctgttgttcaagatgtcattgcgttagggcgtgaagtggctgttgctgaaattgcacaaaatgcagagaattattcagctgaaaatgttgttacactgactgaaacacaacgtttcacaaatgcaaaatctgaccctttaaaatttatcaatgatggtttagaagctgtttctgctactattgggcgtttgcctaatgtttgtgtaattgcttcagatgtttggaaaattttaaaagaaaatacaaaccttttagaacgtatcaaatacactcgcacaggcattttaacccctgaaatttttgctgaattgattggcgttgaaacggtaaaaatcggtgcagcttctcaagaaaaagatggcaatttagaaaaaatctggtcaaatagcattgttttggcttatgttgcaaacggtaaagataaaggcaaaaaaggcaatatttttgaaccgtcttacggttacacggtaagacgtaaagacggcttatttgttgatacttaccaagagaaaggcggtaaagtggaaattattcgttgcacggatattaacgcccctttccttgttggaaaatcagcaggttatttaattcaaggttgtattaagtaaataggttttacctttcaatcagattgtttgcttgcaccgtcaaaaaacggttttctgattgattgaaaacgttactaaagacgtaaaaaagactaaaagggctttagctagtggaatagttaaagcccttttctctaaaaaatgaaattttattgctgtatgtgaaaaaagcgaaattgttatttatcttgctttttttgttgtagttatgtcgctttgttttaataaaattcgatgactttttgtttgaaagattgggtgtatttagtcataaaaatctgcaccttaattagttggttgtttagcccaacttttggggtgcagatcatctacgtcagcccctaattcaatttaatcttgcaagttatgataatgcgctactgctcttgctttgcgaacgtaagggctagttgtagaataccaaagcctcatattaattaaaccaaacacaaaaagcccactatttccatagcaggcttttttatcactaaaaattagtcaccaacagcaatgcgtttcatatctgtcatataaccacgcaattcttgaccgattaactcaaccgggtggttgcggatggcatcgttaatatcacgcaaatatacattgtcgatttcaacggttggtgttggttcgcctaaatcgcctttttgtaacattgggattaatttctctgcaagaattggcgttgcaacgtgtgagaataagtagttaccgtattccgcagtgtctgaaataaccacgttcatttcgtataaacgtttacgcgcgatagtgtttgcgattaacggaagctcgtgtaatgactcatagtatgcagactcttcatagataccgcttgcaaccattgcatcgaatgccatttcaacaccggctttcaccattgcaaccatcactacgccgttatcgaagtattcttgttcagaaattttgataccgtctgcttttggtgaattttcgaaagctgttttgcctgtttcttcacgccatttgaataagtttgcatcgccgtttgcccagtctgccatcattgttgatgagaactcaccgctgatgatgtcgtccatatgttttaagtaaagatcgtttaattggagtttaatttcttccgctaattcaaaggcacggatttttgctgagttagaaagacgatccatcattaatgtgataccgccttgttttaacgcttcggtaatggtttcccagccgtattgaattaatttgcttgcatatgccggatctttaccgtccgccactaatttgtcgtagcacacgatagaacctgcttgtaacataccacaaaggatggtttgctcacccattaagtcagattttacttctgctacgaacgaagactctaacacgcccgcacggtcgccacctgtcgcacttgcccacgcttttgcaatcgccataccttcgcctttcgggtcattttcagggtgaactgcgattaatgtaggtacaccgaaaccacgtttatattcttcacgcacttctgtacctgggcattttggtgctgtcatcaccacagtgatgtctttacgaatttgctcgccttgttcaacaatgttgaaaccgtgtgaataaccgaatgctgcgccttgtttcattaatggcatcacatctgcaaccacttttgagtgttgtttatccggggttaagttaatcactaaatctgcagttgggattaactcttggtatgtgccaactttaaaaccattttctgttgcacgtgtaaatgaagcacgtttttctgcaatcgcttctgcacgtaatgcgtaagcaatatctaaaccagaatcacgcatatttaaaccttggtttaaaccttgcgcaccacaacctacgatcacgatttttttgccttttaagaagttgcaaccgtcagcaaattcgctacgatccataaaacgacaacgacctaattggtcaagtttttcacgtaagtttaatgtgttgaaatagttagccataataaaaatcctgtgttgttaatgttgaatgtttgatgttgtgtttacatactgtagttgtttttgcgagtttgattatagctgtttttgttattgcgtaaattgacattattagaatttatcattgcactaaataaaatcacaagcggtcagaaccctattattttttgcaaatttttgcggagtaagagccttaacactcaagttatctttgctataattccccaaatttacctaaaattgaaggaattcttatgtcccaacttatcgaactcactcataaactcaaagaaatcttccaaatcaaccgtgcagatttggattttgggatttatcggattttaaacacccgtagccaagagattgaaaagtatctttcacaaaccttgccacaaaaagtgaagcaggcgttgggcgataaccaaagtgagcaaatcgcaggttggcaggcggaactggagcaagccaaaaaacaagcccaagagctaggcattgacccaaaccaatcgccaaaagtccaagaactgcaaagcaaaattgaacaagccaaaaaaggcagtgctgatcacgagacggcggtttatcgccatcttttaacctttttcagtcgctattacgaagagggcgattttatcagccaacgccgttataaaggcgatacttatgccgtgccttattcaggcgaagaagtgttgctacattgggcgaataaagatcagtactacaccaaatcgggcgagaatttcagcaattatcgttttagccttaatgatggtcgcaccgtctttttccgtttaaacagtgccgatattgccaaagataaccgcaaagataacgatgcgaagcgtttgtttacccttgccaccgcacaaaccattgaacgtgaaaacgaagatggcgagttggaaatgattgacatcaacccaatcacacaaagcgaagacggcaaaaccttagccattttgtttgattacaaaccgtttgaaaagtcggcaaaacaagagaaaatcttggagcaagatttagccacgttgcaggctcacgatttgctacaaaccaagtggattgccttagccgagcgttgcccaaccgaaaaaaatcctaaccgcactttattggaaaaacacctaagcgactacacgcaaaaaaacagtgccgactattttatccataaagatttaggcggttttttacgccgtgaattggatttttatattaaaaacgaagtgatgaatttggacgatgtgcaaaatattagccatttcgcaccgcttgaagctaatttacgcctaattcaaaccttacgcagcattgctgtagagcttattgcctttttggcacagttggaaaatttccagaaaaaactgtggctgaaaaagaaatttgtggcagggcatcactatttaattacccttaaccatattttgccgctcgaacaagcgggcagatttattgaagaaattgccaataacgtcaaacaacttgcccaatggcaaagcctatttaacctgccgtctgcggatgctcaagcatttttaaatgctcaaaaagcaaacaatgcggggggggtaaaacgcctttaaattcaaatggttacgatgatttacaacatcttgttgtagatacatcactcttttctgccacattccaatccgcactgatttccgaactttcacgctcactgggcgactttgatagccatatcaacggcacgcttattcattcggataatttccaagccttaaatttattacaagcccgttatcgtgaacaggtgaaatgtatttatattgatccgccatataatactggcgaagatggttttatttataaagataattttcaaagttctagctggctaacgcttatggaaaatcgtgttatgttagcaagaagtttgcttgcaaaacaagctgcattattttgtcaaattagtgatactgaaaacacaaacttaaacaaattgatggtttcagtttttggtaaagaaaatcacagagaaactatttccgttattacatcaagtaaaagtggagtaaatgctattaatgtaaaacgtggagaacgtttatttaaaatcaaagaatatttacatttttattcaaatcatccgagttttaggtttaactccttctatacagctgatgattataatgtaaattataaatgggaaatatatcaacaagatgatggttcatggtttgtttgtgatttaaaagctactagaaaatttgatgaaaaatcactctctgaatatgcattgaaaaatccaaaaaatatttattctattgaaaaaaacaatagtaaagcaggcgaagctatgaaatttattttggagaaaagtaaggcaagtggaacagtagaaacttttactgatcagtttggtgtaactaaactgatttatcaaggtggtgtatgtgttcctttagaagaacgtgtaattcaagagaatggaaaaaatgtatttggagtattaggttctgatatttgggatgatattgggcaggccgcaaaatcagaaggtggagtttcatttgataatggtaaaaaaccagaaaaactcttaaagcgagttattgaaatggcaacgcaagaaaatgatttagtcttagactatttttcaggtagtgggacaacagcttgtgtatcacaaaagctaaacagaaagtggattgcgattgaacaaggtgaatattttgaaagtgtattaaaagtacgtattcaaaaaactttatttggcgaacaaactggaatatcaaaatcaatagactataaaggtggtggaattgttaaagtactgaaactggaaagttatgaagatacgctgaataaccttgaacttcgccgcagtggcttgtttgacaatctttcagacgatgtacaacaagactatttgctccactatatgctcaacattgaaagtcgtggcagtttgcttaatgtgtcgcattttgagaaaccctttgattatggcttgaacattagcaccaccagcgccggtgcttatgaatggcaaaaagtggatttggtggaaacctttaactatctgattggggcaaggttagtcagtattgacgatcagcgagttaaaagaggttatgtagcgatagattgtcaattacccaatcaaagcggggatgacaaaacattaattatttggcgtgattgtgaacaatggcattatgaaaatttgtatgcagaaaaagaattcagccacaattttcaagatagcaaaacgacgctatttggtaagatgaattttaatcctaaaaataccgactatgcacaagtctatatcaatggcgaccatacccttgaaaccgtgtgggacggcgagcaaagtggtagcttgaagattatcagcattgaagatgcgtttttatccttgatgtttgagggggatgcataatggcaaaagcaccccaaaataccaaattccattttgatgagcatttaattttaaatcgttggctgttttcgttatttcacaaaacatcgttaaatgagtttaaaagcctgttggaaagcgtagaaaatgacgaccatatcgccagcgatggacagagccatttttatcatcgcctaagcaatgagctgttttttgaacacgataatccgctaagccttgcggagcttgctgcttatgatttgcggttggtgcattattggcaaaaaattacggaaaagcgtaatcgcacaagcggtcatattttgcgaccaaaatacttccagtatctatcgttactgtttaccgaaatttatttggattggtatttcaacaaaaaagccgaattacagaccgcacttaatcagcagttagtgcaatacgccaaagagatgggcaaaaatgcacaagattttgaagtgtatcgcttaaatgatttaaacaaaatcgcgttttggaatgctacaggttcgggtaaaaccttgctgatgcatgtcaatattttgcagtatttgcattatttcggcaaaaaccaaccgcttgtacgccccgataaagtgattgtgcttaccccaaacgaaggtttaagccgtcagcataaagaagagcttgaattgtcaggctttcaagccagtttttttgataaaaatgttatctcgcagacggcatttaattttagccaagatgaggtgggtattggcttgggcgttgaaatcattgatgtcaataaacttgccgaaaaatcaggcgacaaaaccgtgtcggtagatgcctttgaaggcaataatttggtgttggtggacgaagggcatcgtggcacatcgggcgaacagtggctgttacgccgtgaagccttagtcaaaggcggttttgcctttgaatattcggcaacgcttgggcaagcggtggcaggcggcaaaaccattgctaaacaagtggaagacaagcaaaaagcgaaagccaagttattgtttaataaaggttcgttaaaaggtttatcagaagacgacttagccaaattaacccttgatgagctggaaatggcaaaggttcgcaccactgcagtgcttgaaacttatgctaaatcggtgttgtttgattattcctataagcatttttatcacgatggctatggtaaagagagcctgattttaaatattgaaaaacaaggttttgatgagcatttgcctgtttattttgtggcaggtttgttgtcgttttatcaacaactttatttgtttgaacaacacaaatcgacattggcggaatggaatattgaaaagccattgatggtgtttgtggggcatcgtgttaaagaaagtaataaagaaacagaagaacaaaaagtagaaaaatctgatattttaactgttattcgacagctggctttctttgtgaatcaatctcaacaggtaaaaaagtggttgaaagaactcatactagataatcctcaaatattgggtaagaataatgaacaccttttcaaagggcgttttgtgccattactctcttttgtcgatgacgtggatgctttgtatcaagatatgttgcgtaagatttttggggcgacacattcaagccgtctgcgtttaacccatttgaaaaaaagcgatggcgaactggcattatcccttggcgaacaaggcgagaaatttggtgttatcaatatcggcgatgcttctggtttactgaaaaccgcacaagaaaattttgccgatgagtttgaggcggtgagcgatgagtttaatggcggtttatttgctgaaattaatcataaaacatctcccgtaaatatcttaatcggttcgcgtaagtttaccgaaggttggtcaagctggcgtgtttctacgatgggcttgctcaatatgggcaaaggcgaaggtagccagattattcagttatttgggcgtggcgtgcgattaaaagggcgtgaatggtcgctcaaacgttcattgccaagcgttcgcccgaaaggtgtctttttagaaaaactggaaacgctcaatatttttggtatcaatgccgattatatggaagtgttccgtggctatttggacgatgaagatatccaaaccggcgatgaaatgctgacgttggatttccctgtacaaaaacgcttgcctgccatcaaactgaaaaccttaaaactcaaagaagaagtcaaaggcaatcgtaagcagtcgtttaagcgagtagaaaagcagatttatctgtttgaaattcctgaaaaatggcagaacaaaattaaagggattgaaattagcctagatcgctatccaaaagtgcaaagttttgccaccaaaggcacggcaatcactcaagtgcaaggcgaacagcgtgatgaagtgaagttaaattcggcactgtttgatttttttgattgggataagatttatctgcaagtggcacgtttcaaacatcagcaatcttggtataacttgcgattagataaaacgaagttacgccaatttgccgagcaaagccattggtatcgtttgtatatgccaaaagcggcgttaaagatggatagttttgcccaagtggcgttgcagcaagagattttgatcgatttattgctggaatatgtgaaagccttttataaccgcttaaaagctgcctacgaagggcagttttatgaagtggttacggtggatgacagcaatggctctatgttggataaataccaatttagtttgcctgataatgacgaaggtaatgaaatcaaacaacgattagaagccttagcagacggcattagtgagtttagcaatggggtaaaacctgtttatggtggcgacaaaggtttgcaaatgctctgttttgatggacatttgtatgcacccatttttgcttgcttagaacgccaagatttgccgtttagtattcaaccgcttgccattggcgatgaaagtgaactgcgtttaatcagtgatttagtcaatgccaaagcaagcggcaagttgagcgagtggacacaaggcaaagatttgtatctattacgcaatgctgccaataagtccaaaggcttgggttttgctttggcgggcaatttctatcccgactttttgctgtggcttgtggacaatcaaacaggtaaacaatggcttagcttgattgatccgaaaggcattcgcaatatggatttagacaatgccaaatttgggttatacgatgagttacaaaaattagctcatgaattgaagattgagaccccgattttatctgcctttattttgtccattaccaaacaggcagatttgctcaatgtggggcatttaacaacacaagatttcgccgagaaacatattttatttatggacggcaatcaggtttatctcaaacagatgtttaagatgatgttgcaatagtggtgtagatgcttgaaatggtaaagtgggaataacgtacacaagaaaagtggattttgtgtgcatatcggaataacatacacaagaaatcccattttcttgtgtatgttgtgtgaatgtgcacattattcctaatttttatgttgatgagaacgaagtatgaattacgtcattcctgatttattcgcgttgggagatttggaaagcaaatctgtttttaaagcctgtacccacgcacatcgtgcattgggggagttaaaaggtgtcgtgcatacgatgccaaatcccaatattttgcttggtactttgcctttgcaagaagcaaaagaaagttcagaaattgagaatattgtaaccacacaagatgacttatatcagagtaattacgccacacagcaatttgcttctggggcagctaaagaagttcattattatgttcaggcaatgagtttaggatttcatgaagtacaaaagagtggtttgataaccctaaatttaattaaagagatacagcgtgagttggaagataataacgcaggcttccgcaaacaagcaggaactggtttagtgaatcaaaccacgcaagaagtggtgtatatgtcacctcaaacctatgatgaaatcgaaaatctgatggctggtttagaaaggtttatcaacgattctgaacaaatggattatgaccctttggttaaaatggcattaattcatcatcaatttgaaagtattcatcctttttacgatggaaatggtcgtacagggagaattatcaatattttgtatttgattcagcaaggattgttagatacgcctgttttgtatttatcacgatacattaatcgcaacaaaggtgaatattatcaattgttacaagcagtacgagaaacccaacaatgggaaccttggctgatttttatgcttaatggtattgctgaaacggctattcaatcggttaaattgattaatgaaatcaaagctctaatgatgaagcaaaaacagatgattcgtgaaaatttacctaaagtgtatagtcatgaattattaaataatttattcaaatatccctatacaaaaattgactttgtaatggaagattgtcaaatccatcgtaatacagccgttaagcgtcttgacgaattggttgctttaggtgttttagcgaaaaccaaaataggaaaagaaaatttttatattaatgttgaattgtttcatttgttgatgcagtaggtaattggaaaatttgtatgaatatcacagcgtatcaagcgaagtattttgccaatgaaattttgtgtcgttccgaaaatggagtggctcgtatttcagacggtttatttaatgctaaagtagatcttaatccccatcagattgatgcagcgttatttgcactgaaaaatccgcttgggcgtggcgtattgcttgccgatgaagtgggtttgggcaaaacggtggaagctggtttggtgctttgccaattatgggcggaacgaaaacgccgtttgttggtaatctgccctgcggtgttgcggaaacagtgggcaaatgaattggctgaaaagtttggtttaccttgtgtgattttggataaatcgctattaaaacaagaatatcaaggcagcttgccaagttttttgcaagccaacatgggcaagagagtcataattatttcttaccaatatgcaaccaaattcgcgaattttttggccggagaactgtttgattgcgtcgtgatggatgaggcgcataaactgcgtaatgcccatcgtaccagtaataaaatggggcaaacattacgctcggcatttgatgggcgtaaaaagttactactcactgcaacaccattgcaaaatagtttgatggaactttatggtttatctaccttgcttgacgaatatttatttggtgatgaaaaggtgtttcgccgtgagtttgtcaatgagcacaatatggcggaattaaaaagccgtctgcaaactgtggtaaagcgaacgttacgcaaagatgtgttggaatatatccgctataccaaacgccatacgcttacccaaaatttctatccaagcgatgaagaacaggctttatatcaagctgtatcggattttatcagcaaagaacatagcttggcgttaccgaagcgacaacgtcatttgattggcttgattttgcgtaaattattggcttccagcccttatgccgtggcggatacgcttagcattatcttaaaacgcctttatacactcaaagaacaacaggctaaacaagaatatttattacttgatttgagagagagtgaagcagacttagccgatgagttggatgaagagtgggaagatgatgagtcaaatgatgatgaaggattaacatcggatgatcgtcaaacactagatgatgaaatcgctcaaattgaaggttttatcgcacaaaccaaacaattacgccacgatagtaaagcaagttcacttttaaccgcactacaaaccggttttgccaaaatggcggaacttggtgcagctcaaaaagcgattatttttacagaaagtgtgcgaacgcaagcctatttatatgactttttgattgccaatggctatgccaatcaagtggtgagtttttcaggtgctaatcatcacactgatgccaaacgcgtttatgaacagtggcttgctgatgaaaataatgccggtcgaataacaggttctccacaagtggatatgcgtacggcgttgattgatcactttaagaacaatgcacagattatgattgccactgaagcagcagccgaaggggtaaacttgcaattctgttccttgcttatcaattacgatttgccttggaacccgcaacgagtggaacaacgcattggtcgttgccatcgttatgggcaaaaatttgatgtggtggtgattaactttttgaaccaacgcaatgaagccgatcaacgagttttagaactgttaagcgaaaaatttaagttatttgatggcgtattcggtgcatctgatgaaattctagggcgtattgaaacaggtttggattttgaaaaacgtattgctcatatttacgatagttgccgcagtgcggaagaaatcaagcaagcctttgatgacttacaaaaagaaatggaaacacaaatccaagaggcaatgcagacggcaagttcggctttgttagaccattttgatgaagatgtgcacgaacgcttgaagttacagctttcccaaagccaacaattattggataaaaccagccgctatttttggtatgcaagccaatttgcattacaagattatgcgaaatttgacgaagcccaaaaatccttttacttgcaacaatcgcctattgaaacagctcaaacgggacgctatcaattgcaacaacgagaggggcagacaggatacgattatcgcttaaaccatcctttaggcgaatggtgtttagagtattgtcagcaagttcaaaccgatgtggcttgtgtgcagtttgattatagccggcacccaacgaaattatctgtgttagcggaacaccaacggcaatcaggttggctatgggtggataagctcggtttttatggagaaaaccaaacacaggaacagcttgtttttaccgccagaaccgatacaggtgaatggttagatgaggatttttgccgaaaattgtttagcgtatcggctcaggtaaacgcagataatgttgctttacccgatgacttacaaagcaatgccaatcaagctattcagggcataagtgcaaaacaggctgaaacacaaatggcgttattaaaacaagaaagcgaacgtttggataaatgggcagaagataaaatcaaggctgctcaggaagccattgtggaagtgagtgaaaaaatcaaacaagtcaaacgtgagaaaaaccaagcagcaaatttagaacaacttgcaaattttgaaacacaattgaaagatttagagaaaaaacgccgacaattaagggcaaatatttttgatgtggaagaggaaattgaggaagagcgagataggttatttgctcgtatccgagataaattagaacaacagcgtaaggttgaacatttgtttgcggtaaggtgggtaattacttgattactacaagcggtcagaaccctattattttttgcaaatttttgtgagaatctcaccgcttgctttgctgattggaaatgaatccgttataatcttgccaatttttcacccttatttaatagaaggaaaccaaaatgggcttagaaaacgtacctgctggtaaagagttaccagatgatatttatgttgtaattgaaattcctgcaaattcagatccaatcaaatatgaagtggataaagaaagtggtgcaattttcgtggatcgttttatggcaacagcaatgttctatcctgcgaactacggttatgtaaaccataccctttcttctgatggcgatcctgtggacgtattagttccaacgccatacccgcttcaaccaggttcagtgattcgttgccgtccagttggcgtgttaaaaatgactgacgaagcaggtggcgatgcgaaagtagttgcagttccacacagcaaattaaccaaagagtacgatcacattaaagatgtaggcgacttaccagcattattaaaagcacaaatccaacacttcttcgaaagctacaaagcattagaagcaggcaaatgggtgaaagttgaaggttggggcgatgtgaatgaagctcgtcaagagatcttagagtctttcgaacgtgcgaaaaaataattaaactattaaccgaatataatgccaaagtaaacgctttggcattttttatgataggaattaagtatgaaatttttcaagaatcttagcgttatagcaatttgttcactacttttaaccgcttgtgttagcacagcccaaattaatcaagaagcagaaagtaattatgctaaagtgaagcaggaagcaagagcaaaaagtatgttagatactagctcaacgacagctcatcgcattcattcggttttcaataagatgaagctttatgcggaacgagcaaataaaacaggtgtgccgtttcaatgggaaatcattgtgctgaaattaagtgaattgaatgcttgggcgatgcctggtggaaaaatggcattctacacagggctggtggataagttgaatttatctgatgacgagattgcggttgtgatgggacatgaaatggctcacgctttgcaagaacacggcaaatcagatcgtactgttagcacagtgacaggtattgttggtgtacttgctgatgttgcagtgaccgcaacaacaggcgtgaatacagaaggcttgctcagtacaggggtggatttagttgccaataaacccttctctcgtagtcaagaaacagaagccgatgaagtcggtttgatgttaatggcagagtcaggttataacccagaagcagcaccaaatgtgtgggtgaaaatgagccaagcgaatggtagttcaggtttgtctattttttctactcacccgtcaaacgaagatcgccaagcgaatttagcacgtttagtgcctaaggctaaggaaatttataatcggaaaaaataatacctaaataacctgaaaaattctatgagccctactataaatagcggggaactcacaaaataatattctatttatggaaaacagaatatattttttcccctaattattaggattcactatttagtaaaggttaccgaggtctgctcaggcaaatgtaaatctaactgattatacggaatagaaatcccagccttatcaaagccaatttttactttttccaaaatcgcaaattgtgtagttgaatagttattcgtctgtacccacggacgcacaaataactgcacactgcttgccgctaagttaccgactgcaatggtaggctctggatagtgtaaaacattttcatcttcaaacagaatttgagcaataatctctttagctttctcaatatcggactcatagctaatatcgaaaatgaagtcgatgcgacgagtttcattgcgggagtagttggtgatactgtcggcaaatactttaccgtttgggatcaacaccgttttattatcgaccgttcttagctctaacatcaaaatccccatttgctcaactttgcctgatttaccaccagcttcaataaaatcgcctttgttaaatggtttaaagattaatagcattaccccagcagcaaagttttgtaatgagttttgcaaggctaaaccaatggctaaaccagccgcacctatcaatgctactaacgaactcgtattaatgcctaattgtgaaagtgaggcaatcactgtaatcagcaaaaacagaaaataagcgatagatcgaacaaaaccttgtagcatttcatctttgcttgatgctaataccgctttgccgataagggtactgatagcccttgccaaataacgcccgataacaaaaatcgcaattgcaattaacaatttagtgccatagggaataatccaattttccaggagttgttgaagttcaagattttttacatcagtaataatctctttcgcttcagggggtaaagtgatttcaggtatgatttcttttgttttttctgtggtactcattatgttctcctatatcaatttcagcctattctaacacgagacagaatttgtgataaaatccaattcatttttcctttctttatatcaaaatgacaacagaaaaagtaattagtgccagcgttcaattttttacgatcagtgatgatgaagctgggcaacgtttggataactttttactcgccaagctcaaaggcgtgccaaaaagcctgatttaccgtattgtgcgtaaaggcgaagtgagagtaaacaaagggcggattaaacccgaatataagttgcaagcggacgatattgtgcgagttccgcctgtgcgtgtggcagaaaaaaatgaagcaccgatttcgaccaaactcaacaaagttgcagagcttgaacatcaaattctttatgaagatgaagtgatgttagtgattaacaaaccgtcaggcattgccgtccacggtggtagcggtttgagcttcggtgtgattgaagccttacgagcgttacgcccacaagcccgttttttagagctagttcaccgtatcgaccgagatacatcggggctgttgttagtagcgaaaaaacgttccgcattgcgtagtttgcacgaacagttgcgtgaaaaagtggtacagaaagattatctcgcgctcgtgcgtgggcagtggcaatcgcacgttaaagtgattaaagcaccactattgaaaaacgaattagccagtggtgaacgtattgtacgagtaaatgaagaaggcaaaccgtccgagacccgatttgtaattgaagaacgttatccgatagcgaccttagtcaaggcttcgcctgtgacaggtagaacgcaccaaattcgtgtacatactcaatacgcaggacacccaattgcccttgatgataaatacggcgaccgtgaatttgaccaaaaaatgcaacaagcgggtttaaaccgtttatttttacacgcccattctattcgatttgttcaccctaaaacgggcgaagaaatggtcgtgacagcaccgttggataaacaactaaaagccgtgttggcgaagttgagggtaaaataatctaatcaacctcactactacatccatagatagtgagggctattaaaaaatttatagtctaacccgtttttatttacctttttttcaaaaactccaccccagtatcagggaagtcagtaaatacacctgttgcaccagccttgttgagtagggcatcatacatttcatcaatgttggtgaagaactcaggtagtgcgtctttgcgtactgtgtacgggtgaagttccatcttatattgggctaactctttaactaatggagtgtaaacaatgttgcctacttttgatttctctttgtcgatcaacatataccaacctggtccaacaccgtctgcgtatttcgctacttctgccatcgcacctggtttaaacatccagtcgtagttgtaatttacccatttacctgatttgtctttttcttccgtttcgtgccagtcagtgtaagccactaattgtacaagttttacgtccataccaagttttggtaacaattcggttttgatacgttttaactcgttgaagtcaaaggtttgtagataaacaaggtctgatttttggtcataaccgtattttttcaacacttttaaagtttccagtgcaatatctttaccttctcggtggtgtaaccaaggggctttgatttcagggtagatgccgatttttttgccggtggatttttctaagccttggataaattcaatttcgtcttcaaaggtgtgaattttgaaatcagatttccacattgggaagcggtttggatagacttgaacttgtttaccatcttctactttgaagttttcggtcatttcaagggtttggatttcttttaacgtgaaatctgccacataatagcgtccatcttttctcgcacgatttgggaattttttcgcgacatcggttaaaccatcgaggaaatggtcgtgaataaccacgaggcgattatctttggtcattgcaagatcttgctctaaataatccgcttgttgtccaaaggcaagagctttactctctaaagtatgttctggtaaataaccacttgcaccgcggtgagctataattaatttatctgattgtgttgcgactagggttgatgttgagcaacctgctaatactgctgttgcgactaaacctaatgcaaattttgtgagtttcatactgttttcctctttttgtagatacaaaaaaggaagaccaaaatgtcttccttttaatcattaattatttaccatagctatcttctaatttcgctttatgtttgccttcttcaagcattgtgatgaacattaacaatactgctaatacgccacctgcgatcattacatagaagccaccgtcccagccgtagtactctgctgcccaaccaaccactgctgatgcagagtggagcaagatatgcggtaaacgaccgtgagtctgcgagagaatgtattgaagagaacaaaattctacgcaagatcgctcgccactgtattgatgaaacggaagggttgtttattactttgcctgaagatgatctcgactatcaaaaaacctttattcaagcctgtacggagtcaggcattgaagcggtggctatcgatccaaaacttgcgatgcaaatggagccttcggtaaatccagctcttgtcggtgcagtggttgtgcctgatggttccattgatccatttcgcctaacagcatcaaatatgttagatgccacagagaatggtgcgaaagtctttacctattgcgaagtgaaagggttaattcgtgaaggcggtaaagtgattggcgtgaacgtttacgaccataaaaacagagtggaacgtcaattctttgcccctgtggttgtgaatgctggcggtatttggggacaaggcattgctgaatatgccgatttgaaaatcagaatgttccccgccaaaggcgcattactggtgatgggacaccgtatcaacaaaatggtgatcaaccgttgccgtaagcctgccgatgcggatattctcgtgccaggcgacactatcagcgttattggaacaacatcaagccgtattccttacaatcaaatcgacaatatgatcgtcacccctgaagaagtcgatattctctttagagaaggcgaaaaacttgcaccaagtttaagacatacccgtgtattgcgtgcttacgctggggttcgcccgttagtggctaccgatgatgatccatcaggacgtaatgtcagccgtggtatcgtcttgctcgatcaccaagagcgtgatggcttagaaggctttattactattacaggcggtaagttaatgacctatcgcttaatggctgagtgggcaacggatctcgtttgcaaaaaattaaacaaaaccgaccgctgtgttactgcagaaaaagccttacctggttcaagtgaaagccgagcggaaaccaacagaaaagtcatttcactgccaagtaccattcgctattctgcagtttatcgtcacggctctcgagctactcgcctgttggataaagaacgtcttgaccgctctctggtttgtgagtgtgaagcggttaccgcaggggaagttagctatgcggtggacgagttaagtgtcaataatcttgtcgatctacgtcgccgtacccgcgttggtatgggaacctgccaagcagaactctgtgcctgccgtgccgctgggctgatgacccgttttgaagtggcaacaccacggcaatccaccactcaactggcttcttttatggaagaacgctggcgtgggattgagccgattgcgtggggcgatgccattcgagaagccgattttaccagttggatctattacagtttattaggtctaaatgatgtgcaaccgcttgcagagcaagctcaacaggggacagatagcaatgaattttgatgtagtcattatcggtggcggtcttgcaggcttaacctgtggggttgccctacaagaacagggtaaacgttgtgtgattatcaacaatggtcaagcagcgattgatttctcatcgggttcaatggatttactcagccgtttgccaagcggtgagtttgtcgctgatttttacaaatcctatgcaactttcgcaaaacagttgccacaacacccttacagcttacttggcaaagagaaagtccttgccaaagcgacacaatttgaacaactcgccacatcgctcaagctcgatttggtcggctctatcgcacaaaatcacctacgagtaacgcctttaggtggcttgcgtggggcgtggttatcgccaaacagtgtgccaacagtcaaaggtagcgaacctttcctctataaaacaattgcgatattggggatcgaaggctatcacgacttccaaccacaactgttagccgataacctaaaacagaacccacaatttacccactgcgaattaagcactggctatctcaatattccagagcttgaccaactgcgtaacaatgcccgtgagttccgtagtgtgaatatcgctcaagtgttagaacgcaaattggctttccgtgatcttgtggcagaaatcaaaacggcaaccaaaggggcagaagcgatcttcttaccagcttgttttggcttggacgatcaaagtttcttcaaccagttacaacaagcggtggaagcaacgatttttgaattaccaaccttaccgccatcattgctcggtattcgccaacataaacaacttcgccaccgttttgaacgcttgggcggtttgatgttaaacggcgacagagcattaaaagccgatattgaaaatggcaaagtacaacggatttatactcagcttcaccaagacaatgcgatcagtgcagaacattttgtactcgccacaggaagctatttcagcaacggcttaaaagcagactttgatcgcatttttgaaccagtgttccaagccgatattgttggttgcaaagatttcaatgaaaccgaccgcttgtcgtggacggctaatcgcttttcatcgccacaaccgtatcaatcggcaggggttgcgatcaacgaaaaatgccaagttcgcaaagatgggcaatttatggcgaatttatatgcaactggcaacgtcattggcggttttaatagccttgaattaggctgtggctcaggtgtggcagtggtaacggcacttgccgttgcagaagaaattgtgggggcataatatgaacaacattcaacgtttaatcgaacaagctcaacaaaatacccattctgccgttgttcatcacggttttgatgagtcctttgaaagttgcattaaatgtaccgcttgtacggcggtttgccctgtttcgcgtaataacccgatgtatccaggtccgaaacaatcaggcccagatggtgagcgtttacgcttaaaaagccctgaactttatgatgaagcactcaaatactgcaccaactgcaaacgttgcgaagtagcttgtccgtctgatgtcaaaattggtgacattattgtgcgagcgagaaaccgtcatttagatcgccaaaacaaaccgctaatgcacaaactgcgtgatgctattttgagcaacaccgacattatgggcaaaatgaacaccccattagccccgattgtcaataccatcacaggtctaaaagcaaccaaattcttgcttgaaaaaaccatcaaagtgagccgtcatcgctcgttgccaaaatacgcttttggttcattccgtaactggtatatgaaaaaagagcaagaacgccaagccctttatcgtgaaaaagtggcgtactatcacggctgttatgtgaactacaacaatccacaacttggtaaagagttgattgatgtgtttaacgcaatggatatcggcgtaatgctacttgaaaaagagaagtgctgtggtttgccattaatggtaaacggcttcccagatagagcgaagcaacaagcgaaattcaaccttgcagaacttgaaaaagtggtgatgaaccgagagcttgacgtagtagggacatcatcaagctgtacaatgaatttgcgtgacgaatatcatcacgttttaggaatggacaacgccaaagtccgcccacacgttcatatcgtcaccaaatatctctatgaactgtttaatcaaggcaaaaaaccaaaattcaaacagatgccattacgcattgcctatcacaccgcttgtcacgttgataaagcaggttgggcgccttacacccttgatgtattaaaacatatcccagggattgaaattgtgatgttaccatcacaatgttgcggtattgcagggacttacggcttcaaagcggaaaactatgaaacttcacaagccattggcaatccgttgttccaacacatcaataacggtggttttgactatgtcgtttccgagtgcgaaacctgtaaatggcaaattgatatgtccaccaacttaacctgcctacacccgattactttgttggcgatagcgttggagagatagttccctctctaccaaacttcctgcttactttcatcgaaccttagtttattactcattaaccccttcccccacaaacggggggaagggcccgaaagacggatggggaaaatttaacattatggtatctactgttctttttatgcaaaataatgttgagtagctctaatgaaacattgatacctttctgctaattgtttataggtttgttttacttgtgtaatcaatctaaatatctatcagacgtaatttctttgtgaaagaagacagatggttatttaaaaaagggcttaaatccttgtactataaggctttaagccactttttagcaaccatttttctactatgcctaggtatagagagaaaaagaaaagccccgatgatttctcatcggggctaaaaatatggctcctcctgcgggactcgaacctgcgacatatggattaacagtccaccgttctaccgactgaactaaggaggaaaagagttgtaacataaatggtgcctcgaggcggaatcgaaccaccgacacggggattttcaatcccctgctctaccgactgagctatcgaggcatctcgtcgttacggggtgcattatgctgatttccgcccctctcgtcaaacgtttttttcaaaaaaataaaaaaatctgtttaacggatcgctttttattcaatttgtttaaaaaacaacgtgttatctcacgttacggtatttttgttgggctttatttaccttaaccaaatagtttcttgcttgtgaagatggatgagcggtggttaaaattcgataaattgctgacggatctaagttattaattcgctcaatcgccattaatttgtcattatcaaacactctcagtactgcgccagccccactattatatgctgaaatcattgcgtaacgttttgatgtaggatcagttattccttctagatactcatcacgcaaaatcgttaagaacattgtgcctgcatcaatattctgacttgggttataaagataatcacgattaggctggccaccaaaacctttacgcgcaaaaatatcccgtccagctgtacgaggtacaacttgcattaaaccaatcgcattcgcataacttactgcataagggttaaatgctgattcaacttccataatacccagaattaagctcatatcaatgccatagcgttttgacatttgacgaaccaatggcaaatatcgtcttgcacgaacttcaacgtggtttgcaatcattggaatcgtgacataagtaacggtatgtccatttttcaagcggcgtgtttttaatttattttgcaataggtaagttgcaaaatcattagcaaccgccatattggttacagaacgcccatattgatccacaacttgacctgctaaaaaaggattattgctaataggaacatcacccgaagcaaatagatcgatccctgtagcatctgatcccatcagtaatgtgtgaataatcgaattacgcaagcggttgtgatccgccaaagtttcaatggtaatttgaccatcttcaaaactaatatggctacgggtgtaatatttgtccgtatattttacatagtctttctggcttgcttggagcagttcattaacgccccaaatttgatcgatattacgtgaaaattgccccatcaaaatatctaatccattggtatttttagaataatcagggcgaggctttttagaaccttttctcgtcggagtatcacttccacaagatgctaaaaaagggatcagtaccaataacggcaggaattttttatatttgttcattaggttatctctattttgactctacaggcacataaccttcaatatggacttcttttccttcaaacaaaaaattcaccatttctgtttccagaagctgacgatgttcagggttcatcatattgagtttcttctcattgactaacattgtctgctttttgatccactctgcccacgcttgtttactgattgaatcaaaaatacgtttacctaattccccaggataaagttgaaaatctaaaccttctgcttcttgtttcaaatatgcacaaaatacattacgcgccatttttctgtcctaatgtcaaagttaattcgtctaaaatgcgttttatcggggttgctaaacccacttcgctaggttgagttaaatcataccaataatccgctgttgaagatacacgcaaatgataatttccctgattttctgccaccccaagcggtaggacttcggcatttttttgtaaactaagttccgccaaaataggataaatatccaaatggaaatggctaaaagtatgccgaaaggcaattaattgggtaaattgcacatttctgcctgaaactgaccgcttgagatcatctaaatgctcaaattgcggaaagacataaagtccgccccaaagtccttttgcttcacgtttttccaataagacttttgtcccctgttttaaaatcaaaaagtagctctgtttttcaggcaacgccttttgcggttttttggctggaaaatccgcccaagcctgttgagcatttgcctgacagcccttttctaacggacaaaggaaacatttcggcttagatcgtgtgcaaatcatcgcccctaaatccatcatcgcctgattaaaatccgccacttgcgaagttggtgtaacacgagcggtcagatcccacaatttattttcaaccgttttttcgcccgaccaaccttcaaccgcaaaataacgagacagcacacgcttaacattgccatctaaaatcgggtaaggtgcatcaaataccgaagagagtaccgccccagccgtacttctgccgacacctgaaagtgcaaacacatcagcaaaatctgtcggaaattgaccgccaaattcatctctaatttgttgtgcagccttatgcaaattccttgctcttgcgtaatagcctaaccccgtccataaatgcaacacttcatcaatgggtgcattcgctaaatcaataatagtgggaaaacgttgaataaaacgctcaaaatagggaataaccgttgccacttgagtctgctgtaacatcacttcagatagccaaacgccatacaaggttttattttgttgccacggcagatgtttacgcccgtattgctgataccacgccaacacgcctttggcaaaaggggcatccacacgagattgtgccaagggaaattcggatttttcttttttcatttagataatgatataagtcttaataataggggctgatcaacgttagctccaaagaaaatatttctatagttcttttgggttttcccacacacaaacagggattataaacaaccattttatctaacatgctaaatactttacctacatatcattactcaatagaccaatttcgattgaatcaatctcaccatctcttgcaatgcctctgttggcggtgtgtcttgattcataaaccagcggaatagctctggatcggtatagcgaagcatttccacgaaagtgtactgttgctctgcggtcaaactatcaaaatgttcttgataaaacggcataatcattttatctaattcacgcataccacgacggcattcccattcaattctaaaacgactcatcagtttacctccgtaatgcgtagctctcttggcacttcaaaaacggtattttcttcacaaccttccagttcttcaactttggtgacaccgagtgtttttaagtgttcaaccacagactgcaccaacacttcaggggcagatgcacccgcggtaatgccgatcgttgtcaccccttgtagccagtttggatcgatgtcctgtggcccatcaattaactgtgaaggtgttcccattcgagaagctaactcggctaaacgatttgagttggacgagtttttagatccaactactagcactaactgtgctaattttgccaattctctcaccgcttgctgacggttcgtggtggcataacaaatatcatttttacgcggaccttgaattgcagggtatttctgttttaaggcttcgatcacatcaattgtatcgtcaatagataaggtggtttgggtcataaaagtaagatcttcatcttcttttaagccaagtttagcaatatcttccacatcttctacaaggaaaatgccacctttctcattatcatattgccccattgtgccgacgacttcggggtgtccttcgtgtccgattaaaattgcttttgtgcctttcttactcgctcgagcgacttgcatatgcactttggttacaagcgggcaggttgcgtcaaaaactttcaattcacgacgtttggcttcgtggcgaaccgcttgagaaaccccgtgtgcagagaaaatcacaatagcaccatctggcacttcatcaagctcttcaacaaatatcgcccctttggcttttaatccgtccaccacaaagcgattgtgtacaacttcgtgacgcacatagatcggcgcaccgtgaatttctaaggcaagctctacaatcgaaatggcacgatctacacctgcacagaaccctcttgggttcgctaaaataatgttcatttaattactctttttacttttacgatgttctaaaatggattctaaaatcagcaatcctgcccccaccacaataccaatatcggcaatgttaaatacaggatagtgataaatgtcccaatgaaaatctaagaaatcaaccacatagccattataagcacgatcaatcgcattgccgattgccccaccaataatcaaagcataagccgcattttgcagtttaagttctgctttatttttaaacagcattacaatcaatgcaatagagatcacaatggctaaacctaaaaagaaatatttttgccagcctgagtgatccgctaagaagctaaacgccgccccatagtttctcacataagtaagattaaagatcggcagaacattcacgctttcataaagctcaaagcgttgtaccacaatgtatttgctcaataaatctgtgattaataccacggcacttaaccacaaccacgataaacctgtttttttcattttattccttaaattgcttcttcgttctcttcacccgtacgaatacgaataacacgttctacatcatacacgaaaatcttaccatcgccgattttgcctgtttgtgccgtatcaatgatcgcttcaatacattcatcaacttgctcatcagccacaataatttctaattttactttcggcagaaaatcaatcgcatattctgccccacgataaagctccgtatgccccttttgacgaccaaagcctttcacttcagtaaccgtcattcccgtaatgcccacgtccgtcaatgcttcacggacatcatctaatttgaatggtttaataatcgcttcaatttttttcataagttatcctatcttcttgctgatttcggtctaaaactctcacaaatttcagggtaagtttcaatataaatgtcgcttaaaagttgtaaacagtagggaactgcactgaaaacaccacgaacaagcacttttccatcttgatctttcaccccttccaaagtttctttaattgcttttggctgtcctggtaggtttaaaatcagtgagctatgtcgaattgcccccacttgacgagagagaatggcggttggtacaaaatgtaggctcacttgtcgcatctgttcgccaaagccaggcatttctcgatgggcaacagctaaggtcgcatcgggtgtaacatcacgtttagcagggcctgtaccgcctgtggttaggactaaatggcaagcgtggttatcgactaattcaatcaatgtttgctcaataagtgcttgttcatcagggattaggcgagtttcaagctcaaaaggtgtggtaatggcagtttgtaaccaagcctgtaattcaggaatgccttgatcggcataaacaccggcagaagctcggtcagacacggaaactaagccaatttttaagatttctttgcttaaacaagcggtcattttctttctctttttgcaaatttagacagcttgttattttaccttgagagcctatttttctaaagtcttaatcttaaagatgaagtaataatattgaaagataatcacagcaattaagatcagtttgccgatgatgtgagggattacaaagaaagcaaaaatacagaatggcacagaaaacgccaaaatactgattttctgtttaagtgtcattgctcgtgtttgatcgaaagacttgagatatttggaatagatagaggtagataaaaaccactgttttagtcgtttagaacctttgccaaagcaatataatgctaaaagcaaaaacggagtggttggtaatccaggtacaataataccgattaaacctaatatcattgagataaaaccgagtaagatgaatagtgctttcatgtatttaagggaaaagtagtgatggatgttgataatacgttaattcaattcatttttcaacgaagcaagcaactagaaagtatataactatttttacagcctaaaaaagcatagtggacaaaagagttggttctgtttttctaactttcactaactcttttgattacggcatccctaaaatatgaattgagatagggacgattagtttcctctcaatgacatttcacctgtcgcaaaacggcggataatttctccttgctgtaaaatcaattctccttcttcattaattccaagggagatcccatgaatttcttcattttcagtgattaatctaaccgcttgatgacggaaaatatcaaactgttgccaacgttctgtgtagggttcaaaggtggtttgtggataagtcactagggcattttgtaaacgtttagctagctcagcaaccagttgggaacgatctatctgatgttctgagagatcgctccaagcctgcgttaccacatttttatcgacagtgttcattcctaaattcaagccgatgccaatcacaaggtaaattcccgttttatcgacacggctctcaattagaatgccccccatttttttaccttgatagtaaatatcattgggccatttaatttgaatatgcggtacgttcagtgtttggaaggtctcggcaattaatactgataccactaaacttagtgatgagagctgtggaatatccaatgaaggatagtgccataacattgaaaaataaacgttttgactttcaggtgaataccactgccgtccacgtctgccacgccccgccgtttgggactctgcaacacaaagtgagcctgatggcaaggttttatagtgagtcagtaggtattcgttggtggagtcaatctctttaaatacaagagcttgtccttgcgttaatgccgatgtaattaaatgttgatcaaatcccattgccaattaccttgtcacaaattcactatccacttcgccctgtcgtcccataaaacgtacttctgggtgtaattccacgccaaatttttcacggacttgacgacggacttctttggctagtgccacaacatcagccccagtggcattctctttattaatcagcaccaacgcttgttgggtatgaactgccgctccaccgatttggaagccttttaaatttgcttggtcaatcaaccagcccgaaggtaatttgaccgaaccgtccgcttgcggatagtgtggaatattcgggtgagcggtttgaatctgctgaaactttgcaaagtccaccacaggatttttaaagaaactgcctgcattaccaaactcatcaggatttggtaatttcgctcggcgtacggcacagacttcatcaaacacttgctgtagcgttactgtgtttggatcaaattgtgccaaagaaccgtaatttaaaacaggttgccacgcctttgccaacttcaaaccgacagccacaatcgcataatgctcacgatattgatgcttgaatacactttctcgatagccaaactcacactcgtttttcgttaaacggaacagctcacccgttttaagatttagtacatcgacataatcgcaaatatgttcaaattctaccccgtaagccccgatattttgaatcggtgcagaaccagcgacaccaggaattaacgccagattttcaagcccgccaattccttgttgcaatgtccattgcactaactcgtgccaattttcaccacctgcaacctgtaaataatgaaaatgctcatcttgacgatgctcgatccctttgagcttattgactaatactgtgccgtcaaaatcatctaaaaacagcacattagagccttgccctaacaataaaatcggttgttgtgcgtgatcagctttttgccattcggttaatagttgttcaatactgttgaactcgataatgaccgatgcttttgcaggcaaatgaaaggtatgaaatggggttaaggtctgactcattgactactccaaattctgaatttgctcacgcatctgttcaattaacactttcaactcaacggcagaattagtgacatcagcgttaatcgattttgatgccagcgtattcgcttcacgatttagctcttgcatcataaagtctaatttacgtccaactgcaccgccttttttcaaaatagacgtggtttctttgacgtgtagctgtaatcggtctaactcttccgccacatcgactttttgagccagtagtaccatttcttgctctaaacgttgtggatcaagttgcaagttcagttcatcaaaacgctgttgcaagcggtctttttgccactgtaaaacgctcggcatttgagcctgtacttttgtcgcttctgtggcaatagcgtctaaacgttgttgaattaaggcttgtaaattcgccccttcacgtccacgcattgcgataaattctgtaaggatctgctcaaaaccgtataataaatcttggctgatctggtcgagatcttgattttggttatcgacaaccccagggaaacgcagaatatccaccaagttaatttcgccttcttgagccgtttcttttagccattgtaatgaacttatcacctgtttggcatactcttgatttaaagctaagccattgttttgattagcatttaattcaatgcgtaaactacactctactttaccacgggttagtgtcgtacgcagacgttcacgcaaggtcatttccaaattgcgaaaggcttcaggcagacggaaataagtttctaaaaaacgttgattaaccgaacggatttcccatacggcgttaccccactcttttttaagctcaaggtgggcgaaagcggtcatactgtaaatcattgtactcttttctctttgttacaaaatttggcatattgtacttggtattctgctagaataggggaaattttttagagaaagggaataaatatgcgtccaaataatcgtcctgttgatcaaactcgtcctgtaaaaatcactcgtaactatactcgctatgccgaagggtctgtgttggtagaatttggtgaaaccaaagtgctgtgtaatgccactgtcgaagaaactgtaccacgttttctcaaagggcaacaacaaggttgggtgacagccgaatacggtatgttgccaagagcaacccatagccgaacccaacgtgaagcggcgaaaggcaaacaaggcggtcgtacaatggaaattcagcgtttaatcgctcgctctttgcgtgcagtcgttgatttgaaagccttaggtgagcgtacaattacagtagattgtgatgtgatacaagccgacggcggtacacgcacagcgtctatcacaggggcttgcgttgcgttacacgatgcgattaacaaattgatcgccgatggcttattgaaagaaaatccgatgaaaggattagtggcggcaatttctgtagggattgtcgatgggcaagcggtctgtgatttggaatatgtggaagactctaacgcagaaaccgatatgaatgtggtgatggttgaagacggtcgtttagtggaagtacaaggcactgccgaaggtgaaccgttcagccatatggaattattgcaactccttgatttagcacagaaagggattgagcagttgtttgaagcacagcgtcaggcgctaaatgcaacttctgatgttatacgatagtcgtacaaaaattaaaattttaagaaatcatttaggggattattcccagcaatattggggcatagtagacaaaatagtcgctatgccaattttttgaaacatattatgtcaaaataacttactcaaccagcccaattttgaacctaaaacattaaagtagttgtaatcttttaaatgcaatagacgcaacttatccgggcttttttgcacaagaatacgttcatcagggctaaacggcagtaaacgttggctatcacagctaatcactaaatttgactgattgtactcagcaaaacgcattgaaataacactatcgccatcgacaaccaaaggacgagaagaaaggctgtgtgggttcatcggaacaagagcaatcgcatttaaattaggggttaagattgggccaccggcggaaagcgaataggcggttgaacctgtaggtgttccaataattaacccgtcggaacgttgcgaaaaagcaaatttgccatcaatactcacttcaaaatcaatagtacgagcgatttggctagagtgaacgacaacttcattgagggcattatttgcttcaatgatcttaccattttgctcaattttcgcatcaagtaagaaacgttcttcaatcataaactcgccacgctcaaggcaactatgcagttgctcaaaggctgtttgaggggcaatatctgttaaaaaaccaagatttccacggttaatgccaatcagtggtacacgatatttcgctaattgccgagccatacccagcatattaccgtcaccaccaatcacaattactaaatccgcccattcgccaatttctgcaatgctcatcgggttagctaaattgagttgagtggcaattttttcttcgactaacacattatatttacgatcttttagccagttatacacagctaaatgcgtttctaaagctatatcgtgacgaggtttgccgacaatcgcaatggtttgaaatctacggtgcatcatttgaactcgttatctaataaaatttggctatatggtagtacgcaatctgctgtttgtcatctttttcctatcagcttactaattgtttaaatcttagggataaataaaaaattaccctataaaatagggtgtcatctattttatagggttagcatgaatttaactaaaaatgaactaaataaaagagttattgatgatttcttattcgttttatagcgtataaattaatttttattcatcatcctagaaactctttatgtttaatcaatcgccggtgtatattcaccttttgcaattgcatctttgatacgctctgcttcactcaatacttgagctaataaagcctgaacgttttctaaggtcgcaattggacttaaggtggtcatttttagcgattgtatgttgttcactttggttacgccgatattcgcttcgccacgggcaaagagttcatctgcaacgttctggttcaaggtatcaacaaactctgctgggtagccttgcggtacaacacggaacaacacggaagcgaattgaggttcaactaatagctctaagctgtcggtcgctttgatgtagtctgcaacggcacgggtcaattttacgccgtggtcaatcatcgaaccgtagagattttcaccaagggcttccaccgtaaaccataattttaatgcgtcaaaacgacgggtggtttgtagtgattttgcgactaagtttggcacgccgtgttcttcgtcatactctgagttgagataatctgctttgtagtcgatgtagcggtattcgttttcatcttttaataaaaacgctccacaagagatactttggaagaagtgtttgtggaaatcaagggtgattgagtcggtgagctcgataccgtctaggaagtggcgatattcattggatagcagtaatgcaccgccccacgccgcatcaacgtgtaaccaaacaccgaatttattggtaatcgcacgaatggctttgagtggatcgatcgcccctgcgtccgttgtgcctgctgttgccacaacgcaagccacaactttgccttctaaataaagtttggctaaggttgcttccaacgcattggtgtccatttgagcattttcattacacggtacagttacaacagattggaatcccattcccatcattgccatatttttttgcacagagaagtgtgcgttttctgagcaaaccactttcaccttttgcattgcatcaggcggaataccgtcacgttgcaccgaccattccgtgccgtccgcatttttccagtattttgcaatgcacgcatcacgggcaagtaatacgcccattaggttagattgcgtaccacctgaggtgaaaacccccgcttgtcctttgtcgtagcccactttttcacgcaaccactcgataagttgcacttccattaatgaacctgcagggctttgatcccaagagtccatagattggttggtagcattgattaaaacttcggcgatttggctagtgaccattgttggacagtgtaagtgagccaaagagtgtgggtggtgtacttttaaacttttgttgaggaataattcaattaagcgatctagggatttagcaacgcctaagccttcttttggcgggttaaaggcaatttctgagcgtagctgtttaatgctaccgccagtgtacattttttcattttgtagccagttactcaccgcttgtacggcagtttccattgatctttgaacctgttgccattgctaattggttaccacggaatgtacctgtgtgtcctgctggctgccaagcgtcaaactcttttttgatcgcaagtacagcaagcggtaagctaccacctacagcttttgacattaccacaacatctggctcaatgcctgcgtgttcaaaggcgaacattttacctgaacggcagaaccctgcttggacttcatctaaaatcaacacaatcccgtgttttttcgttacttcacggattttttgcaaccatttcactggtgcagtcactacaccgccttcaccttgaattgcttcaagaataacggctgctggttttaccataccgctttcaacatcttcgataaagttctcaaaatagtaagttaaagcatcaacacctgcttcgccaccgatacctaacgggcaacggtattcgtgcggatatggcataaactgtacgcctgccattaagttttgcacggcatttttcgcattaaggttacctgtcattgagagcgaaccgtgggtcataccgtggtagccacctgagaatgcaattacattaccgcgacctgtataggttttcgctaatttaattgctgcttctgtgccgtccgcaccagaagggctacagaattgtaaacggtattcacctttcgggaagaaagagagtagttcttcggtaaaagcatcttttaacggcgtagttaaatcaagggtatgaagtggtaaaccacttgctaatacatcttgaatagcctgaataacggctgggtgattatgtccgagtgctaaagtacctgcaccagccaagcaatctaaatattcgttaccttcaacgtcagtgacccagcaaccttgtgcttttgcaattgcaagcggtaatttacgaggataactacgaacattcgattccatttcgttttgacgagttaagtaatattcgttagttgcttgattgatcggatttacaggagttgttgtcatttgaaaatagaccttctataagaggttaaaaaaataagtcgggtgccttgcgggaagcctaagctttcttatcctgaaagataagatgccttggggcatttgactcgctacttattaaaaaaagcgtttcagcttttttgtttttaccctattgctccctaggattggataggttggaaacaacgcctcaaatgttgggttatatttgaggacggcgtatagtagcgatttttaaaaaaaagaaaagttttttctgaataaaactttacctgtgatacagcgagcttaattgtttagaataagtctttgggagatttttgtagggatgttatttttaatttgttgtttggcgtaatcaattgcatagaaaaacgctcgctcacttgccccaccatggctttttacaaccacggacgataagccgagcagtgtggcaccgttatggcgatcagggttgatctgttgtagctttttatagtaacgataaaagattaaacgtagtaaataacgtttggtattgcgacaaagatgtgaatcttccgttgtttttttaaagagtgaaaggatattttttgccgcaccttcaagtgttttaagtgcaacattaccgctaaatccatcgcagacaatcacatcagcaagatgattcattaatttatccccttctaagaagccaatgtaatttagatgattacattgttttaattgctggtgagcatctcgaatttgctgtgttcctttatgctcttctgttccaatattcagcaacgctaaacgtggatagaccaaatccaacatcacttctgcaaacacattgcccatttccgcaaactgaagcaatagttcactatctgcttcaacgtttgcaccaagatctaacatcacacttgagttgccgttgattgttggaatcaaagatgttaatgcgggacgatcaatgtttggcaagggttcaatcaattgttttgccagtcccatcagtacacctgtatttccgccacttacacagccttgagcatttccattttctaccgcttcaatcgctaaacgcattgaactgcctttactttgacgaatcgcttgcacaaaaggcaagtctgcttcgatcacttttgttgtatggactaattcgatacgttgttgaatatcgggagaaagtttattgagatagggggatatttcagcttggtctccgaacaagatgcaactgagtattggatgttgagccaacgcaagtgataatgcggggatagtaatacggggaccaaagtccccgcccatcgcatctaacgcaagagttagatgagtcaatttaaacctctacgagatccaattgattatttgattttacgaccacggtaataaccgtcagcggtaacgtggtgacgtaagtgggtttcgccacgtgcatctacagatactgcagctgtggttaatgcatcgtgtgaacgacgcatatcacgacgtgaacgagatttcttattttgttgaacagccattggctatactcctactagatctagtttttctttaaattagctaatattgcgaaaggatttggtttctttgccagttcttctggtaattcgccaaaaactaattcgctttcggacacttcacagtgttcatcggtatgcatcggcactaggggtaatgacagaatgaattcgtcttctatcatatctagcaaatttatctcaccaaaagaatcaacttcaattggttcataaatctcgggcaaattgtccgcctgatccatattagacactggactgaaacaaaatgtgcagtcgagtctttgcgtaaatgggttactacaacgttgacagtctaactccacatcaactttcgcactgcctttaaccactgtgagtttttgcggatcaacatataacgataaagtaacttgtgcatcgcccagcacttgaccaacagattcacccaaacggctaagtaggttcgcagaaatgtagccttcgtagtccattcgacgctgagcgtctttatatgggtcaatagttaggggtagttttaccttttgcatagggtgcgaatattacagattttgaagtaactagtcaaagagaaaatctggatttgtaaaaaatccgtagaatcatgccgcttatatgtatctattacattatttggtgaaatttagtagcaatcccaccgcttatatgttaaaacgttcgccgtttttatttaacttacaagaaggaaatgcaaatgtcattacaagcaattattgaagcggcgttcgagcgtcgtgctgaaattactccaaaaactgttgatgcacaaactcgtgcggctgtcgaagaagtgattaaaggattagataatggttcactgcgtgttgcagaaaaaattgatggtgaatgggttgttaatcaatgggtgaaaaaagcggttttactttcattccgtatcaacgacaacgaaatcattgatggtgcagaaactaaatactacgacaaagtgccgaccaaatacggtaaatatagcgaagagcagttcaaagcagatggtatccgtgctgttccaggtgccgttgtgcgtcaaggttcacacatcgagaaaaacgtggtgttaatgccatcatttgtgaacatcggtgcttatgttggtgaaggtacaatggtggatacttgggtaacggtggggtcttgcgcgcaaatcggtaaaaacgtgcatttatcaggtggcgtgggtatcggcggtgtgttagagccgttacaagctaacccaacgattattggtgataactgttttattggcgcacgttctgaaatcgtagaaggtgtgattgttgaagatggctgtgtgatttcaatgggtgtgtttatcggtcaatcaaccaaaatctatgatcgtgaaacaggcgaaatccattacggtcgtgttcctgccggttctgtggtggtttcaggtagccttcctgcaaaagatggttcacacagcttatactgtgcagtgatcgtgaaaaaagtggatgcgaaaacattaggtaaagtgggtcttaacgacttattacgttctatcgaagagtaattttcgcactgaatggcacaagcaacggcttgtgcctcttttttggagatcttgtatgacgacctattcgctacgtttaaaagccaaaaatgagctcacgccgcatccaacggcacaatattggcgtaaatgccaagttgaagaactttttgatttgccttttatggacttagtttttcgggcggcagaaattcatcgacaacattttgatccaaatgccattcaactttctacgctactttccattaaaacgggcggttgcgctgaagattgtgagtattgcccacaatctgcccgctatgacacgggtgttgaaaagcaaagtatgcttgatgtgaactatattgttgagaaagcccaaattgccaaggctcgaggagcaagtcgtttttgtatgggagcagcgtggcgaggtcctaaacctaaagatattgagacggtctccgccatcattaaagcggtcaaatccctaggtttagagacttgcggtactttcggtatgttagaagaaggtatggcggaagatttaaaagaagctggattagattactacaatcataatttagataccgatccggaacgctatcatcaggtcattcacactcgttctcacgatgatcgaatggataccttaggtaaagtgcgctccgcagggttaaaaatctgttgcggcggtattgttggtatgaatgaaacaagagctgaacgagccggacttatcgccagcttagccaatcttgatcctcaaccagagagcgtgccgattaaccaattggttaaagtggcaggcacaccacttgaaaatgcagaagatctcgattggacagaattcgtgagaaccattgctgttgcgcgtattacgatgccaaaaagttatgttcgcctttcagccgggcgtagcaatatgccagaagccatgcaagccttgtgttttatggccggcgcaaactcgatcttttatggggataaattattaacgacggaaaacccagaagaagatggcgatagagtgctgatggaaaaattgaatttatatccattaagttgttcgaatgttgaatgataaaagtaattacaacataagtagctaaattctctcccctctccctgttttttcttgtaaacgaagcaaaaactgcccctctcccacaaggggcgagggttagaatttgataacattgcaaaatcttgctcatttttaaccgcttgtaaggataatataatgaaaaaaatcttgttattaaacggacctaatttaaatatgctagggaaacgagagccccatatttatggttcacaaaccttagccgatattgaaaaccacctccaacaattagcgaaggcaagaggctattgtctagagtattttcaagcaaatggcgaagagccgattattaaccgtattcatcaatcattccaaaataccgatttcattatcattaaccccggtgcgtctactcataccagcgttgctttgcgtgatgctttattgtcagttgctattccttttgttgaagtccatttatccaacgtacacgcccgtgaacctttccgtcatcattcctatttaagtgatgtcgcaaaaggcgtgatttgtggattaggggcaaaaggttacgattacgccttagattatgctattcaatttctaaagagagggaaataaatccattttttgttgtctgaagtaaaaaaagaaaactgaactgctacgattagtggcaaatttgctaataaattcggcaaatttatcagattttcgtcgcaaattaataaaatttcaggtaatctacgcaaaattttgctctatgttctttgaacatagagtttgtttatttttacattcaaatacggatctcattatggatattcgcaaaattaaaaaacttatcgagttagttgaagaatcaggcattactgaattagaagtgtctgaagaagaaggcacagtacgtattagccgtgcagcaccagcagttgcacctgcggcagtacaatatgttgctgcaccacaagcagcgccagcacctgcagcaacccctgcaccagcagctcaaacagcacctgcggcagcgccagcaccaacagcggaagtatctggtcacgcgattctttcaccaatggtaggaacattctatcgtagcccaagcccagaagcagctccatttgttgaagtgggtaaaaccgtgaaagtaggcgacacactttgtatcgttgaagcaatgaaaatgatgaaccgtatcgagtcagacaaagcaggggtaatcaaagcaatccttgtaaacgacggcgaagcggttgaatttgatcagaaactcttcattattgaataatccatttcttacaagcggtcagatttttgcaaaaaattgcacgaaaaagaccgctttcaattaagggtatctcttatgttagaaaaagttgtcattgcaaaccgtggcgaaattgcattgcgtattctgcgtgcgtgccgtgaacttggcattaagacggttgctgttcactcaacggcagaccgtgagttgaaacacgttctccttgcggatgaaacagtatgtatcggtcctgcgccatcaacaaaaagttacttaaatattcctgcgattattgccgctgcagaagtaactggtgctgatgcgattcaccctggttatggtttcttatctgaaaacgcaaacttcgcagaacaagtagaaaattcaggctttatctttattggtccaacagcagatgtaattcgtttaatgggcgataaagtttctgcaattaatgcgatgaaaaaagcaggcgtaccttgtgtgcctggctctggtggccctatcggtaatgatgtcgccaaaaataaagaaattgcacagaaaattggttatccagtgatcattaaagcatctggtggcggcggtggtcgtggtatgcgtgtggttcatcacgaaaaagatttggaagaatctattgcgatgaccaaagcagaagcgaaagcagcctttaataacgatatggtttatatggaaaaataccttgaaaatccacgccatatcgaaattcaagtgcttgcagatacacacggcaatgcggtttatttggcagagcgtgattgttctatgcaacgtcgccatcaaaaagtggtggaagaagcaccagcgccaggcattacccctgaattacgtcagtttatcggtgaacgttgtgcgaatgcgtgccgtgaaatcggctatcgtggtgcaggtacatttgaatttttatttgaaaatggcgagttttatttcattgaaatgaacacccgtttacaagtagaacaccctgtgacagaaatgattacaggtattgatcttgtaaaagaacagcttcgtgttgctgcaggtttaccaatctcagttaaacaagaagatattaaagtgcgtggtcacgcgattgaatgccgtattaatgcggaagacccaagtacattcttaccatcaccgggtaaaatcacccgtttacacgttccaggtggattaggtgttcgttgggattctcacatttatgctagctattcagtcccaccgcattatgattcaatgattggtaaattgattacctttgctgaaaatcgtgatattgcaattcgtcgtatggaaaatgcattgtcagaaacgatcgtggaaggaattaaaaccaatatcccacttcataaacagattctttctgatgaaaacttctgcaagggtggaacgaatatccactatcttgagaagaaattgggtttaaaataatgatatagtagaaaacatatctgctactatgtcaaaatagatacaataaagccctaccttacggtagggcctgagaaaagatgtaattataaactttcagtgaaagtacgagtaataacatcacgttgttgttctggtgttaatgagttaaaacgaactgcataaccagaaacacggatagttaattgtggatatttctcagggtttttcactgcatcttctaatgtttcacgacgtaatacgtttacgtttaagtgctgaccaccctcaactttaatggttggtgcaacattaactgggacttcacggtatgaaacttgacctaattcgctgattgcaactatttggtcttcttggaaatcacctttagctgctaagcaacgtgcttcatttttctcttcatctaataaccagaaagagtttaataagtttttgttggtagattcagtgatttgtacacctttgatcatttttagctcctagtatgttgggtaaattataaaaaaagtttaaagtttcaaaaaattttgagtattctaactttaatcctttaaaaagcgagaaaaatttaagcatttttatcaaaaaaactgatgatggcttaaaaaatagacaagagttaacagttcattttaatttttaacaatttaataataggatagaatatgaacagttggactgatgccattggggaagaaaaaacacaaccctattttcaacatattttgcaatatgtacatcaagaacgtttagttggaaaagtaatttacccacctcaaaatgaagtgtttagtgcttttgctttaactgaattcaaagatgtgaaggtagttattttagggcaagacccttatcacggccccaatcaggcacacggtttatctttttcagtaaaaccaggaattgttccgcctccctcgctggttaatatgtacaaagaattatcccaagatgttgggtttcagataccatcacacggctatctcattgagtgggcaaaacaaggggtgctattgttaaatacggttctcaccgttgagcaaggaaaagcacattcacacgccaatatcggttgggaaacctttactgataaggtgatccatcaactcaatctacatcgtgaaaatctggtatttttgctttggggaagccatgctcagaaaaaagggcaatttattgatcgttctcgtcattgcgttctcacagcccctcacccatcaccgctctctgcacatcgtggctttttaggctgtcgccatttttcaaaaaccaatgattaccttcgttctcacggagtcgaagaaattaattggcagctgccattataagtaacatgctaggaatatctaagagatttcctaacttatattgttgatttggactggctcaataatttcacttggatagcaacccaatacttttaagaaactcgtcactgtttcaagttctttcaaggcattttgggtattttcattgtgaatattggcatctaattccacatagaacatctcttcccatggtttaccataaataggtcgagattcaagtttaatcatacgaatgccgtgttgcttgaacaccatcaacgcatcaaccaaagcacccgcttgttgagtcgtcgtcattaataacaaggttttggtctgtacttgtggcgaaacattgatagtttttttagacactacaataaagcgagtaatattgttttcttgattcgcaataccactttttaacacgcttaaaccgtacaatttcccgccatcttcattacctaacgcaacgcaatttggtttatttaaacgagccactaactgcatagcgtgagaactactttcacagtatttgatatgcactttatctaaactatgaataaattggctacattgttgtgcaggttgtgggtgggtataaatggtatccacttgggcaaaatcagcattgtttgttcctaaaacacagtgtttaataggataagctaattcgcctacaagggttaagtctgtatgttgcaacaaatcataaacttcattgatagaacctgatgtggtattttctaacggcaacacgccataatcggcttcatcttgctgaactttttcaaaaactgaatcgaaagattcgcaactgagttccactaaagaagccgtgctgtttttcataaactggcgagaagcaagatgagaataagagccacgcatacctaaaaatgcaatggtggcattttcttgattctgattcagtttattttgcaagtaatgttgctgtgttaagacagagtcttcaatgatacgttggaaaatttgcgtaacatattgtgggtcaagttgataattttccgcttgagcaaaactaaccaattcttgtaacagttgtttttcacgttcgatatctcgtagaggctttttcgtgatctctttgcttctcactacatcgaacgcaagtcgatgacgctccgataataatttcaataagttgcggtcaatttgaatgatttgttgtcgaatatccgataaatctaaagacattgcgttttcctaagcggtcggttgtgtttaattttttgcagtttgcagtttgtatataactgaaattttaacggcttcccccataaatcacaatcaactaatgaaaataatcgctaaaatggtaagatgtcgcacttttatcaaataaagaggaaatcgaatgtcaaatccacttttaaacaacacaagtttacctaaattctctcaaattcaacctgaacacgttgtgcctgctattgagcagttaattcaacaatgccgtgatacgattgaacaagtttctcaaattaatacaccaacgtgggaaaacttctacctaccgcaagcaatcacaggggataaactctctcgtgcgtggtcgcctgttgggcatctcaattcagtaaaaaatagctctgaattgcgtgaagcttatcaagcgtgtttgccgatgttatccgaatacagcacttgggttgggcaacatcaggggttgtatcaaggctatgtcaaactgaaaaatagccctgagtttgccacttattcgctcgctcagaaaaaagcgattgaaaacagcttgcgtgattttgagttatcagggatctcattgccagcagataaacaaaaacgctatggcgaaatttctgctcgtttatctgaacttagctcacaatttagcaacaatgtccttgatgcaacaatgggttgggatattgtgattgaagacgaagcggatctaaaaggtttgccagagtcagcacttgaaggggcgaaattttcagcacaaagtaaagagaaatcaggctaccgctttacccttgaatttccaagctatttgcctgtgatgacctattgtgaaaaccgtgagcttcgccagaaaatgtatgaagcttataacacacgagcgtcagatcaaggtccaaatgcaggtaaatgggataactctgcaattatggcggaaacccttgagttacgcttagagttagctaaattactaggttttgaaagctatgccgagctttcccttgcaaccaaaatggcggaaaacccaacgcaagtggttgatttcttggaaggtttagcaaatcgttctaaagagcaaggcaaaaaagagttagctgagctaaaagcctttgcaaaagagagctatggcgtaagcgaattacagccgtgggatattgcgttttatagtgaaaaacagaaacaagccttatatgcgatcaacgatgaagagttgcgcctttatttccctgaagaacgtgtgctttcggggttatttgaactggtgaaacgcatttttggtatgcgagtggaagagcagaaagagtttgatagctatcacgagaatgtccgttttttcaatattttcgatgaaactgaccgcttgcgtggttcattctatttggatctatatgcccgtgaaaataaacgtggcggtgcttggatggacgattgtatcaatcaaaaacgtctagcggacggttcattacaaaaacctgttgcctacttaacctgtaacttcaataaaccgattggcgataaaccagctctgtttacacacgatgaagttactacgctgttccacgagtttgggcatggtattcatcatatgctgaccgaaattgatgtgggtgacgtttcagggattaacggcgtgccgtgggacgcagttgagctaccaagtcaattccttgaaaactggtgctgggaagaagatgcccttgcctttatttcaggacattaccaaacaggcgagccactaccaaaagagaaattgacccagttgctgaaagcgaaaaacttccaagcagcaatgtttgtgttacgccagttagaatttggtttattcgatttccgtttacatatgagtgagccgaaagaaaatattgtgttagatacgctaaaagcggtaaaagcacaggttgcagtggtggaattaccgactttcgtgcgtaccccacacagcttctcccacatcttcgcagggggctatgccgcaggctattacagctacttatgggcagaagtattatcggcagatgcctttgcacgctttgaagaggaaggtatttttaatcgtgaggttgggcagtctttcctagataatatcttaacccgtggcggttcagaagagccgatggtcttgtttgaacgcttccgtggtcgcaaacctacgttagatgcgttgttaagacataaggggattgctcgtcaagaggataagacttggtagcataatacattaaagaaaagagttggcttgtatgcattaatttgaaaattgttgaatataaatcatatattccaagtgattcaatcaacgttgataataggaatgagacaattcattttgttgcaaaagttcataaatccgctatactcgccagtctgagttggttagacaatcgctggtttattgaagcccttaaccgttcgtaagaacgacctagtgggacaagtaaacgagaggaaagtccgagctacacagggcagagtgccagataacgtctgggaggcgtgagcctacgactagtgcaacagagagcagaccgccagtttcggctggtaagggtgaaagggtgcggtaagagcgcaccgcgtgagtggtaacatttcacggcacggtaaactccactcgtagcaagaccaaataggaatccaacgagttgcccgcttgggattcgggtaggttgctcgagcgtatgtgtgaatgtacgcctagaggaatgattgtccacgacagaactcggcttatcgaccgactcagcctaatttttaagagcgaacagattttgcctgttcgcttttttattgaagcatgtcggaacaaaaagcccttataaaagtctgatataatgattttaaaattgatttcattataaggatttcaaatgcttaagcgttttcttatcggcacgatttcgctgttactctctttttctgtttttgctcatccacactctttccttgatatgaaaaataaagtgctaattcaacaaggtaagctggaaggttttgaattgtactggacacttgatgagattacatcagctgaactgatctatgaaatcaacagcagtaaggataaaaaacaggcaatgaataaaattttgcgtgagttagatgaatctgcggtgagtacccactattttagcgagctttataatcagcaaaatgaaccgattaagtttaaagctaaaccgcataactcgtccgttgaaattcagcataatcgtattatttaccatttcaccttgctactagccgagcctaaagcggtaaaagggcagtcattccgtttttttacctttgagccaagttattacttagcaatgaattacgaaaaagcgagtgatgtcagtagcacagagcaaaatctttgtaaagttgagatgattgagccgacggtaaatcaatctttgcggttgtatgcatcgacattagataaaaatgaaacccccgatatgccagcagaacgtggcttgtctttaggcgcacaatttgcgcaaaaagtgagtattgtatgtcaataaaggcaaagtattgggctgggatagcggtcggattggtggctctttttgcgatttatcaggcttatccctatctcttatttaaagtcagcgagtggcagagggaatttaattttgccctttcaggggcgttaaatcgtctaaacgaaaaccagcaacaggcagggctgagcttaatggcggtgagttttatctatggcgtgtttcacgccgtcggcccaggtcacggtaagtttattctgaccagctatctctcttttgaacaaaccaaactgccacaagcggtgaaaatcacgttgttgtctgcgttagtgcaaggcttggtggcgattgggttagtgacgattattgtggtgatttttaccctttctcgtagctattttaatctagcgttaaaatgggttgagcgaggcagttttgttgtaatgatgttgtttgggctttattggtgttatcaagcgttaaaaagcgtgagagcaaagccaaagggctttcaaattcgccatttgcaaaaaatagagcagaaatcaccgcttattactgctcatcatcaacattctgcagattgtggctgtgggcataaacatttgccaagttcatctgaaatggcaactgcaacggattggaaaagcacgctgatgttgatttttagcattggcttacgcccttgttcaggggcaattttagtgctgtttttagcttataccttggatttgtacctgtggggggtagcttctgcgttattaatggcaacgggaacggggctaacgctaacgctttttgcctgtttggtacttttcgctcgccgtaaagcggtgcatattagccattggtatctttcattttctgctcacaagcggtctgttttattcggaaaattgctgattggattacttttgatcggttttggttttaccttattccacagtagtttgttagatacaagccaaaatcttttgtttaagcgttaagttatgtcatattcaatggacgccgagcgtggtgtcccttgtattatttgctaattagacagaatttgttatttaaaccagtccagctcgctaaataactaatcattaactttttttatcattttaattaaaaaaatcttttcaaaagataaaaaatcgttaaaatgccgaaattgttttacttttttatgaggtcttttcgatggatagcatcgtttcaatttttgaagatgttttaaaatggatcgtgaacacgattgacggtccactttgggatattactgtattaacccttttaggtgctggtttattctttaccattaccactggcttagttcaattacgtttattacctcgtagtatccgtgaaatgtggtctggccgtgctgcagagggcgagtcattaaccccgttccaagcctttgcaacaggcttggcaagccgtgtgggcgtgggtaatatcggtggagttgcgactgctatcgcattaggcggaccaggtgcagtgttctggatgtggatcacggcgttaataggtatgagtagtgcatttgcagaatcatcattggcacaggtttataaagtgcgtgatccaaacggtatgttccgtggtggcccagcttattacattaagcgtggtttaaaagctccttggcttgcgattgcctttgcaattaccttaatttttaccttcggttttgcgttcaatgcggttcaagcaaactctatcgttgaagcaacgcgtaatgcgtgggaatgggatccgcattatgtgggcattgtgttagtgattgtgactgcagcgattatcttcggtgggattaaacgtatcggtcaggtttcagcgaaagttgtgccgatgatggcgttattctacttaattatggcaatgatcattttagggatgaatattgagcgagtacctgaagttttaaataaaattattaccagtgcctttgacttttctgcaatggctggcggtatctttggttcattattctcacaagcgatgttaatggggattaaacgtggtttattctcaaacgaagcgggtatgggttctgcaccaaactcagcggcaacgtcagatgcaaaacaccctgcaagtcaaggcttaattcaaatgttaggggtatttgtggataccattattgtatgtacttgtaccgcaatcattattttaatgtctaacgattatggtagcgaatcattgcgtggcgtatctttaacccaaaaagcgttagagttccacatcggtgaatttggcttacacttcttagcctttatcttattgttattctgctacacttcaattatcggtaactatgcttatgcagaaagcaatattcgctatatccgtaacaaaccaagtttcgtattagccttccgtttaatcgtgttatttttcgtttacttcggtgctgtgcgtgatggcggtattgtttgggcgtttgccgataccgtaatggcatcaatggcgatgatcaacttagtgtctatcgttttacttgctccaattgtttgggttatcttaaaagattaccaaaaacaagtgaaagcaggggtagagcagcctgtattcaaaattgaagatcacccagagcttattcgccgtggtgttgatccgttaatttggaagtcaaaagagtaacctattaaaagtttaatctaataagatccctgcttatcatgcagggatttttatgaggtatagggatcttaagtagatttatatgtattatttatttctaattacatagataatctagtttttatctgttctatattccctctaaagtaaccgcttcagaaattagaatagcggtttttatacagccttaatttatctattctgtgaagtcgatcacagatttgataaaaggattaaggcattttagagtattattgcctataatactctccctttttttatatcaatgaggatacttgttatgatgaacagaggacgttttcttcaaattggtgcgaccactgtattagccattagtgcaaatcgctttgcatttgcagctggtgatagcaaagtttcttacgtgtcattggcacaacggatattcacagttttttaacggattttgactattataaagatgcgccaacaacaaaatttggttttactcgtgccgcaacgttaattgaacaagctcgaaaagaagcttaaaatagtgtacttgttgataatggtgacttaattcaaggtaatccgattgcggattatcaagctgcggtcggttataaagagggtaaatctaaccctgcgattgatgcgttaaaccaggtactgatgagccagtttaccaaccatacttcattcagaaaaaagaagtggttgatgaagatggcgtgaaacatactttaaatgtcggttatatcggtttcgttccaccacaagtaatggtttgggataaagcccatttagacggcaaagtggaagctcgtgatattgtgaaaacggctgaaaaatatgtgccaatcgtgaaaaaagcggggcggatttaatcgtagcacttgctcacactggcccatctgatgagccttattttgaaacgtcgccaagcgataaagcgaaagcctttattgcagaaaaagcacaatatccaatgtcattcgttggcactgatgaaacaggctttgcgatttatcagattgatttgacgaagtaatatatttatagccaagcattttaattaagttctttttagaatgctgggcgctttttttagagttttcatcctacaccctcatcttgtatgcttcattttatcgaactcaatcatcaacaataccccacagacgaacacggctatttgaaaaatttagacgactggtcgcctgaacttgccgtagttatcgctcaaaaagataaccttgaacttagcgaagcccattgggaaatcgtctattttgtgcgagaattttatcaagaatataaaacctccccagcaatccgaatgctagtaaaagccttatcgcagaaatttggtgaagaaaagggcagtagccgttatttgcaacgtttattccctgaaggcccagcaaaacaggcaaccaaaattgcaggcttgccaaaacctgcgaaatgtttataggaatgaagatgaacagcccgcaatcaatctgtattttacgactttctgcgattggtgatgtttgccatacccttgcggttgtgcaagccattcaacgccaatatccgcgagcggaaatcacttggatcattggtaaaacggagtcgatgttaatgcaaggcattccgaatgtaacccttgtgccttatgataaaaaaacgggatggaaagggattttggcgttatggaaacagcttcgcagtaagaggttcgattatctgttaaatatgcaaacggcattgcgtgcctctattttatcgttaggtattcgagcaaaacaaaaggtcggctttaatcgagatcgtgcaagagaagggcagtggttatttacaaataaaaaggtggaacagaccgcttcccctcacgttttagacggtcagatgatgtttgctaaagcgattggtgtgcaagatctacgtccaacttgggacttgcctgtaagtgaagcagatttagcctatacgtcacaatttattgataaacaaagaaaaaatttagtcattgccccttgttctagcaaaaaagagaaagattggttgcctgaaaattatgggcaaattgcacagtttgcattagcacaaaacatcaatgtgattattgcaggatctccgtcggtttatgagatggaagtagcagcaaaaattcaacaacttgcaccgaattgccttaatcttgcaggaaaaaccaatttaaaacaacttgccgcattaattcgtcaagcggatttggtgctatcttcggattcggggccagctcatattgcgacaactcaaaatacgaaggtgattggtctatatgcgattcataacccacgccgtacaggcccttatttagatttagataaagtggtgtctgtttatgatcaggttgtattagaaagtcgtggaaaaccttgggatcagttgccttgggcgacaagtgcgaaaggtgatggactgatggagagaatttcagtagagcaggtgaaacagaaaattcaagattatttataaaatcattgtttgggcggaccgatgtgtccgcccgaaatattatagggctttgacagcttgatagattaaactcaaaaaaccattgaaactttgccaattacgttgtaaattacctctgtattgatttttttacaattataggaaataaaaatgaacactgtatttaatcgggatagtttacacaacgtaaacatttgtaatgaaaaagttttgctaacgccaaagggattaaaacaagagtttccgttgccggagcatctgcgtaaacagattgaagaatcaagaaaagtgatctcagatattattcataaacgtgataaacgccagcttattgttatcggcccttgttccattcacgatcctgtatctgcattagaatatgccaaaaaattaaaagtgttagctgacaaagtgtcagataaactttacattgtaatgcgagtgtactttgaaaaaccacgaactacggtgggttggaaaggcttaattaatgacccacatttaaacggcaccttcgatgttgaaaaagggttacgcattgcacgtaaattattgttggatttagctgaactgggcttgccacttgcaaccgaagccttagatccgattagcccacaatatcttgctgatctgtttagttggtcagcgattggagcaagaacaacggaatctcaaacccacagagaaatggcatctggcttatcaatggcggtgggatttaaaaacggcacggacggaaatttgggcgtggcgattaatgcaatgcaggcttctgcaatggggcatagttttattggcattaaccaacaggggcaagtgacggtattgcaaaccaaaggcaatcctgatggacacgttattttacgtggtggaaaatccccgaattttgaagcacaatatgtgcaagagtgcgagcaagcattacgcaaagccggcttgcctgaagcgattatgatcgactgtagccacggcaactctaataaagattaccgccgtcagccgttggtggcggaaaatgtgctacaacagattgtcgcaggcaatcaatctattatcggcttaatgatcgaaagccacctgtttgcaggcaatcaatcatccgagcaaccttttgaacagatgaaatatggcgtatctattacagatgcttgtattgattggcagacaacggaaaccttattaaccgattttgcagagaccctaagaaagtagtatgaacccattaaatcctattcgtgaacagatcgatcaagtcgatcaacagttaattgaattattgtcaaaacgtctttcactggtggcagaagttggcaaaattaagcaccagcacggtttgccgatttatgcccctgaacgtgaagcctcaatgattgccgctcgccgtcaagaagcagaaagtcagggcattcctgctgatttgattgaagatgtgttgcgtcgtctaatgcgggaatcttatgccaacgagaataaacacggctttaaagcgacaaatgagcaaatgcggaaaatcgtggttgttggtggcttgggcaagttaggcggactgtttgcccgctattttgaattatcgggctactcggtcgaacgccttgatcgagatgactgggagcaagccgaacagattatgcacggagcggatttagtggtggtttgtgtgccgatagccaacaccttagacacccttgagcgtttacagccgtatttgaacgaacagatgatcttagctgatctcacctcagtcaaagcacagccgttagcgaagatgttagaagtgcattccggagccgtcgtcgggcttcatccaatgtttgggcctgatattgcaagttttgccaaacaagtgatcgcttgttgtcacgggcgttttgccgaacgttatcaatggttgcttgaccaaatgcggatttggggagcgaagattgaagagatcgatgccacagaacacgatcacgcaatgacctacattcaagcactacgccacttttccacctttgcttatggcttacatttatcgcaacaagcggtcaaattaccacaattacttgcactttcgtcaccgatttatcgtttagagctggcgatgatcggtcgtctatttgcccaagatgcgaaattgtatgcggaaattattgccgataagcctgaaaatttagatgtcattgcctcgctacaacagagttttgaaaagagcttggcattctttcagcaaaacgataaacagggctttattgatgcctttgaaaaagtgcattgttggtttggcgattattccgaacagttccttaaagagagccgtaatttattgcaacaggcgaatgatttgagggggtaggaatttactttactaagacattttatattttctcttgcttttccgcccttaataagggcggagtctatgagaataattatgtatgccgagcttacttcaactctctcgctcctaaattatccaccttacaaatatggataaaaccctcattattttgtagataatctttttcaagataatcgaccagtttttgagcgtgttctaaatctggtgcaatggcgaacatagttgggcctgaccccgaaatacccaccgctaacgcccccaaatctttacaaccttggcggacttcggcaaagtttggcagtaatgattcacgatacggctcagcaataagatctttcatcataattgcggcaagtacatcttgacgagtgtgacaagcgtgaacgaaagagcctaaatagcgagcttgtgagatcatctcttggcgtgtatagcttttcggcaagatcgcacgggcttctgcggtggaaacttcaatcccaggataagccagcacccaataccattcgtcaaaaaacggaatcggctggcagatattgccgagagattgagtcatcagttgcaaaccgcctaaatagcaaggtgcaacgttgtcgtaatggattgagccagaaattctaccttctagttcgcccatcatttccaacaattccatttttgaaaacggttcatcgtggaatttattcagcgctacgagtgcagccacaattgagcaagcacttgagcctaagcccgatccaatcggcatatttttctcaagggttaggcgtagatttttcactacaccaccacgcaatttcaagcgttcgctaaacagtacataagcttgatagacgatatttttttgcggttctttcggcagtttacgcacaaaataaccgacactttccaactcaaacggttgatcacactcttcaatttgtactacatcgccgagtaatgagccatcaatcggcgaaatggctgtgccaagagagtcaaacccgacacttaaatttgcacttgaagctggagcataaattcgtaatgtcatttttttcctttgtttttataaccatttttgtggggacgccacgcttggcatccgttataagcggttagtttggaacaaaattttgcaaatgtagatttaattcagtgtacgcaaaatatccgcaaaaatacccgctgccgtcacatcattacccgcaccgtagccacgcagtaacagtgggatcgggctgtaataacgggtatagaacgcaagggcattttcaccatttttcactttataaagtggatcatcaccgtttacttctttgattgcgacacggcatttaccgttttcaatggagcccacataacgcaacacattgccacaagcggtcgcgttttccacacgttttgcaaattccacatcaatctccggcaacatcgctaaaaattctgctgcagttttgccttcagagaaaccttttggtaaaacaccttccacttcaatatcttccagctctaatggatagccacattcacgggctaaaatcagcaatttacgagccacatcttgccctgataaatcatcacgtggatcaggttctgtgaagcctttttctttagcaatggtggttgcttcagacaaacttgaaccttcttctaatttaccgaaaataaaagaaagcgaaccagataaaatcccttcaaatttctcgacttcatcgccggcagcaagcaaattttgtaggttttcgattacaggcaagcctgcgcccacattggtttcatataagaatttatgttggctttgacgagcattttcacgcatttcctgataataagcatagcttgaggtattcgctttcttatttggtgtaattacgtggaagccttcttttaatgcacgagaataaagatttgccaccgattgtgctgtcgtgcaatcgacaaaaacaggattaacaacgtgatgtaatttaatgaatgaaagcaacacatcaaagtcagatggctgtgtcgccgactctaaatccgcacgccagttatcaaggcttaagccgttttcgttgagcaacattttatttgagttagctaatgcacaaacacggatctcaatatccttctttgcaagatattccttctgggttgtgatctgttcgatcaattcgccacccacaccgccaacccccactaaaaagacatcgaccacttttttgttattgaataacgctttatgtgtagctttaaccgcttcaatcgctttatttaacggcacaacagcagaaatggaacgttctgatgaaccttgtgcaatcgccacaatgctgatatttgcttgagccagtgcagagaagaagcgagccgcaatccctttggcggtacgcataccgtcaccaaccacagaaataattgagagatctttgatcacttccacaggatcaagcgagccatcttttaactcttgagcaaaagtattgtttaacgcacagagtgctttttcgaccgcttttacaggcacacagaaactaatactatattcagaagaagattgtgtaattaagttcacggaaatacccgcttgcgacatcgaagtaaacacacgagcagccataccaaccataccttgcatacctgagcctgaaacattgaacattgccacattatcaaggttcgtgatccctttcacttttaaattatcattgactacattactgtcaatgattgtgcctggtgcttctggattatgggtatttttaattaagcacggaatgtttaacggtactaacggaccaatagtgcgagggtggatcactttcgcaccgaaataagaaagctccatcgcttcttgatagctcatagactctaaacagatcgcatctggtactaaacgaggatcgcaagtataaacaccatccacatccgtccaaatttcgcacacatccgcttttaagcaagcggctaaacaggcagcagagtagtctgaaccattacgaccaagtaacaccaattcaccttgttcgttacctgccgtaaagcccgccattaacacgacgtttttctttggaatagaaagagcttcaatacgtttggtcgattcagcaatatccacagaagattctaaatagctcccgtgtgctaataatttttcgataggatcaatgcgagtaacttcataacctttcgcttcaaaccacgctttcatcatcgcaatcgacaatttttccccacggctatgcactgttgcaccgatattatctgggcagaatttattttttgctgcttcagctgcaatattgcagatgtcgtctagttctgctttgataaaggcacttaatccttcacggtcgaaattgttattgacggcatataatccgttgatgatgttattgaaaatgtcggtggcttcggtgagatgagattcgtaggattcgcctgtttgggctttatcgacaatagcgacaagatggttagtgattttagctggggcggatagtacgcctgcggcttggtttgccaaatgtgccttttcgatgatgtcagcggcttgtaaaaagcgttctggattggctaaagaagtgcctccaaattttagaactcgcataatttctcctgaagataatagttaatgtttgcaaattttgttacaaaaaaacccgcttgttaaagcgggtttcgttgaatattgttccgttttctagccacgaacacccgcactatgtttgcacataatggtcatcgtcgtggtaataatcatagaaaaacggttcatcgctattctctaaatgttaagcatgaaagacaagtgggagaatcctctaaaatagaacatttgtcaacaggtttttatagaataactactatttaatatgtcagattaaaaatcgatgtatctatattctttagaacaacatcttatatggatacatttttgctattgatacagaatgtatgctcgaatattttaattcctcaataagagagcatgaacaaattaacgaataatgccacgcgtagaacgtttaaagaaatccaagaataaactgaccgctgcttctgtttttgcatactgttcaatttctggaatagcttcttctaaggttttaccactgcggtaaattagcttatacacattgcggattgcatgcattgtcgctttctcaaaaccacgacgttttagcccttcaagattaaccccgaacggttgtgcgtggttgccttgagccattatataaggcggcacatcttggctaaccattgatccaccacccaacataacgtgcgaacccacaacgacaaattgatgaatagctgacattccgccaacaatcacaaaatcatcaagagtaacgtgtcctgctaaagtgccattattcgcaataatacagcgattaccgatagagcaatcgtgggcgatatggcagttaatcataaataagttatcgttacctacacgcgtaacaccaccgccttgaaccgtaccacgatgaatagtcacactttcacggatacggttacgatgtccaataatggttttagttggttcaccttgatatttaagatcttggttaatttcaccaatacttgcaaattggaaaatttgattatcttcaccaatttctgtatcaccttgaataacaacgtgagagtgaatttttgtaccagccccaatgcgaacatctttgccgataacacaaaatgcaccgatttctacatttgcaccaattttagcaccttcttcgatcaaggctgttgggtgaattttggctgaagcgtcaattaatggcatagtattttcctctttattcaagcaagattatttacgtgcacacattaggtctgcttcgcaaactagcgtatcatctacataaactttacctgtaaatgccgtaatacctcgacgctctttaacaaaggtcacttcaatgatcatttgatcgcctggtactacagggcgtttaaagcgagcattatctactgctgcaaaatagtaaagttcattgtctttcaatttgccgtagcttttaattgctaaaacccctgttgcctgagccattgcttctaaaataagtacacctgggaaaacgggttgatttggaaaatgcccagtaaaacaaggctcatttacactcacattttttacagctcggagccatttaccttcttcaaaatcaaccacacgatcaactaataggaatggataacgatgtggaagcatttccataatttcagttacttcaataattcttggttcacgattttctgtttgtaatttggttgtcactactaagacctcaatcaattattcagctaaacgtttttccaatgctttcaaacgtttattcatttcatcaatattcattacaagagcagctgttttacgccattctttattagtttgcaaaggaatacccgatgagtaaattcctttctctgtgattggtcgcattaccattcccattccagtaatgattgccccatcacaaatttccatatgcccattgattacacttgccccaccaatttggcagaagcgtcctactttcaggctaccagccattacgacacctccagcaatcgcagtgccataaccgatatgtacgttatgtgcaatttgacataggttatcaataatcacattgtcttcaatcaccgttggatctaaagcaccacgatcaatacaggtacaagccccaatttcaacacgattaccgataatcacgccaccagtctgaggaattttaatccattgacctttctcatttgcatagccaaaaccgtcactaccaataacggcagaagattgaattaaacaatctgagccgatttgtacattatggtaaaccgacacatttgcccataatttggttcttgcaccaattttactgttttttccgacaaaacagccagcaccaatcaccgcatcatcaccgatttcaacaccactttcaatcacagcatttgcaccgacagaaacgttatgacccaatttagcatcaggtgagatcacggcactttcagcgatattttcggcagggtttggggttgtatccatatattgagctaaaatcgcataagcaacataagggtttccaaccacgatcaagttttgaccttcggcacaaaattcgacatcagcttcagaaacaataatagctcccgcttggcattgagctaactgtggacgatattttgcattagagataaaggtaatttgattagaagttgctttatctaaaggagcaatgcttaaaatagccaaatcggcgttaccctttagagtaccgccgatctgctccgctaattcaattaaacggaattcagccattattttttcacttcttctggttttgtgacttccgctgcaggcacttcagtttttggagcctctggcatttttccacccattgcaactagaatttcttctgtaatatctgctgcatttccatctttagcatataatgcgaccgatggaggaagaactaaagtatagcctttagattccgcgacttgtttaattttcgcattaatatcttcaacgactttttgttgtacttgttcaggagttattacaccagattctttttgtaccttagcaatttcttcttggaaagccgctactttcttttgaaactcatcagcacgtttttggaactcttctgctttttttccaaattctacttcacgttgttgcaatgcagaaactttattttggaatggtttagcttctgcgttaattttatcctgacgtgcttggatctctttcgcttttaacctaggtgcatctttttcaagttgggctacctttttcttcattgcagcttctaaggttacttgttctttttgtaacttctgtgcatcttcttcaatttttttacgctcatccaataatgctttttcttcatcagataatgctttattttctgctgctaattgtttttcccttggtgcaaatttagattcagtgtctttcataaatttagtgaatttatcatttgcttcaatggtaagtggatgattttgtatcaagaaattaggatcaacaaatccaattttttcatttgcatttactgtattcgcactaaaagctaaagctgaagcaactgcggcaagtttaaataaatttttcattaaaatgtcctttctgaagttaggaaagatagactcgtaaaaaaatgaacaaatctatccgcttgtttataagattagaatgaaccaccaatgctaaattggaactgttcaatttcatcaccttgatattttttaattggtttcgcataagaaaataccaatggacctatcggggaattccattggaatgcgatacctgtagatgcacgaaaacgtttataatctttaaagttttctaaactagaataattatattgaatgtcgtttactactggattagttttccattttgtattcaacactgttgcagcgtccacaaataatgaagttcttacattatgttgatatttttcacttacaaatggtgttggagtaattaattctaaagttgcagatgccattgcattaccgccaacaatatctctatttacggaattgaatccgatattaccattgttatctttacccagatagattgcttttggtccaatagctccataagcaaaacctctcagagagccgatacctcctgcagtataagtttgatagaatggtaattctttaccactaaaaccatttgcataagcaatattcgctttagttgagataacccacttatgttcgcgattgactggtaaatagtttttaaaatcaatactaactttataatacttattgtctgaacctggtgtggtaatacgtccactaatgcttgtcaaagtcccttctgttgggagaaaacctcgatttagactattatagttccaaccaaaagaaaaatcgaagtcatttgctttaatttttttatagacatttaagtcattatcaatcgggaatttcatggattgtacataaagttcacgattaaattcacgtcgagcattcttaatcagatcttgagtgtagcctagaccaaggaaataggagttgtattcatttacagggaatcctaaagtactattgactccataggtttgtcgtttataacttgcgacactattattttttgaattatcataatcctcgtagaagatatttccaccaaggcttactccatccttagtaaagtatggttcagtataccctaaattgatacttgtaccatagtcattacgggtaccatttaaactaattgtagagcccatacctaagaaattatcctgttttatcccagcttgataacttaaaccactttctgttccataaccaacaccgaaattaatacttcctgtattgcgctcttttattttatatacaatatcaacttgatccgccgtatttgggacatttggatagctcatttctacactatcgtaaaaccccgttctttctagacgagccttccccaaagcagctagacttgttgacaaccatgctccttcttgctgacgcatttctcgacgtaacgttgaatctgcagtcacatcatttccttcaaaacgaatctgtcttacataaacacgttgtccagcatccacaacaaatgtgagacgaattgttttatttgtatcatcgaaggttggatgaagctctattttagcggaagcaaaaccattatttccaaatacttgtttaatattgtcttcaatttttgaaagttcatttttgctaaagagctcgcctgttttataatatttgagctgttcatttaactcgttgtctaattttgcagtattaccaacaatacgtatttcacttacagtataaggtattccttcattgattttatatgttaaagatacttcttttttatcatcactaaatacgggttgttcagcttcaacattaaattttgcatatccttggttcatgtagaaattacgtagattttctaaatcttgattgtatgctgtttgttcaaatttactactttgaaaaatattgaaccaagaaacatcaggttgaatatccagttgtttcattaatacttttgatgtaaaagcttgatttccttcaaaattaatagcttttacataggcaacatctccctcttttatatctaatttaatatttacacctccattgtctgagtttgttataacagtatcaatggtagcattgtaacgacctatagagtggtaatgctcaatgagtgctgatttaaatgcgtctaactttgtagaattaaataattctcctttagtgatgagattcgcttttagattttgttccagtggctccttggggattgcagaattaccttcaatatcaacattattgatgactggattctctaccactttaataattaaaatatctccttcacgggttgcactaatattttgaaaacgattttgtacaaataaatgacgaataacgtttgcaatatcattatcagtcgctagttgtcctacttttacaggtaatgtagggatcattgtttggcttacagatgtttggataccatcaatacgaatatctttgatcacaaaaggtgaagcaaaagcaacgccatttgcaactaataatgttgaaagtaatagttttttcatttaaatgatcctattcgttggtaaaataatataaatatctaaccacttgactaaaagtggattaaatcattaaacaatgcaaatagcattaaccctacgacaaacatacccccaatctgctgaaaacgcagttggaatgcctcaggtacaggttttctacgaaccgcttccccagtgagtaaaactaattgcccaccatctaaaggcaaaatagggaacagattcatcactgcaaggttaacacttatcaatgccataaatcctaagtaatagacaaaaccaatttcagccgttgccccagccccttttgccattgaaattgggccgcccatattacttagagaaagctcgcctgtaattaaatttccaataaactgtaaaatcgtataacttaatgatacgactttttctaagctctttccaaaggcggaaagaatatcatactttaattcacttcgatactttgattctaatggttgatacgttggcactaagcctattaaataacgctcatcttcctttgaatattcaggctgcaactgaaaagctaattgctggttattccgttcaatcgtcaaatcaataatattacctgtttgcacctgctctaacaaatatcgccattcaaaaggttgctgattaacagaaataattttatcgccagctaaaatccctgatcttgccgaaaccgaattttcgactacatttttaataattggttcaaccgtcgcacttttaggacgaatacctaaagtagttaacggattttccttatttccatcaacattccaatttctcaaatctagcgtaaattgacgagaaatattttcatcaatatggttgccttcaataacaacttcagcttctccaatcttgcccaacaaagctagggtaacatcttcccaatcttgaacggaacggttatctaccgttttaatttccaattctgtttccagctttgcataagctgcaatagaatctggaatcacagatccgatcactggcttaaccgttggaaccccaacattaaacaccgcccaatacgccaaaatcgcaaataaaaaattcgccactggacctgcaagaacgataaaagcacgttgcaaaacagactttgtatgtaaagattgcgaatctggtaattgatgttctgcttcaccattgtgcatttgcacatagccacctaaaggaatgagtgaaaatgcaaattcagtcccttgtttatctttcttacgccataatacttttccaaaaccaatagaaaaacgtagaacctttacgccacattttcgcgctgcccaaaaatgcccgtattcgtgtacgaataccaacacgcagatcagaataaaaaaggcgagcattgaagtcattgcgctaccctataggaaaaagaaaaagccgatagcaaaaataggcacggcggccgttaaactatcaatacgatccaaaataccgccgtgacctggaattaaattactgctatctttaatgcctacttggcgtttaaacatactttcgctcaagtcgcctaaaatcgagatcgctaccgtaataactgaaagtacaacaaatgcagaagtatttaactcacgcccaaacacatttgcaggcactacacttaagaaaatcgttgcaataacagcagaagttatcacaccaccaatcgccccttcccaagatttacttggtgacactttaggtgcaagtttatgtttaccgaatgcacgccctgaaaaataagccccagagtcagccccccaaactagcaagaaaacatagagtaataaataagtgccttgatattgatcgagattatattgatagaaacgtaaagcaagagtcccaatcaaaaatggaattaaggtgcaaaaaccaaaaataaacttagccaccactgatttagcccaaacatctgctgattttggatagctaacaaccaaagctgatgcaaccaaccaccaaaaaccgccaataaagagcaaaggtgtcgtttcatcagtcaaaaaacgtgtagcttgaatataacttgttccagccataataggaaaaatcaataaacaggtcaccacaaaagcaacgatagcacgcgctattggacgtttgaaacctgcaaattgcgcccattcccacatacctaacacaacaatagcggataagccaatcgtaaaagctaagggtgaaagccaaaacagtgcaaccactgctaaaataatcatcactattgccgaaagaatgcgttctttaagcattgaattttccttatagattaacaaccaccaaaacggcgatcacgttgttgataagcaataatggcatctgtaaatgccttttcatcaaaatcaggccataaaactgggctaaacactaactcggcataagcaatttgccataataaaaaattactgattcgctgctcaccgctagtacgaattaataaatcaacctgtggctgatcttcagtcactaaatgacgttgaaaataatcaggagtaatctcatcaacggaaagttcaccattttttacttgtaatgcaatctgcttagttgcttgggtaatatcccaatacccaccataattcccagcaatatttaacattagacctgtattattcgcagttaatgcttccgattgagcaatacgattttgcaaactttcactaagggctgatttatcaccaataatcttgagtcgaatattatttttatgtaacttcttgacttcgtaatctaacgctttcataaacaccgtcattaatgcggacacttcggctttaggtcttgaccaattttcgctactaaatgcgtagagcgttagtaccttaatgccatgtttagctgcaaaatttatcgcagaacgtaccgcttttacaccattttgatgcccaaatatgcgtaatttcccttgttgttttgcccaacgcccattaccgtccataataattgcaacgtgttgaggcattaattgaggttcaatatccacagaaatatccactttatgattaaaaataaatcagtttaaaggcaatgtatgcctataatcaaaataactacaactataccataggatagaagattggggaatctacctttaaaaattatccttttgtttccttagactaataaactcatctaaagtcaccgcttgcataaatggattaatctgtttttcaacaccaatcgtactcggtagcgttggtttatgttgtgaacgcaaaatatccgctcgctcttgatgttccattaaactacagcttgttgccattaccgcttcggcaaatttcaaattgctttgagtatattcgtgaccagcatagactttcacaaaatcaggcaaggctttaaaacgttgtagggcatcaaactgagcttggtaatcccctgtaaacactctcccacaaccgcctgaaaataacgcatcaccacaaaagagatattcattatcaaccaaatagctaatatgttgcgccgtatgccctgcactctcaatcactcgcacctttaaccctaacagttcaaactgttgctcagggtaaacaatctgattggcaaattggctcacttcttctgagccataaataagcatatcgggaaattgtgccactaaaccagccacgccatcagtatgatcgtgatgattatgggtaagcaaaatagcggtgggattaagctgatgttttgcaagaaaagcgaatacagcttgagcctctgctggatcgacaataatcgcttggcactctttttgtaaaatccaaatgtaattatcagaaagggctggaattggggtgatttgaagcatatttattttccgtaggtcgggcatttatgcccgacattgccgtgttttatgaaaaattgtcgggcataaatgcctgctttgccatattttatgaaaaattgtcgggtataaatgcctaactttgcggtattttataaatgattgtcgggcataaatgcccgacctactatttcaagaataacgctgccgccccacgcacaccgcttgagtcaccgtggatcgcttttttaatcactggcacttccgtattacgcaataaatattttggtaaggcttttggcaagacttcataaatataatcaaagttagacaaaccaccaccaaacacaatcatatctggatcaagtaccgtaatataatttgccaccgaaattgccattaactcaatgtatttctcaacaaactcaacggttttctcatctttatcgtaaaaacgctgaataatgttttttgcatcaactttttcgccgactaaatcattataaagcatctcaaaaccacgtcctgagatatagctatccaaacaagccatattaccacagccacatttataaatcggtgccttatcccaaccaagcaatttcaacgcgtgatagttaagctgaatatgccccacttcgccagccataccgatttgacctgagtgagctttaccgttcaacacaataccgccaccaaaacctgtaccaataatcaaccctaacaccgttgaatattgcagattgctttcgtcccacgcttccgataaagccaagcagttcgcatcgttttcaacacgcacttcacgccctaaacgtgcttccaaatcttgaataattttattgccgtgaaccaccgcaatgttggcaatttccgctaacccagttttatgattaacaaaacctggtacaccaagccccacagtgccgtgctcgccaaattttgcatcggcattacgcactaaggtttccactgttcttaaccaatcctcataactcgtttgtggggttggcactcgctcgctgtgtaacttctctaatttctcattaaaggcagccaattcaatttttgtaccgccaatatccaaaccgtaataaaccatagttagcctcgctttttaaataatgtccatttttctaagagtgggattacccataagaagatgatcaagtggaaaacccacgcaatcaaagtactgacaaacagatcgataggataatgcattcctaaccgcaaacggctgatcaacatcaaaccagcccacaaaatcacaaaaaattgagcaaaaatcaccgcttgtccacgaataccaaacagcaaccctgcaaacatcaatagccaagataccccaaaaatcgtatgccctgacgggaaagagtagcccagctcatctgcttgatgttcaaccacaaactgattttcaggttgcacaaatttcaataccgccgtttcctgttcagctttaggtaaagcataaaatgcctcagtatccgcctgaaacatctgtgtcacaaaaggacgaggctctttaaagaccgctttcgccccctctttaattgcctgtgttccaactaccgacgttgcacaaataaagcctactaaaaaccacgaatagcgagtgcgcgcaagccacatcagccacaacataaacagcacgcaagtgattaacgcataaggcgttgaacccgtttccgttaaaataaacaacgcccaatcgaaaacattaacaccaagattagtttgcaaattccattgccacccaattaaccacgctgtagctggaatgaacaacattaataacgtcaaaaatgaaagtttctttaccatattataaatcctatgcaatattaaattgtattcattaaaaaactacgtgatatacctgtaaaataaatagaatgtttctgtaatataatgaataattagcacctgcttactaaaaggtagagtcccaccacccctactgattgttatgtgctacccccaatggtttcttattgctgacttctaattaagctcaacagatatattctagtctgtttattctaatttcgactaccacattatgactattgtgaagaaaatctaaggcgcagaagtaaaatatgaaaaagaaattactccattaaccctaccattgcttgtgctttgcggtcaatttcttgccattctgattgaggatcagatttttcgacaattcctgcccctgcataaaaggtaatttgattagcttgaataagggctgaacgtaacattacgcaaaactcggcttgttcgggcgtgaaatagcctaatgcccctgcataccagccccgctcaaaacattcctgttgttgaataaactgcttcgccttagggcgtggcagtcctgcgacggcggcggttgggtgaatacgagcaaggcaatctgcgtcgctgacctgctctgtcagttgcgtttggatttttcggcgtaaatgctgcacgttatgtaaccgcttgatctctgcatcgctgacttgaatatccgttgcacaatcagccagatgactacaaatatcgtccacgaccagccaattttcatagatatttttttgatcgttgagtagccatagggcattttgttccgtttgaacaggatcgtccgtcactgccactgtgccagctagagcttcggtaaaaaattgacgttgttggcgtaaatagagccgttcgggtgttgagccgataaaggcttccccttgtttttccgaccataagaaatgataacagcctagatttttttgttggctggcaaaaagcagaacgtagggggaaatgaggtgtgtaaaagttttggtggtcgcattggctaacaccactttattcatttgctgttgttgaatttgttcaatcgctaattcaatgttgtgttgccaacgtgaaaaatcacaggcaacttttgtgcttaacaagctattttcaatggggtgaagttcggctgtctgctcaaactgagctaacaaagcgatacattccttttgttcgctttcaaaatggcgaccatctagatttaaccaagcggtgatgttcttctcattttttactaacagcaagcgtggcaacacaaaatggcattgtccttcaaattctattcctccgacgaccattaaatcagactgtttgctaaattgttctacgtcgtctaaatgctcaaaggtttgtaccgcaccgactgccactatcgtttgttctgtatctcgattttgccagtagtagtgggggaaaagcggttgtgcttttagccaagctagtaattgttgattttcaaggtctattgcaatttctgcttgcaactgtactaagccttgtgccacaggcttttgttgtagttgttgataaagttgttgctttaactgactaaacacagacattgcaaaaaatcctaaaaatctcaccgcttgacaaaaaagaagtctattttagcctatttccacttttttttcctaacaaatcggagtacagtagagagatttttataaattaacagataattaaccctctattttagggagaaacaatggaacgctttgcaaaaaccgataaattagctcacgtccgctacgatattcgtgggcctatacataaggaagcgacccgtctggaagaagaagggcataagattttaaaattaaacattggtaacccagccccattcggttttgaagcccctgcggaaattttagttgatgttattcgtaacttaccaaccgctcaaggctattgcgactctaagggtttgtactctgctcgtaaggcgattgtgcaatattatcaattaaaaggtatgcgtgatttagatgtcggtgatgtttacattggtaacggcgtatctgaactcatcacaatgtcaatgcaagccttgttaaatgatggcgatgagattttaattccgatgccagattatccactttggacagcggcggcaacccttgcaggcggtaaagcggttcattatctttgcgatgaagaaaatgagtggttcccagatattgaagatattaaatcgaaaatcaccccaagaaccaaagcaattttggtgattaacccgaataacccaacgggagcagtgtatagccgtcagttattattggatattgtggcgattgcccgtgaacataacttgattattttctcagacgaaatttacgagaaaattgtctatgacggtgcggtacatcatcatcttgcccctcttgcccctgatcttttaacggtgacttataatggtttgtcaaaggcataccgtgtggcaggtttccgtcaaggttggatggtgttaaacggtccgaaaaatcaggcaaaaggctttattgaaggcttagatatgcttgcgtcaatgcgtttatgtgccaacaccccgatgcaacacgctattcaaacagcgttaggcggttatcaaagcattaacgaatttatcttaccgggtggtcgtttattggaacaacgtaataaggctcacgaattgctcaccaaaatcccagggattagctgtgtgaaaccaaaaggggcgatgtatatgttcccgaaaattgatacggaaatgtacggtatcaaagacgatcaaaaatttgtttacgatctgcttcaacaggaaaaagtgttgctggttcaaggctcaggctttaactggcataaaccagaccacttccgtgtggtgacattgccgtatgttgatcagctggaagaagcgattggacgattagcgaagtttttgcagagttatcgtcaggattaattaagcatttccacttgaaatatgtagggacacactgcgtgtgtccgtgcatttatatctgtctatatttcggatacactagtttcggacacacgcagtgtgtcccttgtatattaaaattatagtaaactagcaacataaaccataacgttatccacagcttgggtgtccctagagctaaaactcgttctgtagcgtaggcgtggataacttcatcagcaaaaccgaacagttgaaatataaacccgaatacaaggcaggttaccgatgaacgctccgatttattgtggtattgatgttgctaaacgcaatttcgtgattggtttttcccatcagaaaaagaccaaaaccgaaaccaataacgccaaaggtattcaacataccttggactatttaagccagtttaatgtggctctgataacgcttgaagcaacgggtggattagaaattcccgtggcaaaagcccttgctcgagcaggttatcgtgtatttattgctaatccactgaaagccagtgagtttgcaaaatctcaaacgagagccaaaaccgatgcaaaagatgcggttaatctcgctttctatgggctcacttgtgagcttaaaggcgaagtagagcatcagttgtatgttccgctttctgagcaagaagaacagctggaagcccttgtggttcgccgtcgtcagcttgtggatatgcgagtagcagagctaaatcgtttgcaacaaagccacgaaacccagttggacaatatccaacaacacattgaaatgcttgataaattaatcgccgaacttgataaagatatcgacgaccaaagtaagcattttagtgataaagctgaccttatctcagacatcaaaggcgttggcaaaaattgcgtcgccgtgatgatgtcaagcctgccggaattaggcaagctaagcagcaaaagaattgcctcactcgttggcgttattccgcatccacaggaaagcggtcaatggaaaggaaaatccttttgctatggtggtcgagcgattgttcgtaatgccttatatatggcagcactatcggcaattcgctttgaacctgtttttaaagccttttacacccgattggttgcaaaaggcaaagcgaagaaagtcgctattatggcgtgtgtgcgtaaactgctaaccattatgaatgcgttggttagacgcaatgaaaaatgggacgctacacgctacttatccacagaatctgtgggtcaaaattgaataacttttttgtgtgtaaacacagttgctacgggtatgtttttaatgataaaaggtatcacattttccgtcaccgcctctattttattcggtgtactctattatttatccacccatttaaaaccactttctggtgaagaaatttacggttttagaatgtgggtaagcctgccttttgtgatttctgcactctttattttcaaaaaaaacgacgaatttaaccgctatttaaaacgcctaaaacagcacccccatttaattttggtattattaacaactactgcggtcacaggctcgcagatgtggctttttctgtatgccccaaacaacggttatgccattgatgtgtctattggttatctgttaatgccgattgcaatggttgccgttgggcgatttttatttaatgaaaccttatctctcttaaaaattatctcaattatttccgcatctgttggagtgttcattacgttaatgaccgcaggctcactctcttgggctacctcaatggtattaatcggctaccctgtttatttcagtttgcgtaaacattttgatatgtcgcatttatccagctttgtctgcgaaattatattaatgttgccgatagccacttattttatgctcaataccgatatgcaatttgtcaccgaaaataatccgaatttttatttttggttagtgttattaggcattgtcagtggtacggcattaattggctatataatggcaagtagccttgtgccgattaatgttttgggattattaagctatattgaaccgcttgcaatgctaattgttgcttttattattggcgaagtgttagatcaatcttcctatattttaatggcgtgtttgatgctgtcgatatgtctattagtgcttgatggcattattactattcgtaaacagcgtcggagggaataatgttaaaagggatcttattttcactttctgcaaatatcttattcggtgctggctattattttgcggttttacttcgccctttagaaagcgatagtatttttggctttcgtattgtagtattaatgccatttattttactggcgatctttttatttcatcaacaaaaagcctttaaagatttatattatagagtaaaacagacaccttatcttatttttattcttctgctcttagcattaaatacagctattcagctttggttatttctctgggcaccgaataataatcaagctattgaagtttctatcggttatctattattaccgattgtcgccgttgctttaggcaaactggtttttaaagagcattttactttattaaaatggcttgctttattttttgcaactattggtgtcacaattaatatctttttaaccgcaagtatttcgtgggcaacttttgttgccggttttggctaccctatttatattgtcttacgtcgctattttcatattaataatttagccactttctttgtagaattattattgttattaccctttgccatttattatattgctcaagttgatcaagcctctattttaatgcaaaatgaatatctctatttttatctagcattattagggctagtaaatggaatggcatttattttatatatcgcttcaagtaatttactgccgattaatgtattaggcttgcttggctatgccgaacctttggtgatgttatttatttcctttgccattggtgaagtattagaagcaaaatcctatattttaatggcgtgtttggcggtatccattatcttattaagtgttgatagttttcgcaaagtgaaaccctaatgaacctcatccgaattgctctacctgtgccgttggcacgttatttcgattacctgcttccaacgcattttgaaaatgtggtgaagggggctagggttgttgtgccttttggtcgccagcgtaaaatcgggattgtggtggatttcccaaccacatcagatattcccaccgaaaaactgaaaccgattgagcaactgttagatgaacaagctctgtttgacactgaaatgtggcaacttttacagtgggcaagccgttattatcacgcccctttcggcgaagtgctacaaagtgctttgcctgtcaaactacgacaaggggaaagtagtgaacgcactgctcccgactattttgttgtcacggaaaacggcagaaaagctctatccaacggcgtggttcaaaaggcaaaaaaacaacaagagctattaagcaaactggcggaatttgcaaatttctttgaaaaaccgaccgcttgtagccctgcggtatggaaagctttgtttgaaaaagggtatctggaaaagctggaaatcccttttaacgtgcaaagctggcaggaaaaattaggcgaacagccgatttgcaacactcaaaaccgtttaacgttgaataaacagcagacccttgtcgtcagccgtttgcattatcaacaaggcttcggagcgtttttgctcaatggggtcactggctcagggaaaacggaagtctatctgcaagtgatcgaagaagtgctgaaacggggcgagcaagtgttggtgcttgtgcctgaaatcgggctgaccccacaaactattcaacgtttccaagctcgttttaacgtggaaattgacgcattgcattcgcatcttaacgacactcaacggctcaatgcgtggcttcgagcaaaaaacggcgaaagtgcaattgtgatcggcacacgttccgccttgttcacccagtttcagcaacttggcttaatcattattgatgaagaacacgatggctcgttcaaacagcaagacggctggcgttatcacgcacgggatttggcggtgcttcgagcgaaaaataacaacattccgattattctcggctcggcaacgccaagttttgaaagtttgcaaaatgtgcaaaacggtaaatttatcgaacttcagcttactgcaagggctggtaatgcacatttttccaaacaaaccttaattgatttgaaaaaacagcggatttattcgggcttatcggaaaagttgttagcaatgatgcaagctcacttggaaaaaggcaatcaagtgatgttgtttttaaaccgacgggggtttgcccctgttttactttgccacgaatgtggctggattgccgattgcccgtcctgtgataagccctttacctatcaccaaaaacagcgagtattgcgttgccatcactgtgcttcgcaaaaagccattccacgtcagtgcggacattgtggctcagtcaatttgattaccacagggatcggcacggaacagctggaacaagtgctggcacagcgttttccgcaatacagcattactcgtattgaccgtgacagcactgcccgtaaaggctcgttggaacaacaccttgccgaaatccaagcaggcaaaagccaaattttgatcggcacacagatgttagccaaaggacaccatttcccgaatgtgactttagtcgccatcgtgaatgtggatagtagcctgttttccaccgattaccgtgcagaagaacgtttggcacagctttatgtacaagtgtcagggcgagcaggacgggcggaaaagcaaggggaagtagtgttacaaacgcattaccccgatcacccgttactcaccagcttactcaacgacggctaccttgcctttgccagccaagccttagcaatgcgaaaaataatgagcctaccgccgttttcttcgcaagtgcttattcgtgcaacgggtagagataacgacaaagttgcaaattttctgcaagatttgaccgcttgtttacaccaaattatcagcgaaaacggctggcaaggctttcagttacttgggcctttcaacgccccgatggcaaaaaaagcagggcattatcgctggcagttattaattcaacattcggcaagaagtgcgatccaacagttgttagatcgttttgatgagcaaaaagaacagttcctgcgaaacgatattcgactgacggtggatattgatccgcaggagttggggtaggttattgtgacctttgagcttatttagccattctaaaaactattggctaacagtatttaaccaagtatttatccagcgctttatctcactgttatcaggaagagtgaaacttatagtttgataagttggcaatgtgttaaataaaggatctgccttagtagtcacaacaggcttcattacattatagtaagaaataattcgttgcgattctggttgttgtaggaagcttagaaactgttgagctaatttgagttgtctgctgctctttgtgattgcggctacttccacctgcactaaatgtccttctgcaaaatctgccgcgacgtatttatccgtctgttcgtgccattgatgatatagcggagatgttgtataactcaacaccaaatctgcttcgtttttcaaaaatgcaccataagtttcagaccagccttttcccacagtgacggtatgtttggctaaattctgccacgctgattctgcctgttcgccataaacttgatttacccaaaagagcaatcctcgtccaacggtgctagttctaggatcttgataaatcactttaagatcttggcgttcaacaagttcttttaaactttttggtggattactgactttttctttgttgtagataaaagcatattctccaaaatcatagggtaaaaatattttgcttcgccattcaagcggtaagttattggcattgttttgcagattgtgttctacaaataagcctgatttttcagcttcgggcattaagaaatgatcgatacctaacattacatcggctttagtcttatttttttccaaacgaatacgattgaacattgttaccccatcttcaaaaggcataaatttcaaatcgcattggcattgtttttcaaatagcgcttcaagtttagcagcaggcccccattttgaagcaaaagaatcataggtataaaccgtgagtgttggctgttgagcaaaagtggtggttgcaacggctaacgcagaaagggtgaaaagattgaatttcattgaatattccttctaaaagtgaaaatagaaggatctaaaacaggcggatatagattgtctgtctcaaatccctacgctgatattagtcagatcaggttctatgggtatttctcagccttgctatacaaagcaccccgatgagaacagaggtattctactataattttgtgctaagatcacttaaaatatggcgaattttaaaagtcgctgagaatcagtacaaaatagaggaaatcctttgaacgaacttattttcactcttgagcctcaagacaatgctcgtcttcaatcgttatgcggttcttttgacgagcatcttacccttattgaaaaaagttttaaccttattgttgcgcgtaatgcatttacctttactattcaagcagttgaagaaaatcattattctgcaacattattaaaaaattgtgcgaaattaattcagcaactttacaacgaaactgctccaattaaaggaaaagtaaaagaactagatttggaagatgttcatttagcgattcaagaaagccgaatgttgttgcaaaatcagtggacaagttcggctcatgaaattgcaattaaaacaaaacgcggcgtaattaaaccacgtggcgaacatcaacaagcctatttacgtaatattctaagtcacgatattagctttggtattgggcctgcaggaacgggaaaaacctttttagctgttgctgcagcagtagagtctcttgagcgccaagagattcgccgtattttgctcactcgtcccgcagtggaagctggtgagaagctcggttttttaccaggggatctagggcaaaaaatcgagccttatcttcgaccactttacgatgcactgtttgaaatgttaggtttcgagaaggcacaaaagctgatggagcgaaatgtgatcgaaatcgcaccgcttgcatatatgcgtgggcgaacactgaatgatgcctttattattttagatgaaagccaaaatacaaccattgagcagatgaagatgtttttaactcgtattggtttcaattctaaagcagtcattacgggcgatattactcaagtggatttaccgcgtagccaaaaatctggcttaaaacacgcaatggaagtattaaaagaggttccagagttaagttttaacttttttgacagtaaggatattgttcgccaccctgtcgttgcaaaaattgttcaagcttatgatgtatgggaagcagaagatgaggctaaccgagaaaaaaagaaattagaaaaattaataaaagagcaagataaaatcctagaacaagcagaagaattataaatatacgttataaagtataaccataattttaggtgtaatagacaaaacatactgaattaaatatagaaaagacgacaaatcgtttagagggattatttagtgaacttaagcgaaaattaaataatcacaatgaattaacgaaaaagcgtaacatgttgtttatacagggtttttttaaataaaaagagttgctaacatttagagaaaataaacattagcagaccctatcccaaattctgtgtaaacacccatttcaacttaacggtgatcgtctaggcgatcaccaaaatcaatcataaatcgattcatcgccagtttccagttctgaatcggcattgtccatttttttgatgcatctttaatcgcaagccaaatcactttgaaaactgaatcatccgtcgggaatacatttcgttttttaatcacacgacgaatcacgctattaagcgattccacagcattcgtggtataaatcgctttacgaatatcagccggataatcaaaaaatgtggcaatatttgcccagttatcttcccagcctttcgccacaagcgggtattttgcctgccatttttgcgaaagtgcggtcagattttcgcgagcctgtgcttccgtcggggcctgataaacctgctttaaatctgcggtgacggctttgtaatctttccacgaaacgaatttcaagctgttacgcactaaatgcacaatgcaaagctgaattttcgttttagataaccaagatggtcggtcagttcatcatttaacgcggcctcgacggtaattttcttgagcatccgtgaaaattgattgaggtcttctggtgtttttaggtttttggcaaattccgctgccaaggcgtgaagttgtttttcgttcataataaaatacctgtgtctgaatgtattatctcagaaacaggtatttacacaaattgtgggagaggctccattagcaaccattttgtctactatgcctattcttgggacaacagttttatctactatccttttttatacttacatcatcattcatttatacagataataaacttgccagcccaataaccaacacaaaaatagctaaccaaatcaagtgaagtttgacgcttttgcggtttatctcttgattatgtaaatggcgttgttctagcttttgtttataaatttccaaatcagcttcattgaacgagaagccacaatgtgggcaagtaacggcactttcactgatttttttacggcattcggggcaacgatgtaaagccattgtaattcctactttgatataaactgaataagatgtttgacaaatgcacttgggttttcacaatgggtgttatgtcctgcatttgcaatttgatgataggggagctgatgttgttctgccatttgacgaaatttactatctttctctcctataataaatagcatttttccgtgaaactgacgacgttgttcaggggaaaaatagggttgcgttgcaaggctagtggctttgagcatttgagctagtgcttgcccgtgattatttagcctttttttgatgaaatctgtccgcttgctttcgcttaaattggcaaaaacaggctgtcgataccaatcttctaaaacatttccaagcggttcattacttaggcgatctgcccaatggcaatcattttgccaacgtgcttttttgtcttcatcgctgattaagccgatatttgccccttcgagcaggatccctttaagataaggattttgggttgtgagggcgtaatctaaagctagtctaccgcctaatgaatagccgacaagatagaaagtctgttcagcaagatgttgttgcaaggtgaagtgaagctgttctctagcttgttgaaaactgtggcacgagatagcttggctttgaccgtgaccagcaagatcaagagtaagcggttggattgcaatcgtattttgcaagagcgagaggacaggttgccaatcttgttgagaaccaagaaatccgtggagaaagaccacgggggttcctgaatgactgtgccacgttgttgctaacattagtcgatagaagcacgagagatctgttcaatcaaggatttataaaggctactaccttcctgatcattcaccttgatttccacaatagtaacacctcgacgagcataggcttgtttaagttttgtgcccaaatccgcccaagtataaggacggagatattctaagccgaacattgtcgcaatctgtgaaaactcaagactatggctaagacggtagaatttatctttcgctttttgatcgacaggaagcatatcaaaaattgcaccgccattattattaataacaaataaaatggtcggttggctaatctgacgtaaaagcgaaacagagttcagatcgtgtaaggcggaaatatccccaatcactgcaacagtcggctgtccgctaccttttgcaatacctgcaagggttgcaattaatccatcaataccgcttgcacctcgattggtatagatcggataaccttctggcaatttacacaaagcatcaactaagcggacaaataaactatttccaataaataaattaccattagctggcaatacacgttcgatatgatgtgctagagaagcttcattgagattgccacccacttgctgttcaataaaggtttcacagaattgagaaagagccaaaggttccaacagccacggtttttgacgaagtggcgggtgaacacgggtaaagtggtgagcttttgccacaaaacgcgtttgttgatgagcataggtgttaagataatctgtcgtttcctcaaccagccagaattcgcctttaaaagccgataaaaattgattaactcgcttgctcacaatctgtgagccaaactgaataacaatgtccgcctgtaataaacgttgttctactgttttgtttgacagccaaatgtctgcataaggtagagatgcatcaaccccagattgcacatcgctgatcaaacaccagccaagcgtttccgcccacagttttaatcccattccctgctcaagcggtaacttacctactacaattaccccacgtttggttcgccaataatcccaattttcgtgcatcaacacatcttgttgggttgcttgttgatcgtaccatttcacttgaggtttattcagccaaccttgaatagcgtgcaaccacggatcttgtccaatgctttcctcatcagcttcataaagaggctctgcaaatggcacattaatatggataacaccacctttttgagcttgtttagaacaggcttgctctacacgaccaactaaccagcttgcactatattgcgaacttggttttggtaaattgagatttgcaatgggataatgactaaaaatatgttgctgttcaatcgcttgattggccccacagccgatcagctcaagggggcgatctgcggaaagcacgataagtttatggtgtgtgatactcgcctcgatcaccgcagggtaaagattagagaccgcagttccagaagttacaataattgcaacgggatcttgcgttgcttttgcaagtcctagtgcaaaaaagcctaaaccacgctcatcaaaatggctatggcattcagcttgaccttgtttttgcagatgtaatgcttcaagggttaaaggcgttgagcgtgaacctggggcaatacaaatatgttttacgccgtagcggagtaaagcatttaaaataactcgtgaccaagaacggttaaaagtgctgatgtttgtcattattcatctctttgcaaatggaatgtgagtggatagattgtagcaaaattttgtaaaaaattgagagagtttcaacgcttgtaatgcatatttttgtaattttaatttccatttgtactgtaagtatatagttaaagaataaaccgacttaaatcttcattctcaaccacatcattcaacgcatcagacacatacttctcgtcaattacgattttctcgcctgaacgttcgctggcatcgaatgaaatactgtccattaggcgttctaacacggtatgtaaacgtcttgcaccgatgttttcggttttttcgttcactcggaatgcggattcggcgatacggctgataccatctttggtaaactcaatatccacgccttcggttttcattaactcacgatattgtaaggttaaagatgcattcggctcggttaaaatacgctcgaaatcttctttattaagtgatttaagctctacacgaattggtaaacgaccttgtaattctggcagtaaatcagacggacgagccacttggaaggcaccagaacagataaagagaatgtgatcggttttgaccataccgtgtttagtattgactgtcgaaccttcgataatcggcagtaaatcacgttgcacaccttcacgagaaacatcaccgccactgtgttcgccttttttacagattttatcaatctcatcaataaagacgataccgtgttgttcaaccgcttcaatcgcttgctgtttcaactcttcaggattaaccagcttcgccgcttcttcgtccaccatcacttttaacgcatctttaattttcattttgcgttttttcgttttgtttggcgacattccctcaaagagagattgcagttgagaagtcatctcttccatacccggtggagtcataatttcaacgctcacttgggctgcgacatcaatttcaatctctttatcgtcaagctgaccttcacgcaattttttgcggaagatttggcgagtagaagtgttatcgctctcttgcacgtttccccactgatctttcgctggcggtaataacacatctaaaatgcgatcttccgctgcatcttgcgcacgcatacggtttttttcgaccgcttgttggcgaaccaatttcattgaaacattagcaagatcacgaataatcgagtccacctctttacccacatagccgacttcggtaaatttcgtggcttcaactttaataaacggtgcattggcaagttttgccaaacggcgagcgatctcggttttacccacgcctgttggaccgatcatcagaatatttttcggggtcacttcttgacgcagttcttctggcaactgcatacggcgccagcggttacgcaaggcaatagctactgctcgtttagcttcattttgtccgataatatgtgcgtctaattcagacacaatttcacgaggggtcattgacatagttttattccattttgtagggacacactgtgtgtgtccgttaattcacatcaatatatttatttttggacacatgcagtgtgtccgctaatttacatcaatatatttatttttggacacacgcagtgtgtcccttgtatattaaaattatagtaaactagcaacataaaccataacgttatccacagcttgggtgtccctagagctaaaactcgttctgtagcgtaggcgtggataacttcatcagcaaaaccgaacagttgaaatataaacccgaatacaaggcaggttaccgatgaacgctccgatttattgtggtattgatgttgctaaacgcaatttcgtgattggtttttcccatcagaaaaagaccaaaaccgaaaccaataacgccaaaggtattcaacataccttggactatttaagccagtttaatgtggctctgataacgcttgaagcaacgggtggattagaaattcccgtggcaaaagcccttgctcgagcaggttatcgtgtatttattgctaatccactgaaagccagtgagtttgcaaaatctcaaacgagagccaaaaccgatgcaaaagatgcggttaatctcgctttctatgggctcacttgtgagcttaaaggcgaagtagagcatcagttgtatgttccgctttctgagcaagaagaacagctggaagcccttgtggttcgccgtcgtcagcttgtggatatgcgagtagcagagctaaatcgtttgcaacaaagccacgaaacccagttggacaatatccaacaacacattgaaatgcttgataaattaatcgccgaacttgataaagatatcgacgaccaaagtaagcattttagtgataaagctgaccttatctcagacatcaaaggcgttggcaaaaattgcgtcgccgtgatgatgtcaagcctgccggaattaggcaagctaagcagcaaaagaattgcctcactcgttggcgttattccgcatccacaggaaagcggtcaatggaaaggaaaatccttttgctatggtggtcgagcgattgttcgtaatgccttatatatggcagcactatcggcaattcgctttgaacctgtttttaaagccttttacacccgattggttgcaaaaggcaaagcgaagaaagtcgctattatggcgtgtatgcgtaaactgctaaccattatgaatgcgttggttagacgcaatgaaaaatgggacgctacacgctacttatccacagaatctgtgggtcaaaattgaataacttttttgtgtgtaaacacagttgctactatacttcttcaatcacgtgattatggttgctgtaaatatcaatatccccagcaatttttaacgcttctgccacgatttctttagcagaaagattattttccgttcttaatagggcaagagcagcagcttttgcatagttaccacctgagccgatggctaatacatcaaattcaggctcaattacatcaccactacctgaaaccagcaaaaactcactttcgtttgcgacgatcatcatcgcttctaatttgcgaagtgagcgctcggtacgccattcttttgcaagttcaaccgcagatttgactaaattcccttgatgtaattcaagttttttctcaaacagatcacgcaaaataaaggcatctgccgttgagcctgcaaagcctgttaccactttatctttatataaacggcgaactttacgcactgtacctttttctacgcaattacctaaagttgcttgtccgtcaccgccgatagcgactttgccatctttgcgaacacatacaatcgttgtcattgaaattcctatttttctaaaaaactgcgtgcatatttaagggcaatatcatcagtttcaagtgtaagcggtaatattaaccaagatttttgtaaaatgaatagaatttatcataattaggtctaaaatatacgctgtttatatttcactttataggagttcgctatgttcaaatttattaaaaacctgtttaactcagaaaaagaaacggtagaactttctctttctgccgatgaaatcgcccctaaaattatcactgcattaggtggtgcagaaaatatagaatatcttgatttctgtttaactcgattaggagttcaactaaaatcaaaagataaaattgaccgtaaaggcttaaaagcacttggtgccgcagaagtggtacaaattgttgaaaataacgtacacgttatttttggcacaaaatctgaaagctatgcgaatgcgattaatgctattttaaaaaaatagtttagagtgtctaaattaaaggggtgattaattctattcctgttggtgtttttccagagaaaagcatttcagttttatataccaacatttttaccccattatccatcccttccttaaaaatttgagcgtattttgcatcaattttcttagctatctcaaaagccttaatacctgtatgtaaaatagcaaaaaaaatgactgcctgttgcccttgctgggaaattgctatcaattctcttagatgtttttgtcctctttcagtttttgtatcagggaacattccaataccgttttcagtgagtagcgtagttgcttttacttctacaaaacagtccaacaaattttgttgttttaagaggaaatcaatgcgactattttcttgaccatacttctgttcgggtaagatttcatcgtaatctacgagttcacggatccatttattctttaatgcttcagaaacaagttggtttgctctatgtgtatttacacaaataaaatcacctgactgagtttgagtgagctcccaagtataggcatacttacgtttgaggttatttgatgttgaaaaccaaacaatgtctccaggattagcacaaccagtcatagctccagtattgggacagtgaattgtgatttgttctccgtttggaagttttacatcagctaagaaacgtttatagcgttgaattagtatgccagacgagagtgtcggaaagagcattaaaacctcttcggaaataactaggggtaattttcaaacttcggggtattaattaagtgattttttaacagaatttctcaaagagatttaacatggtgcccgaggccagacttgaactggcacgccccgaaaggcgagggattttaaatcccttgcgtctaccgattccgccactcgggcacaataatggagcgggaaacgaggctcgaactcgcgaccccgaccttggcaaggtcgtgctctaccaactgagctattcccgcatagagtaagtcatttgtgtcataatgcttttttaccctattctaattaatttaatttaactgtcaaataaaaatattaataatggttgttgtacgtttaaaattcatgcatctgtaataggatttttctattaagtgttaatgatatagtgtgggcatttatattatgactttcttaaatactgataagtagatacttgctattacaggtaaatagttaaatcatcatataagagagatgatacttatgaaacctttgtaaacatattactttttcctgatcgcgtccttttatatgctataatccaccaatttttgatagactgaatagaagatatgaccataaatttagttcaatttttaacagaaaccctcgaagggctgaaagctcaggatattcaagcgattgatgtaagagggaaatcgagcattactgaaacgatgattgtgtgtacggggacatcaagtcgtcacgttgcttctactgcagataatttgattgtggaaagtaagaaagctggtgtggacgtgtttgctcacgagggtaaagcagttgctgactggatcgtggtcgattttgggcaggcgattgtgcatattttgcaacaagatagtcgtgagatgtatcaattagaaaaactttgggtgtagatgaaaattcaattagtggcagtgggaactaaaatgcctgattgggttaccaaaggttttgaggaatatcagcgtcgttttccaaaagatatgccttttgagctgattgagatccctgcaggtaagcgtggtaagaatgcggatattaaacgcattctagagcaagaaggcaaggcgatgttggcagcttgtgggcgtgcgaaggttgtgacccttgatattcctggtaagccttggacgacagagcaactcgcccagcagttagagagctggaagaatgatgggcgtgatgtgtgtctattgattggtggtccagaggggctttcacctgaatgtaaagcggcggcagagcagagttggtcgctgtcgccattaaccttgcctcacccattagtgcgtgtggtggtggctgagagtttatatcgtgcgtggtctttgacaacaaatcacccttatcatcgagaataatggcaaatgtttggtaaattcgcaaaaccgcaaaattatgacaaggtgcgtaacgggcaagcagagttaaatctgtttgtgcgtcgcgccttgattgcgtttgtgggggtgattgctttaacaggtattttgctaacaaatctttatcatttgcaaattgttgattatgcctcttatcaaactcgttctgatggaaatcggattaagttattgcctgtgcctccgacaagggggctgatttatgaccgaaatggtaaggttttagctgaaaatttgacctattttggtttgtatattgtgccagagaagatctataacctagatcagacccttgaagaattaaaattattggtgggtttaaccgatcaagatattgagaactttcataaagagaaaaaacgtacaactcgttatactccgattttattaaagcctgatttaaccgaagagcagatggctcgttttgcggttaatcagtatcgttttccaagtatggacgttcacccttattttaaacgaaattatccttatggggatattttgacccatatcctcggttatgttgcgaagattaatgatcgggataagaaacgtttgcaagaggaagggaaatttggaaattatgcgggttcgcacgatattgggaagctgggcattgagaaattttatgaagagcagttacacggtgtaacaggttttgaggaagtggaaattaataaccgtggtaaagttattcgtaaattgcgtgatcagcctgcagtggctggaagcagtattcgtttgagccttgatattgatttgcaacgctatgtggcgaacttattggataatcagaaaggggcggtggttgttttagatccgactgacagcagtattttggcgatggtgacaaacccaagttatgacaataatctgtttgttgatggggtgtcgggtaaagattataagcagttgttagaagatcctgaccgcccattgtatagccgtgcaacacaagggacttatccacccgcttcaaccattaagccgtttatggcagtagcaggtttaacggaaggtaagattactccaaacacgacaatttatgaccctggtttttggattttacctggttctacacagcgtttccgtgactggaaaaaaggggggcacggtagaactgatgtgaatagggcgattgtcgagtcgtctgatacgtttttctatcaactcgcctatgatatggggattgataagatgtcggattggatgaagaaattcggctttggtgtgaaaacggggattgatttggctgaagagtccgtcggaattatgccaagtcgtgagtggaaacagaaacgttatagaaaatcttggttacaaggggatactatttccgtcggcattgggcaaggttattggatttcaacaccgttacagctggcaaaagcaacggcagtgctgattaacaatgggcgggtgaatacgcctcacttgatgaaagagataatgtcgagtgagcttattccttataaagatccgttgttatacgaggatatttctgatgtgccaagcctttattggcagatctcaaaactgggtatgtataacgtaattaatgcgagcaacggtactgggcgaaaagcctttgctggtactgcgtatcgagctgcaggtaaaacaggaacagctcaggtctttagtttaaacggacaaagttatgatgccaaaggtttaaaaaagaatttacacgatcacggttggtttattgggtatgctccctatgataaccctaaaattgtggtttccattattttagaaaatgcgggcggtggcggtagtaccgcagcaccgatagcaagacagattatggattatgctttgttacaccaaaccgaagctacagcaccgttgcctgtagaagaacgtgaacccccagaagcagaggaattgagtgaataaatcatcatttttaggacgattttggaagatctttgccttagatttatggctattaatcggcttgctggcaattactggctatggtttgttagtcttatatagtgcaagcggtggcagtgaaaaaatgtttaccaacagagtaatccaagtgtgtctgggtttaggggtaatgtttgtgatggcgatgttcccccctcgtttttacgaaaaagtatcaccctgcctatatgtggtttgtattattttgctgattttggttgatgtggcaggtgaaatcagtaagggcgcgcaacgttggctaaatcttggatttattcgatttcaaccctcagagattgccaaactttctgtaccgttaatggtggcaagctatttaggtaatcgttccttaccgccaaatctacgcgataccagtattgctctggcgattattattgcgccaacattattagttgcaatacagcctgatttgggtacttctattttagtttgtgccgctgggctgtttgttttatttcttgctgggttaagttggaaacttattggggctggtattgtctttctagcaggatttattccgataatgtggttttatttgatgcacgattatcaaaagacaagggtaatgacgttaattgatcccgataaagacccgctaggaacaggttatcacatcattcaatccaaaattgctattggctctggcggtattgaaggaaaaggttggatggaaggcacgcaatctcagttagattttttgcccgagccgcatacggactttatctttgcggtactcagtgaggaatttggtttaattggtgttttggtattattagctatttacctatttattatcgcaaggggattaatgattggggcaaaatctgcctcagcctttggacgaattttatcgggaggaaccgctctcttattatttgtatatgtgtttgtgaatatcggtatggtaagcggtattttacctgtagttggcgttccattgccgttgtttagttatggcggaacctcttatgttaccttaatggcagcttttggtttaatgatgtcgagttatgttcatcgtgaacgaaaagagaaaagcaatccatataaattagcagaaaaataaatattctatgattaaaaggggaatttaatgaaaataggcaaaattgttacgctattattagctgcaatgataatgtttacaccattggaaacaatggcaacaaatacaaagaaacaaacaactaaaacgcagcttatcgtaaagaaaaaatcgacaaaaaaagtaacatctaagaaaaaggtaaagaagaaagctgtaagctctaacactaaaagtacaaaaacaaccgttcctagtgataatcaaacaaaaaaactttatggggtaaaaggagcagatttagaacgcgttaaaatatcaaataatcaaaaatcctatcaagagaaggggacaacgcatacggtaatgggtaaagaagcttctcgtcagtacagcgaagttggaactgcaagttattatgcggataaattccacggacgcagaaccgcaagcggtgagatttttgataaaaatggttatactgcggctcataaaactcttgcgctgggatcttatgctttaataacaaatttacgcaatggcaaaaaagtaatagtacggattaatgatcgtgggccatttagtaaaactcgcattattgatttatctaaaggtgctgctaaagtgattggtatggtgggtgctggtacagcaaaagtacgagtggaagctatgcaggtagataaagaaggctatattattgggaaaggggcggaagcactctatcaaattgcacaacaagaagggttgaaccttaaagtgaaaggggatggtgaaacacttgccattaaagccgataccgaacctacaccgcaagcggttgtttctcagccaaaatttgtgttaaaggtcactcaacttaagaatgaacgtatggcgaaaaaagtacagaaagtgatttcgacagtgaatagccatattgtcacgaaagaaaagagatatgaagtgattattgatgtttcttcagctgaagaagctcaacacgttaaacagcagctcaaccgtttaggttacactgtattcagttattcagaaaaatagataggattttttatatgttaaaaagtaaagtactcaaaacggtcagtctatgtgctattgcttattcaagtgtgaatatggcttatgctcaagatattgattatggcattgcagccccccaacttaatgctcaaacctatattttaatggattacaattctggtgcagtattagccagtcttaatccagatcaacaccaagcacctgcaagtttaaccaaaatgatgacgagctatgtagttggtgaagccttgaaaacaggtaaaatcaaaaacagcgatttagtcaccgttaccgaaaactcttggggacaaaaattcccaggctcgtctaaaatgttcttgaatgttaatcagcaggtatccgttgaagatttgaacaaagggattatcgtcgtgtcaggtaatgacgcttgtgttgcgattgcagagcatatttcgggttcagagcaaacattcattgatagtatgaataaatttgtgcagaagtttggtttgaaaaatacgcattttgcgactgtacacggtttagaccacccagaacaatactcatcagcaagagatatggcgattatcggcgctcatatcattcgtgacttgcctgaagagtacaaaatttattcagaaaaagagtttacctacaacaaaattacccaacctaaccgcaatggcttattgtgggataaatccatcaatgtcgatggaatgaaaacaggacataccgatcaagcaggctataaccttgtagcctcagcatacaatagtaatacccgtttaatctcagtggttatgggcgtaccaacctataaagggcgtgaagtggaaagtaaaaaactgttacagtggggatttgctaactttgaaactgtcaaaccactttcagcagggcaaagcgtgcttgaacaagcggtgtattatggtgatttaagcaaagctcaactaggcacattacaagatagttacattaccgttccaaaaggtaaaacagcagaacttaaagctcgctacaccctagaaaaaacaaatttggaagctccgttagtgaaagggcaggtcgttggaaaagtgatttatcaactcaatggcaaagatgtggcgagtgttgatttacaagtaatgcacgatgttcaagaagcaggtatctttggcaaagcgtgggattggttcgttttaacggttaaaggtctgtttaattaaacccttgtaattatcagaattgccctcatttagggtgccattcaaacaagcggtgcgatcttgcaaattttttgcaaaatcacaccgctctcatattcataaaggacaataaaatgacagaaacaaaaagcgtaaatttagccgatattccacaacaaaaactcaaagatttacttgaatttccttgctcgttcacctttaaagtcgtgggtgtagctcgtgaaggtttaatcgatgatgtcgttagcgaagtacaaaaagtggttaaaggcgactataatccatctcttaaagagagtggcaaaggcacttatcactctgtatccatcactattcaagccgaaaatatcgaacaagtcgaaacactctataccgacttagccaaaattgaaggcgtgagaatggtattgtaacctatgccccaacttatcattcgccaacttggtgtgcaagattaccaagaaatttggcacaaaatgcaggattttaccgatagccgtgatgaacaaacagccgacgaaatttggctggttcagcacccgtcggtgtttactcaaggttcagccggtaaacctgagcatctgctcaatcccacgaatatccccgtggtacaatcggatcgtggtgggcagattacctatcacggtttaggacagcaaattatgtatgtgctgatcgacatcaaacgccacaagacaaaaggtaacgatttgagcgtgcgagatttggtgacagcattggaacaatgtgtagtgaaaacccttgctgattatggaattaatgcctatcccaaaccagacgcacccggggtgtatgtggacggtaagaaaatctgttcgcttggtttacgcattcgcaaaggctgttcgtttcacggactggcattgaatatccagatggatttaacaccgtttcgcaatatcaatccttgtggctatgcaggattggaaatgtgtcaattagctgattttgtcgctgaagctgaagccgattgcgacaaggtttcgcctaaattggtcgattactttacccaaattctcggctataataagcaacaaattattaacaaataggacaattatcgaatgggtacaccttttaaaatggaacgtggcgtgaaatatcgtgatgcagctaaaacgtccattattcctgttaaaaatatcgatcccaaccaagaattactgaaaaaacctgagtggatgaagattaaactgccagccaactcagcaaaaattgaaagtatcaaaaacggtatgcgtcgccacggcttgcactctgtgtgcgaagaagcctcttgcccgaacttacacgaatgttttaaccacggcacggcaacttttatgattatgggtgcaatttgtactcgtcgctgcccattctgcgatgtggctcacggcaagccgttgcctttagataaagacgagccgaagaaactggcggaaaccattcaggatatgaagctcaaatatgtggtgattacgtctgtggatcgtgatgatttgcctgatcgtggtgcagggcattttgcggaatgtgtgaaagagatccgtgcgttaaacccagggattaaaattgagattttagtgccggatttccgtggtcgtgttgaacaagcaattgaaattttaaaagaaaatccgccagatgtatttaaccataaccttgagaacgtgccacgcctgtataaagaaattcgtccaggtgcggattatgaatggtcgctcaaactactcaaagaatttaaggcggttttcccagatattccaactaaatcaggcattatggtcggtttaggggaaactaacgaagagattttacaggtgatgcaagacttgcgtgatcacggtgtcacaatgctgacattagggcagtatttacaaccaagtcgccaccatttacccgtggcacgttacgttcacccaacggaatttgatatgttccgtgaaaaagccaacgaaatgggctttgaacacgccgcctgtgggcctttcgtccgctcttcctaccacgcagatttacaagcaagcggtgggttggtgaagtgaaaattaaatcatatggtgcacataagaaagttttcaagggaattttagagctagttatgtgtatcatatagatacatacttaccacatacctattatttagagtttacttttaggtaaaatatttctgtgaactgagtaaagtcagcagtatatcgctgattttcatcataaatcgtcaatgtctgcaaagccatttcagcatattgcggtgaaaaagtgaggataactcgtttaggtgatagtccgatttttgtgcagatttcccagtattcaatacaatatagccctaataaatggctttgttccaacaattttttttcagcatcgataggcaaaataaagctaattctgccatttggggttagccactgttgagcccgttttagccaatcaaaatggctataagtcacagctcttgcaagatctcgttgcttatttcggcttgcaaggctatgcttaaaatagggtgggtttgatacgataaggtcgaattttttggtagatttccacgtcattatatccgcttgtagtacgtcaattctgttattccacggacaatgttgggcattttcttgagcttggtgaaacgcgttttcttccagttcaagtgcagtaatttgtgcactagcggtacgttgggctaacattattgcaataagccctgtccccgtgcctaagtcgagaatgtggcgtgcattgctaggatctgcaattgagcccagtaaaatgccgtctgtattgactttcattgcacagcagtcgtgtgcaatgaaaaactgtttgaactgaaagccactcattactattttcttaatttgacggtttcaatggcgtgatcttcgccttttactaaaatcaaatttgctcgctctcgacttggcaaaatgtttttgcgtagatttaatccattaatttcgtcccaaattgttgaagctgttgtgattgcttcctgttcacttaactttgagtagtgatggaagtaagaattaggatcagagaatgcactgcgacggaattttaagaaacggtggatataccaatctttcaataaggtttcatcagcatcaacataaattgagaaatcaacaaaatcggaaacaaagacactatgtgggctatgtgggtagttcataccactttgcaacatatttagcccctctaaaatcacaatatcaggctgatcaacttcattaaattgatcggggatgatgtcgtaagtgagatgtgaataaacgggggctttgacgttgcgtttgcccgatttaatatcagaaacaaattcaataaggcgatgaatatcataagactcaggaaagccttttctcttcattaaatttcgctcttgtagcgtttttaatggatagaggaagccatctgtggtaattaaatctactttacgtttttcaggccattctgacagtaaggcttgtaagatccgagcagaagtgctttttccgacagaaacactgcctgttaagctgataatatagggaactttcggcgattctacgtctaagaatttatgtaacacttcttggcgtttgagattttcatcaatgtaatagttgatcaaacgagcaagtggaagataaattgtactaacttcttctagggaaagctcttcattaaaacctaaaagcggttttaaatcctgttcggtcagttttaacggcactgactttcgtaatgcagcccactgctgacgattaaaggttaaaaaaggcgtaattttagtgatgcccattgccaagttctctatttttgctgaatataattcatattgttacggttttaataacccgaaatatacaatagaaataatgaaagtagatattttatcttacaacatttagtaaaaacatctaaaaaatcagcaatttgcgtatttaacaagcgaaagaatggattttttaatttttttgaaaaaaatgcttgcaaggtttttcgaaatccctataatgcgccttaattgcttacgacgcaacgccgacttagctcagtaggtagagcaactgacttgtaatcagtaggtcaccagttcgattccggtagtcggcaccattctagcgttatcaagtattcaattatcgtggagggattcccgagtggccaaagggggcagactgtaaatctgttggctcagccttcgaaggttcgaatccttctccctccaccatttctttaattgaatttctttgggacagacgaatttagaacagcgggcatcgtataatggctattaccttagccttccaagctaatgatgcgggttcgattcccgctgcccgctccaaacgctgatatagctcagttggtagagtgcacccttggtaagggtgaggtcggcggttcaagtccgcctatcagcaccacttcattactttctatctttatcttttccttagcataaataagtatttgatttctaaatttggttaatgtggtagaatgccatcttgaccatatttgtttaactggacttttttaaaccaatatcgtttaaaaaataagttcataaataacataaatggcaatataataggtttttactctaaaccctgtggtgcatatcgtgctacgggatttcatcaacaaaggaaactttacaatggctaaagaacaatttaatcgtggcgataaagtccacgtaaacgtaggtacaatcggtcacgttgaccacggtaaaacaaccttaacagcagcaatcacaaccgttcttgcgaaaaaattcggtggtgctgcgcgtgcgtttgatcaaatcgacaacgcaccagaagagaaagcgcgtggtattaccatcaatacttcacacgttgagtacaacacagaatcacgtcactatgcacacgttgactgcccaggacacgcggactatgttaaaaatatgattactggtgcggcacaaatggacggcgcaatcttagtagttgcagcaacagatggtccaatgccacaaactcgtgagcacatcttattaggtcgccaagtaggtgttccatacatcatcgtattcttaaacaaatgcgacatggttgacgatgaagagttattagaattagttgagatggaagttcgtgaacttctttcacaatatgacttcccaggtgatgacacaccaatcgtgcgtggttcagcgttacaagcgttaaacggcgtgcccgagtgggaagagaaaattcttgaattagcaaaccacttagacaactacattccagagccagagcgtgcgattgataaaccattcttattaccaatcgaagacgtattctcaatttcaggtcgtggtacagtagtaacaggtcgtgttgagcgtggtatcattaaagcaggtgaagaggttgaaatcgttggtatcaaggatacaactaaaacaactgtaactggtgttgagatgttccgtaaattattagacgaaggtcgtgcgggtgagaacgtaggtgcattattacgcggtaccaaacgtgaagaaatcgaacgtggtcaagtattagctaaaccaggttctatcactccacacacagacttcgaatcagaagtttacgtattatcaaaagaagaaggtggtcgtcatactccattcttcaaaggctatcgtccacagttctacttccgtacaactgacgtaacgggtactatcgaattaccagaaggtgttgagatggtaatgccaggcgacaacatcaaaatgacagtaagcttaattcacccaatcgcaatggacgaaggtttacgtttcgctatccgtgaaggtggccgtaccgttggtgcgggtgttgttgcgaaaatcatcaaataatctgtttttagtttaagaagattagattgttatcttaagggctggatgcgatatttaatcgtattcagcccttttatttggtgtaatagacaaaatagttgctgattcgtcaaaaactataccaagtggacaaaacagttgctaatatctattttctctaaatgttagcaactctttttatttaaaaaatcctgtataaacaatatctgacgatttttcgttaatccgttatgattatttaattttcgcttaagttcactaaatagcccctctgagcgatttgtcgtcttttctatatttaattcagtatgtttttcatagataaaaataaaatccatataacgctttaaactggcataagcacttcttacattgcgatgtttataaggaaaatagccttttcattcgctttatcactcctttcttttaaaaatgcttggtgttttatgaaccaagaatgtaatcgccgaattaaaaattcatttttgagctttttgtgagtgtttttgcaattatttttaattctttacccgcttgtgattgatgcttttttcttaatttttgcatcactatcgctaccatataaaattgacacatttgtactggtgtattaaataaatctttcatcaagccacgtctaccatcacagacaattgattgaattttatagcttttcatacgaagtgaattaaatgctatcctgtaataaacatcttttccgttttaacaacacgatggttaaaccacctttttagaaagcgaatccatcaggactaaaatactaaattcacgaccaaagaaggtagtatccgcaataatatttaaatcacgtgatagtggtggatttaatgctgttttaggggctttatcaatatatctttgaatcgttctgactgaacaatgatatttaatagcaagttgttgataggtttgttttcctattgaataatcattccaaatacttattggatttaatttctttttaagggtaaatgttttattacaggcattacatttatagcgttgaatattatttcttataccatgtttctttattttcagactttggcaaaatgggcagttttttgttcatgtttcaaaaagagagcttaaagccttgtactatgaggctttaagccactttttagcaaccattttgtctactatgccgatatttttgttggcatagtagacaaaagtgttgttttttacggactatgccttacatcttctcaaccgtcttaatacccaacagatccaacccttgttttaaggtttttgccgttaagtgagcgagtttcaagcgactttgcttaatactttcttcggcattaagtatcgggcaggcttcgtagaagctagagaaaatacctgctaattcatagagatattggcagagaacgtgcggtgtgccgtctttggcaaccaccgtcacggcttcttcaaactgcaataatttaatcgcaaggttgcgttctttttcgtcgattaaaacgatattggccgttaagctgttcgggtcgatccctgcacgactgaagatcgaacgcacacgggtataggcatattgcatataaggtgcggtgttgccttcaaagctcaacatattatcccagtcaaatacatagtctgtggtacggtttttgctgagatcggagtacttcaccgccccgattgccacggcttccactacagcttgtttttcgcaagcggttaaatctggatttttttctgcaattaatttttctgcacgctcaacggcttcatcaagtaaatccgctaatttaaccgtgccacctgtacgggttttgaatggtttgccatctttgcctaacatcattccgaagttgtgatgttcaaggctgaagctgtccggcacataacctgctttacgagtgattaaccaagcctgttgcatatgttggctttggcgagtgtcggaaaagactaacgcacgatctgcttttaaggtctcaaagcggtatttggcagcagcaatatcggtggtggtgtaaaggaaaccgccatcttttttctgcacgatcacgcccattgggtcgccgtctttatttttaaattcgtcaaggaaaaccactaacgccccatcatcttcaacggctaaaccttgagcttttagatccgccacaatttcaggcaacattggattgtaaaggctctcgcccattacatcgttttcagtaagcgtcacattcaagcggttgtagttatgttggttttgttgcattgtgatgtttaccaacttcttccacatcgtacggcaataatcgtcgccactttgcaatttcaccacataatttcgagctttttccgcaaagacttcatcactatcataatgctcttttgctgtgcgataaaaggcttcaagatcacttaactccatttcggacgcgtgttcgttttccattttttctaggtaagcaatcagcataccaaattgcgttccccagtcgccgacgtggttagcacgaataactttgttgcctaaaaattctaaggcacgcactacgccgtcgccgataatggtggaacgtaaatgcccaacgtgcatctctttagcaacgtttggtgatgaataatcgaccaccaccgtttgagcttgatttaagttaatgcctaatttatcgccactgaatgcgttttctgtttgttgagctaaccaagttggggctaagaaaatgttgataaaacctgggcctgcgatttctaatttttctgcaatgccgtttaaatcaacgttatccactactttttgagcaaattcacgcgggtttaagcctaatttttttgctgcccccataatgccgttcgcttgataatcaccgaattggactttgcctgattgacgcactaatggctcaacattttgctctgcccctgcgacaatcattgcttgcttgattttttccgatagaatgtgttgaatattcacgtttatacctattttcaatactaaaaaatgtgtgcaatgatactaaaaaatactgataaatgctccgaatttgcaaactttttcacaaatctaaccgcttgttttggtgaacttgctgaatttgagcgaaaaatagcgcagattgctaagattgctcagattgatttgagccaatatcagatcgatcatctggcagtacgaatgaatagcaatgagcttgctaaacaatggaaagcaatgctactgactggttcagcgctattaaaagagagtgaagttaatggtcgcccgataggtttgtttactctaaatcagcctctgcatttttgcggacaagccgtttctgtgattgagttgccgttccctaaaggtaaaagctatccagaagaaggctgggagcatattgaaattgttatcccaatgtacgaaaacgagaacgttgagcagtggtgtaagcggatagatgagcaattttctttgcaagctaatcccgaattaaagatcaaaatcagtcaaccacaagtcgaaggcgaacgtttacctaatccaagtgtggcaatttcactcataaatgcaacttatcagaatttttgctgtcttaaattgcacccttatgatttaaatgtgtcacttctttaaaattggcttattttatacaaagggcttatatgaaaaagttatctagtattttattaataggcattatatcagtagcgtgtacggctgaaaaatatacatctgaaggtaatgcaactattgtaaccagcgaatatctatcttttgattcagttaaacttactataaaaaaagacaatggtgaattagtaacaataaataggaagtacgatgctcatgcaacagtggggggccgtgtgcatataaatgagatgaatagactagaaacaattcctcgttatgaatttaaatgaatcttatatcaatcacatactttgtctgttaaattctttttactcatgttgaacacatgggcggatgaaatagttgctaatgtttgtattccttaaatattagcgaccactttgtcatataggcatagttttcacgaaattagcagccattttgtctactatgccctagcatagccgcagaactgtttaattatgcggatttgctcgccgttgggcattatctcgaacttaaagtctttgcgtaattgcattaacaaagtttagagcgtgatttttccacattttatatttgatctatgaaaagaagaaactgaaattaaacacgatttgctggcagccgcggtggttcccccattcgattattcaccaatacatcaagcaacaacaaatacctgattaattagatttgaaacgacccacaccgtttatatcttatatctccgctctgaaggagagaactttacggcacagttatgataaaatccgcattcttgtaatacttcatttcacaaaaatgcggattaatcaatcagggggtatgcctttaattaaccttgctgatcaccaatcaacacagactctaacgcaatttcaatcatatcgttgaaggttaattgacgctcttctgcggtagtttgttcgtgcgtacggatatggtctgaaacagtacagatggttaatgcttttgcaccaaattctgcagcaacgccgtagataccagccgcttccatctcaacacctaagataccgtatttttccattacatcaaacatttctacatctggagtgtagaaaagatctgcagagtaaaggttacctacacgcacattgatgcctttcgcttttgctgcttgtacagccgctaaagtaagatcaaagtcagcaattgccgcaaagtcgttgtctttgaagcggatacggtttactttagagtcagtacaagcaccaacaccgataatgacttcgcgtaatttcacgtcttggcgtactgcaccacaagaacctacacgaataatttttttcacaccgtattcggtgattaattctttcgcatagattgagcaagatggaatacccataccgtgtcccattacagaaatacgacgacctttgtaagttccagtataaccgagcatattacggacattagtgacttgttctgcattttctaagaaagtttcagcgatatatttagcacgaagtgggtcacctggcattaatacaacatcggcaaatgcacctgctggtgcattaatatgtggagtcatagtctgttcctcgttgtttgttgagagattaatatcccgttacattttgatttacttgttcatcgtttaatgtagcaagtaaattcgctaataaactagatgcaccaaagcggaaatgagcttggttaatccaatcttgtcctaaaatttcagcagttaatgcgaggtactgctctgcttcttcggtggtttttacaccgccagcggctttaaaaccaacgctatctgcaacacctaaatcacgaatggtttctagcataatatgagcagattcaagggtagcattcacaggcactttacccgttgatgttttgataaaatctgcccctgctttaattgaaatctcactcgctttacgaattaattccgctgttttcagctcgcctgattcaataatcacttttaatgcaacattattggcagaacaggccgctttacactgtttgacaagctcaaaaccgacttgttcattacctgcgatcaatgcacgatatgggaaaaccacatcgacttcatcagcaccataagccaccgcagctttggtttctgccactgcaatgtcaatatcatcgttaccgtgagggaaattggtgacagtcgcaattttaacttgttctgtaccttgtgcttttaaggttttgcgtgcaataggcacaaaacgtggataaacacacaccgccgcaggcgtaccaaatggcgtattcccttgttggcataatgttaccactttttcatcggtgtcattatcatttaatgtggttaaatccattaaagataaggcttgttttgcaatagattttaaactcattctttattccttacttaaagcaatcgtttaactttgccataaacgacaacaccacagtttcctgtggtgtttcgttcaagaattgagagtgttaaaccgcaccaccaattccgataaatagacctgcaatcgcagcactcattaagtttgcaagagaacctgcaattaccgctttgatacctaagcgagctacatcaccacgacgatttggtgccatagaacctaaactaccgattaagattgcgatagagctaaagtttgcaaaaccacaaagtgcgaaagtaacgatagctttagttttgtctgttaatgccattggagcttcggggcctaagtatttagcaaattctaagtaacccacgaactcattgatcgctaatttaagaccgatcatttgaccagcgacttcagcttcattccaaggaacaccgattgcccaagctaatggtttaaatatccaaccaagaattagacctaagtttagaccttcataaccgaaccagccaccgacagcgcctaaaacaccattgattaatgcaattaatgcaatgaacgaaattaacattgcacctacgtttaatgctaagtgcatacctgagcttgcaccagcagcagctgcatctaatacgtttgctggtttttctaattcaacgttctcaatgctgtcattgaatttttctgtttgtggaagaataattttagcgaataaaagacctgcaggtgcagccataaatgatgccgcaatcaagtatgtaagtggaacccccatacctgcgtaacctgccattacagaacctgcgatagaagctaaaccaccacacattactgcaaaaagttctgactcagtcattttgctgatgtaaggtttaaccactaatggtgcttctgattgacctgcgaaaatattcgcagctgctgacattgattccgcttgagatgtaccaagtactttttgtaagccaccaccaatgattttgatgacccattgcataattccaacatagtaaagtaatgaaattaatgcagagaagaagacaatgataggaagaattctgaatgcgaagacgaaaccaccgcctccaaagacttcaaacattttatcgctaacaagaccgccaaataagaaagcaacgccttcgttaccatagctaatcactttagcaaccccctctgccattgcacctaatgcattacgacccactggaacgtaaagaattaatgcggcaataccgatttgtgaagctaatgcaccaaaaactgtgcggaagttaattgctcttttgttatttgacaaaagaaaagctattcctagtagaacaactatacccaataaactatttaacgtacccatttaaggactccattcaaagaaagagaagagatatatgataaatgttatagtgattataacaactaactcatcaaaaatgatgggctgcacaatataccaagttttcaaactaagatctttaactttttacatagttaaaaaataaattgacagaaaatggactttatttatcaaaaatgtgaagtagctctcattttttcacgccagcttcttttacaccttatagagttagagttattgtagtttacccacggtaatttttactgaactaaaggaagataatatgcgtaaaaaaattattttggattgcgatcctggacacgatgatgctattgccattttgcttgcttacggcaatccagatattgatttattggctgtaacaacggtggttggcaatcaaaccttggaaaaagtttctcgaaacgctttagccattgcggaaattgcaaatattcggggaatcccttttgcaaaaggggcaatccgaccgcttgtcagagaagttgaagttgcaccaagtattcacggtgaatcaggtttagatggtcccgttcttcctgaagctactcaacaacacgttactcagcacgccgttcaactcattattgacctaattatgagccaccccgaaaaaactattacattagtaccaacggggggcttaaccaatatcgcccttgcggcacgactagagccgagaattatcgacagagtaaaagaagtcgttttaatgggcggtggttatcatacgggtaactggagcgctgttgcggaatttaacattaaaattgaccctgaagctgctcatattgtttttaatgcaggttggaaagtgacaatggttggtttagatctaactcaccaagccttagcaacgcctgatgttgtagaacgtattgccgcgattaatactaaactagccaaatttgtggtggagctgttagacttcttcggcaaaatgtataaacaggctcaagggtttgattatccacctgttcacgatccttgtgctgtagcttatgtgattgatccgacgcttatcgaaacacaaaaagtccctgtgaatattgaattaacaggaacacatacacttggaatgacggtagcagatttccgttatccgccaaaagaatgtaacacttatgtggcaaaagttttagatcgagagcgtttttgggatctcgtgattgatgcgattaaacgacttcaataatacaagcggttagattcttcaagttttttgcaatactctataaggctgaacaggattcagcctttatttttgtgagcttgttcacaaatttttgaaaaagacattgacgctgtttctaatggatttaataatatgacaaatgtcctttcattaaaacatttgtcctagtggagttcggcaatgaatcagaacgaaaaaacgattttagatttaatacgtcaaaaccctttcatttcacagcaagaactcgctgaatatatgggattatctcgttcagcgattgccaacatcatttccgccctaataaagaaagaatatttattaggcagagcttatgttcttaatgagcgtagcgctattttatgtattggtgcggcgaatgttgataaaaaaattaaaacggacgaagaacttcgaggttatacgtcaaacccagtaaattccacaacaacgattggcggtgttgctcgtaatgtggctgagaatttaggcagactcgggcagaaagtgagctttatttctacggttggcaacgatcctgaatgggagagaattaaatccttctcgtctgagtttatggatatgaataatgtgattaccgtagaaggacaatctacaggctgttataccgcattactagacaaagaaggcgaaatgtatctaggcttagcggatatgtcgatttatgacagcttaacccctgaagccctgaataaacacactacattaattaaaaatgctcgttgtattgtggctgatctgaattgcccaaaagcgaccattgaatacctttgcaaaagtgccgaaggttatcacattcctttggtgttgattgccgtttccgaaccgaaaatggatcgtcttcctcaagatttacaaggtgtaagttgcttaatcatcaataaaggggaacttgcagcctatttagatatgctattagataccgatcaaaaaattgaagaagccgctaaaatattgttagcaaaaggcgtaaaacaaattgtattaaccgcaggttctaaagctattttgagtgcatctcaggatgaaacccgttggtattccgttaaaaaaatggatagccacaaagtgattgatgtcacaggtgcaggcgactcttttagtggagcatttatttatgcttggcttaataattatgagcaagacaaggcgatcttagctggtttaaccaacgcctatcatacaattcagtcggaatttactgttcgaccaaatttaaccaaatctcaattagaaaccgaaatggagcattattatgaataactaccttattttatctaatgaagtgcaacgtggtatggctcaaggcttgccgattgttgccttagaatcgaccattatttctcacggtatgccatatccacaaaatgttgcaatggcaagggaagttgagcaaattatccgtgataacggtgctgtacctgcgacgattgcaatcattgatggcaaaatccgtattggtctttctgatgatgaattagagttatttggtagcagcaaagggatcgcaaaagtttctcgccgtgatttaccacagattattgcgtctaaaaaattaggggcaacaacggttgcttctacaatgatttgtgctcaccttgcaggtattaaattcttcgtaacaggaggattaggtggcgtacataaaggctgggaaaccacattagacatttctgcggaccttgatgaattagcacaaacaagcgtaaccgttatttgtgcaggggcgaaatctatccttgaccttgatgcaaccttagaatatttagaaaccaaaggcgtgcctgtcgttggttataaaaccaaaaatctaccagcattctttactcgtgatagcggtttaccattggcattatcgtgtgaagaattaactgaaattgctgaaatgatcaaagtgaaatggctgctaggcttagaaggtggcgtggttgttgcaaacccaattccacaagaagatgaattagcaccaagttatatcaacggtattattgatacagcagtaaaagaagccgaagaaaaaggcattataggtaaagatattacgccattcttactcggtaaaatcgttgaaatgaccgaaggcaagagcttagaagcgaatatcaagctggtgaaaaataatgcgaaagtcggtgctcgtttagccgttgaattttttaaataatcgattaaaactcgttttataacgacttatcttgaacggtgaatttgtaataaattcaccgttttgttttttatttgtagaaaaatttgatctatctctcactttttaatgctattgattgcattacttcatttgtaggggtatgctttggagtaaattttctttttgtttaatgctaatggagtttttatgtcgagattaaccaaacaacaaattttagaacaattaaaaaatggtttaattgcttcttgccaacctgttgatgacggtccgatggactcgccagagattgtagcggcaatggcaaaagcatcagtcattggcggagcggcagggcttcgtattgaaggcattgataatttaaaagcggtgcgtaaagtcgttgatgtgccgattgtaggtatcgtaaaacgtgatttacctgacagccctgttcgtatcacgccattcttacaagatattgacgatttgtatcacgcaggggcagatattattgcctttgatggtacagatcgtgttcgtccaaccacgattaaagcctgtgcaagacgtatccaagagttaggggcaatgtcaatggcggactgctcaaactacaaagaaggtatgtactgccaagagttaggcgtagatttaatcggtagcacaatgtcaggctatacaggcggtgaaacccctgatgaaccagatgtacaactggtgcgtgatttagtcgccagtggttgtcgtgtaatggctgaagggcgttacaatacccctgaacttgctgccgttgcgattgaaaatggggcttatgctgtaaccgttggctcagctttaactcgtcttgagcatatcgtaagctggtttgtgaccgccattgataatcgcaaaacaggagcctaatatgaccgcttgtttagccattgatgtgggtggaacaaaaatcgccgctgctcttgttaccttaaagggaaaagatgcgattgtggcggaacgtacacaaattcacacgccacaaaatccaagtgcagaagctctagacagtgctttggcacaaattttaacgcagttcaaagggaaatttgatcaggtttcggtggcttcaacgggaattattcaaaagggtattctaaccgcacttaacccgaaaaatttaggcaatctggcattctttcctcttgagcaaagcgttgccaaacacacggacaagccgattacactgttaaatgatgcccaagcggcgggttgtgctgaatttttacgtcaagatgacattgaaaattttgcctttattaccgtttcgacaggtgtagggggcggtattatcttaaatcgcaaactctttactggcacaaacggcgtagctggacatatcggacatagccttgctgatccaaatggggaagtgtgtggctgtggacgtgtcggctgtgtcgaagccgttgctgcagggcgtgcgattgctcgtgatgcagctaaatgggataacccgtgcgaaccgcctgaagtatttgcacgctttagagcaggcgatccacaagcggctgctttagtggataaatctgcaaaagcgattgctcacttaattgccgatctcaaaattaacttagatattcaacgaattgctcttggcggaagtgttggattagcagaaggttatttagccagagtaacccatttcctttccgaaatgcctgaaatttatcgccctgatgttgttcctgcttattatgcccaagatgctggattgataggtgcagcttggtgggctgaaaatcaaaaacagatataatgattattacattattaaatgttttaccgctgatatcattagatatgattaggcatagtagacaaaagcgttggtaaaaagtggcttaaagcctggtactataaggctttaagccactttttgaaatatgaataaaaacctgtcctttttgccttaagaacaatatccaaaagtatggaaataaaaataatattcagagatacttttgttcgtcctgccataaaacattttcttccacaaataaattaaatccaatagatgattacacaataggaaaacaaacctataaacaattatccgaaaaatatcactgttccattagaactgttcaacgtttgttcattagaggcatagtttgcaaaaaaacactcttgtctactatgccaataatttttgatagatgggtaataaatttgcctactatgcctattattcaaatgctaccttactagttactggcgtatgactttcaaaatctcagcaaaatcttcacaaacataatcaggctcagactcactaataggaatgttgtagttatagccataggttaaacccacgcttttacaaccagccgctttcgctgccagaatatcgtttttagaatcgccgacaaataacatttcgtggggatataaaccaaatttgccacaaaggtaataaagtggggctgggtgtggttttatttgaggcagagattgtccaccaagagcctcagaaaagagatgatcgattttaaaggcttgcaatacaggcaaaacgtgcttagttggtttgtttgttactactgctaaaatataaccctgtgctttgagtgcttctaaggtgtctttgacattaggatagagcttgctgatgttgcagacattttcgccataaaaataaccaaatcggcgtttaatttgggctaattcgtcctgtgaaaattcgtctgcttttcctgtccattccattcctttcgcaaaaagcacatcagccccattgccgatccaagtcagaacaagctcttcagaggcttgtggcaagccaacttcggcgaaggcagagttaagcgataaggctaaatcgggcaggctattgactagcgttccatctaggtcaaaaccgattaatttgaattgtttcgtcatcttatttccttaaccaagcggtgagatacgctcgatattttgtttttaggtcaatattaactctctgcttcccattgtgcaaactcaacaaattccgttagttcagggtattgtttaagccacttttgccattgaattttatcgacttcaatttccactaaacgatcgccaaattcggtgaaacgctctgatttgatacattgctgttggtaaaatttagtgtaaatctgaccgcttgttgtgggtagcagtactctttcacagaccagctcgtttttaagtctgactcgcattgcttcaaatagcagatcaatgccttgattttgttgtgccgaaagataaaccgccacaggtttgccgtcatcgttgtattcgatatgtggcttaatactgtccaagcgatccaccttgttatacacgagcaaggtcggaatttctaatgcttcaatctcatctaacacttgattaactgcatcaatattttcatttttacggtcgtctgcaccatcaataacgtgtagcaacaatgtcgcttctgtggtttcttgtagggtggatttaaacgcagaaactaaatcgtggggcaaaaagcgaataaagccaacggtatctgccaaaatcgctgtgccaacatcttgaatttgaattcgtcttaatgtcgggtcaagggtagcaaacagttgatctgccgcataaacacctgcatcagtaatcacattaaatagggttgatttacctgcattggtataacccacaagggaaatggttggaatgtctgctttttgacgagttttgcggttctgatcacgctgtttacttaccttttccaagcggttttgtaactgctgaatacgcactttaattaaacggcgatctgtttctaactgggtttcccctgggcctcgtaagcctaccgcaccgcctttttgttgatcttggttacctaaacggcggactaagcgagtggataaatggcgaagctgtgccagctcgacttgtaacttaccttcgtgagatcttgctctttgggcaaaaatatccaaaatcaagcctgtacgatccaccactcggcaatcgcaaagggattgtagattacgcgtttgagcagggctgagttggtgattaattaaaacgacggtcgcatcaaaatctttgattgcatccgcaatttcttgggctttaccttgaccaacatagtatttgatatggggtgcggaacgtgtggttgtcaatgtagcgacaacctctacccctgcggactcggcaagagtttgaaattccatcagattttctacatctttagtttgagagaggtaaagatgtaccacaatagcacgctctttgtcaggcgtgttttgtgttttttcaggcaacggaaaaccaaacacagaatttgctgtgtttggttcattcaagaggtctaacgtagtaataaaattattccactttctctaccacttcagcagattgcactggtgcggcttgatgagcgtggttagagttattgttgtgagaaatcgcacgagctggcacaacggttgaaattgcgtgcttgtaaaccatttgactcactgtgttttttaataaaataacgaattgatcgaaagactcaatttgaccttgtaatttaatgccattcacgaggtaaatggaaactggaatccgttcacggcgaagtgcatttaagtatggatcttgtaaagattgaccttttgccattttatgttccttctaattattgttgtttaatgctttgccaaaggcattgcgatattaccacagtttcaaatgcttttgctgtactttttcgatcatttttttataagaattttcaggatctaaactatcaagccattctagctcactcgtccaacctcttagccaagtaatttggcgtttagccagctgacgagttgcacaaatgcccctaaagattgcttcatcaagagaagtttgtccttccaaatattcccacatttgtcgataaccgacacagcgaatagaaggcagatcaacatttaaatcgccccgttgataaagctgtcgaacttcttgttcaaagcctaaatcgatcattttatgaaaacgttgctcaatccgttgatgtagcacggcacgctcttgaggggctatcgcaaactgcattatctcataaggaataccttcgccttgttgagcggtgagttccgtcattgtttttcccgaaatataaaagacctctaacgcccgattaatacgctggctatcattagggttgatccgctcagctgaaatcgggtcgatattaaccagttcttgatgtaaacctgcccaaccgatttgctctgcttttgcttcaatttctgcccgaatatctggatctgccgaaggcaatggcgacaagccatcaagcaatgctttgtaataaagcattgtaccccccaccaacaaggggattttaccttgagccgtaatatctgccatttctcgtaacgcatcttcacgaaaattcataacagaataactttctgatgggtcaagaatatcaattaaacgatggggggtaagttcgagttcagccttactcggcttagccgtgcctatatccatacctttataaatcaaggcggaatcaacactgattacctcaacaggaatctgctggcgtagggcaatggcaagatcggttttccccgatgccgttggccccattaaaaaaattgcgagaggtttttgcattacatctagtctataaaataacaagcggtgagttagggggcttttatttctcctggttttatcatcgacaacgcagattgaatactacgctcaatcgtagggcgacgaggatcatcttcaggcattaacttcaacatcattccccacgtcattgccgccattttatagtcttcctgttcaaacgcacggaaagccaataagctcaaggcattggtatttgtatgatctgccctaatcacttctttgagcaataactcaccttgcgatttatcttttgggtcttcagagaacaataaaatttcagcgtgacgtaacttatactgcatattctctggttttagcttgctcgctttagcaaaactatcaagagctagctgtccattatccaacgccattcctaactgacctagcataaaccaatgtttatcgtcattcggatttttttgtagctcaacacgtagtgccattgcaaattggttcagctcttgttctgaaaggggatcggtttcttccgtttttactctttcataaaaataatcaagctttttgtggctcatttcaagcattgtgccactaaaccacgaaccgatattccaatagatcccagcactaataccgccaatcaataaaatcaaggcgataaaccataatttgccaagatgtccaaatgattttgtcgaacttaccgcttgtgtttgatgctcaggaatatcgtcaagcaggctttgttgaagttcgagcttcgtctgctcgctatcttcaataatacctgcttccgcttcttgttccacttcttttaaacggtcaaagtagaaggctttattgaggctatcacgcttttgtgtgcttaaattttgacgctgtttcaataaagggtagaacgccactacgccaataatcagcgtaataatcgtgactaaaatccaaaaattcatcatttatccttttcgtttaaaatctgattaaggcgagctgtatcaaccacatttgcatttttctgctcagaactgaccgcttgtacacgctttttacgtttaaacataatgcttaaacctaccccaattaataataacggcataagccagagtagaatggtcgctggtgtgataggaggatcataggtaacgaaattaccataacgttccaccatatagccaacgacttcatctttgcttttaccttgtttcagtagctcaagggtcttgttacgcatatctgtcgcaatggttgcatttgaatctgcaatattgttattttgacattggggacaacgtagctcttggattaacgcacgataatcagattcttgctgtgcattatcaaattgttgcatatccgtcgaagctatacttaatacagggacaagcaataagagtgcaaataatttcttcatagccattacttcaatttctcataaacgggttttagcacttcattccacactttttcattcacatcacctgtatggcggtaatgaattttgccgttaccgtcaataataaaggtttcaggtgcaccataaacccctaaatctaaccctaaagagccttttggatcataaacaacggctttgtaaggatcaccataatcttttaaaaattttaatgccttagcacgctcatctttgtaatctatcccgacaatttcaatcccttgtttagcaagaacagttaaaaattgatgttccgcaaaacaagttggacaccaagttgcccatacatttaataagcgtggcgttcctgttttaaccacagatgaatctaacatctgtgttgcttcgtgtaacgattctaacttaaattctgggatcgttttacctacgagagcagactcaagtgcttttggatcttctccattggcattgcgttgaagctgaatagtaaaggtaataattaaccctaaaaaaacaatcagtggaataagtaacttggctttcatctgttttccttacacataacaaagggcgtatatgaacgccctaatttttagagattgattttacctaaacgttcacccattttggttggttcgcctgcttttaagtgagcttccaactccacagcacctttcgggaacaaattaatcaccgtagagcctaaacggaatgcccccatttcttgcccttttttcaaatgtactgcggtttcgcctgtagggagatattcgtaaactgtcacttcttttgctcttggcggattgataactcctgcccaaacagtactcatactggcggtaatagttgcccctacaaggatttgcaccataggcccaaatgccgtttcaaattcacaaatcagacgttcattacgcgcaaaaagatttggaacgtgttctgctaaaaatggattaaccgaaaacagctcaccaggcacatagatcattttacgcaaggtggcatcgcacggcatatgcacacggtgataatctctaggcgataaataagtggtaataaaattgccgtttttgaacttatctgccagattaagatcattagcaagtaatgtttctaaactaaattggtgacctttcgcttgtaataattggttctcttcaattttacccaactcactcactcgaccgtctgcaggtaaacagagtgcttgcggatcttggttaattgggcgagcattttcctttaatggacgaataaaaaattcattaaatgatgcataatcagaagccttagttttttctgcttctgctaaattgacttggtattttttcgcaaaaacattgatgatgaaatgagtgattactccccatttacgttccgcaagccagcctgctgcttgggttaagtacagctgtggcatcatatattgaaacgcgattttggcacgttgtgcgtaggttggcgctgggtaggattttaattgcattgcagtatccgatgaataaataagttaaagggataaaagtatagcaaatgcacggaagaatgagtagatacaatgagacacaacaaactttattttctaaattaaatgcagaaaacaaagcgtattagcagagtaaaaaatgtttaacagcacgagatatagcacccctaaaagtccccattgtttcttataccttggcataccaatcttttttctgcgatgggtcaagtagggtagttaataggcttgccagtaaatccacactgagaacaaaaataccaatcgcaagcacgcctgcggaaatcgcattgtaatcttttagtgcaagggcattaactatccaacgtcctacgcctccccagctcaccacattttcgacaagcatagcaaaggcgaaaattaaagtgatatttcttgcgatcatcggaataagtggaggcaaggtattgcgtaaaatatgcacccaccagattttaagtggcgaccagcctcgtgtacgagcgactttgacataattttgtttcagcacatattccgtacgttgttttgtcattcggataatttctaacgtcgctggcacagctaatacaagggtgggcagtgcaagatgatgcaaggcgctttgcatcatttttaatttatgtggtgcatctgaaagaaaaatatctaaaattttaacgcctgtgattgttggcaccgcataaatggggtggagttcgccgacagctgaaattgcccaatgatggctagaagcatacgccaataagacaatggcaagccaaaatacaggcacagcaaggcttaatgaccccagtgagcctaacagtttgccaatcatattttgccgttgtagcgccgcaaaaaagccaagcggaatgcctagcatcagcgaaagtaacatagccgataaacagagcgagatcgtggctggaaagacatttaaaattaatttcgttaaaggctcacctgtcatttcgctaacgcctaaattcccttcaagcaattgttgcaaataaattgcatagcctgagaagccttgttcaatgacagaataatgcggatttctcagcaaaataaaataactgataagcgataaaatcatcagtgaaatgatgattaacaagagcttacgaataagaacgaacaacattttatttcaccttaatgtcagataatttaacctgcccaaacgcactgattttgacattcttaacgctgttattggcaactaacaatcgtttgacattcaccaaaggtaacagcggtaagcgttcttcaagtagagtttgaagttgttgataatattgcattcggctttgtggatcttcagcggttcttgctaatttaagcaattcatcaaattccacgctacaccaattcgatagattggtcaccgcatcttgcaagcgacaacttaaaatcgaagagagaaaactatcaggatcaaaattattggctaaccaaccacttagaattaaatcatagtctgcctgatgattttcaagttgctgagttaagtaggctcggctcacttggcgaacattgagcgtaattcccactttcgctaactctgctcgcagatattccgccatttttaacgggtgcaagtgataaacacgtttttcatcaattacccacagtgttaagcggtctgtttcctccacttttttactcgtatcaggcggataatagggataacttgttggatttgcttgagcatacaacgctttcggtagtacattctgtggcacttcagcaacaccgtagaacagaatacgcgctagacgctcacgatcaatacttgtcgcaattttctggcgtaaagcaggatctttcattttatcttggcggaaattaaaggctaaaaaagcaagatttgctccagccgtttcaatcacatagccttgcgttttatccaaaatagagagctgacttggttctggaaaggcagaaatatcgcactcgttattcaaaaactttgccattcgccctgtgccagaggtagagaaatctaccactaaattgctgatattggcttttttaccccaatagcgaggattaggctgtaagcgaacaaaatcgttttgtacataattatcaagctgatatacccccgtgccaacaggcaaaatatccagttgcattaagttatcatcagcattgagttgtaaggcatactctttcgataaaatcaccgcatactgactggcaagatgagccaaaattgagctatccggctgtgccaaacgaattttgacaatatgcgatgaaggcgctgaaatctcgacgatctgattagcgagatcgacactttcaaaataagagaaatgggtgcggtctgcaattcggtgacgaacttgatgttgcacttctcgattaagctcaggcagttcatcaactttgcccaaaattcgatttaaggaaaagatcacatcttcgcttgtcaaatagcgtgtcggcgtaaaccattttgtatgatgaaaagagacttttttgcgtaaatatagcgtaatggttaaaccgtcttcactgatttcaaagcgttctgcaagggctggtttcagctggttttgttcaggatcaaattcaatcagtttgtcgtaaatctgttctgtaacgatattcatatttgagccaacatcggctttttgaggattaaaagaaaaaccagaagcactggtacagtaaaccagactgtttgttagcaacgcttgtggaattttaggcgaagcgtaagcggtgggatatgcacctaaaaatgcaaatccccatagcataagttgcgtaaaaatcaggttaaaccctttcatcatttgctaatcccataactccgcaatttattggcaatggcagtatgtgaaacccctaagcgttgagccaatttacgcgtacttggatattccgcatagaacttgcgtagcagtgaggcttcaaaacgattaaccagctcttctaatgaaccttgctctaaatgtgagatttcaaaatggcttggcaccgtttcaggcaagttaagatcactcgctttaagttgatcggtagctaaagagcaagctcgataaatggcattataaagttcgcgtaaatttccagaccaatgataagcttgtagggctttgataaaatgttcatcgtaaagcggtttacgaatgcctaattgctgactgatttgggtaataaagtgatcggtcagtagcattaaatccccttgtctttcacgcaacggcggtaaatttaaggtaagcacattcaggcgatgatataaatcttcgcgtacttttccttcctcaactaaggtcgcaagcggtttttgtgatgtacaaataacacgcacatcaacttgaatttctttatcttcacctacgcggcgaaatgatccatcattcaaaaaacgtaataatttgccttgcatttcaagggatagttctgcaaccgagtcgagcaatactgttccgccattggcatactcaaaaaagccaacgtgtgtacggtcgccaccgtgatgtccaaacatttcgctctcagcctcttcttcaggcaatccagcacaattaacggcaatgaatttttgatcccgacgaaaactaaattggtggcacgctttggcaaacaaatctttacctgttcccgtttcgccttgaataagcaaaggcacattgagtatcgcaaatttcttggcttgttcaatcaccgctttcattttggcactcttcgtcaaaatatgatcgaaatcactgttttgatttgccataaattgacgtaaatcgagttgcattgtttgctgagattgcagagtaacaacatacccaagcggtcggttttgtgccgcctcccacaattcaatcggcagtaaatccattcgccatacttgatcattaaattgaatagggtgagaaattggctgtaatgttgtcggtaaaatagaacgcccttgttgcaaaacccactgataccatttggtgcgattgagattgacgataatttcgttgagatcaacgccttcaagagaaagaatttgctcttgttttttcttaggtagcgactggcgataaatcggtaataaaactttacaggcttgagaattagcaaaggcaattttaccgttgagatcaagcgataaaacaggattaggcaacgcctcaattaaggctctcaactcaagatttttacgttcttgtggaagatgatgaatttcttgaacagcagtaatacttggaatttttttcaactgcttgacaaaattggcttgttggctagcttccattgcttcagtacgcaaatagacaagccctttttcgcccaatttttgcagttcgatcccttctaaatttatgccttgcgttgccaataaacttaaaatatcttgagcaacgcccacacgttcaatacactcaatcgcaaatcgcatcttctcttccttttgtaaaataagcctttgatctgtccgcttatgatactccgaaaaaagaattttggaaatttttgtttacaatatagtaagacaagaatggattaactattattgtagggagaaaaatctaggctatacttgtaatcatcttatcttctccaaataatttcacattctacttttaactgctccgttggctttccttgcaacttttggcgtactaggttaaacagcgaaaatgcaatttgttgatgattctgtttaatcgaatgaatatgaaacggcagagcgttaagtaaatcgtgatcatcaaaagtggctaaatgtaattgaccgttcaacagtttatccatttgcttgtgttcagtgaggtaacgtagaacaccttccaaaatggtataagacgcggtaaatactgcttcaggcaaacgccctaaacgttcaaccagctctgccatcaactgataacctgattcaggttggtaatttttatgtaaaatccaaccgctttcttcttgtaagttaccttgctttaagccttggcgaaaaccagctaaacgagattcactaggagaaagtgagcattgaccgccaaaataaaaatattctttaagttgatagcgttggatcgttagagatactagttctgcaattttttcggtatcagcactaatcacataacctaattcaagttgaggaacatagcggtcaagttgtaatagaagagtgtgctttaatacggatttatagtattttggatcttgatgtgttggagcggtaattaagagatcaatttgacggtcaagtaaacgatctatcgcttgtttctcctgttgaggattatcatcagaacaagcaatgactaagtacaaaccattctctcggcacaatttctctaaagtctttgctgtagaggcaaagccataattggttaaatcaggaatgaccagaccaataacattggtgcgacgtagtttaagtgcttttgcataagcatttgcacgataaccgtgctgttttgcgatttcttcaactttttggcgggtttcaggcttaatgcgaaattgttctgcctgcccatttaagatcatacttgctgtggtttttgatacacccgcaagttgtgcaatatcattgagggttaagcgtttccgtgacgatttaatttccatatattctcccttatttaagatgtgtattttatttctttattttggggaagaattatagctgatttatcttctcatcggtaataaaatgaaaaaggaagcttattgcttccctttcctgttaagacagattaatccgccaacttcgtaccatataagtaagtataaccaaatgggctttgtttatagtcttgaacacgtttacttgttggggcaaagttaattgagtgtgctacgttgatccaaggggcttgttcttttaacaatacctgtgcttgttcataaattttggcacgctctgccttgtcagataaaccaaccgctttgtgtaataacgcatctaattcaggatttttgaagcgagcgtagttactgttacccacgttttcactaccgaataatggcgataagaagttatcaggatcaccattatctcccgaccaaccgtaagtaccagctgttaattcacctgctttagtacgcttgatgtagtcgccccactcatagctaaccagttttgatttcacgcccactttttcccagtcgctttgcactaattccgccatacgacgtgggttcgggttagaagcacgcaccacaggctgtacccaaatatccgtttcaaaaccattttcaaagccagcttcttttaataactgttttgctttttttggattatattcataaccagtgatttcgttgttatagccccaaattgttggtggaagtgggtttttcgcagccacacctgcaccacggtaaacagcatcaatgatcgcatttttatctaccgcatagtttaacgcttggcgtactttcacattatcgaacggtgctttttcagtattgaacgcaatataagcaatattcaaccctgattgagaaagtaaattcactttcggatcggttttcatcttctcaagatctgctgcatttgggaaatcaattaagtcacaagcacccgcttgtaattttgcataacgagccgtagcatcagggacaatttcaaagatcaagcggtcaatatcggcttttcctttccaatactctttatgtgctaaataacggcttttttgatccacttgatagcctgcaaacacaaacggaccagtaccaataggggttgtatcaatggtttctggtttgcctgccgctaacattttatctgcatattccgctgaataaatcgagatgaagtccatacctaaacttgctaggaatgtcgcatcttggcgatttaaagtaattttcactgtatgatcatcaactttttccactgatttcaacaatgttgggaatttcattgctttgaagtacggataagttgctttagatacattgtgatatgggtgatttggatctaactgacgttgaaatgagaatactacgtcgtccgcattaaaatcacgacttggggtaaactctttatttgagtggaatttcacacctttacgcaaattaaaggtataagttaaaccatcatcactcactctccagctttctgcaagagcaggttcaatatctgttgaaccacgtttgaactcaacaaggcgattatacacttgttgtgaacttgcattataagaaatcccgtccatcactaatgcagggctaaagcctgttggtgaacggctaacacagttaataaacgttttatctgcggcttgagcaacggttgaaaccaataatgtcgtggctaagagagagaatttagtgtttagtttcataatatctccaataaagagtgaaaaattgcaagcaagataccgattattttgctgaaggtaaagaacaaaaatgtggtctttataacaaaatgatataaaaaactcaccgcttgcgtaaacaagcggtgagtttctttccattatttactagcgaaattcagccattaactcgcccgctttttgtaccattgctgttgaacccacaaagaatggcacacgttgatgtaattcagttggtttaatgtctaaaatcggattaaacccgtcagtcgccataccgccagcctgttccgctaagaatgccatcgggttgccttcgtaaagtaggcgtaatttaccgttcgggtggcttttcgtgcttgggtaaatgtagataccgccttttaacaagttacggtggaagtctgaaaccaatgagccgatataacgagaagagtatgggcgcccccttgccttatcttcttcttggcagaatttaatgaatttcttcacgccctctgggaatttgagatattgcccttcgttaatcgaataatatttgccttcaaacggcattttcatatttgggtgagaaagaatgaacaaccctaaagaaggatcataggtaaagccgtttacgccattgcccgtcgtgtaaactaacattgttgatgaaccataggtcacatagcctgctgcaacctgtttacgtccaggctgtaagaaatcatccatcgtcactggtgtaccaatcggtgatacacgtttgtagatcgaaaagattgttccgacagacacattcacatcaatgttggacgaaccatcaaggggatctgtcattagaatgtattttgcatttcgaccacgttctgtatcaaacgccacgaaagtatcatcttcttcagatgcaaatcctgccacatcgccacgagcaattaatgcttttttcattgtttcgttggcaaatacatcgagcttcatctgggtttcgccctgaatgttttcatcgccagatacacctaaaatatcttgggttaaacctgctcggttaatgtcacggtgaatgatttttgcagacaaacgaatggaagatagaataccactgagttcccccgtagctcctggatattctgcttggcgttcaacaataaattcgcctaatgttttcattttttatctccttattagctattcaatacagtttgctttattatactcgcccattgaaaccctgttttcgagtaaagttttgttttgtgatactgttcacaatttttatgtaaggaatgctatgaaacagcaacatattcatattttagggatctgtggaacctttatgggtggcgtggcgattattgcaagggagttaggttatagagtcacagggtcagataccaatgtttatccaccaatgagtacctttttggaaaaaagtggcattgaaattatcccccattacgatattgcacagctcgatcctgttcccgatatgattattatcggcaatgcgattagccgtggtaatccttgcgtagaacatatcttaaatcaccgcttgccatacacttcagggccacaatggctaagagatcatttactcaaagatcgttgggtgcttgccgtttcaggcacacacggcaaaaccaccacaacgggaatgttaagctggattttagatcaagctggcattgatacgggtttcttaatcggcggtgtggcaggcaactttggtatttctgctcgtgcaggatcaagcgatttctttgtgattgaagcggacgaatatgattcagccttttttgataaacgttctaaattcgtacattacaatccaaaaaccttaattatcaacaacattgattttgaccacgcagatatttttgatgatttaaaagcaattcaacgccagttccatcatcttatccgcacaatgccacaaaatggctgcattttgtctgcaacatcagatgaaaatgtccaaaacaccttaaaaatgggctgttatagcgagcagcaatttatcgggcaagatcaagattggtacgccgagccgttaagttcagactattctcattttgcgatttaccataaacagcaaaaagcaggagaagtgaaatggaacttgcttggtgctcacaatatgcacaacggcttaatggcgattgccgcagcacatcacgcgggggtaagcgttgagcaagcctgtttaggtttaaacagctttatcaatgccaaccgtcgtttagaagtcaaaggggaagtgaatggcattaccgtttatgatgattttgcccaccacccaaccgctattttagcaaccatcgacgcacttcgtggcaaagtaggtaaagaacaacgcattttagcggtattagagcctcgttcaaacacaatgaaaatgggcgttcacaaagaggaaattgccccatcgttgaaagacgctgatgccgtctttgtttatcaacccgataccattccgtggcaagtcagcacgattacagatgcactaagccagccggcacaatggtcggcaagcctagatgaattagtggaattgattgtcaaggaagctaaaccaacggatcatattttagtgatgagtaatggggcatttggtcagattcatcagaagttattagagagactacctttttcgttagcagccgcaaacattgtataaaatacattcaatattatttatggtacgttatttacttttgcctttctatttttctcttaaaatgccataatgactcgctttttctgtctattgaattttactgaataaaattgtggaaaatcagacaaaagtaccgcttgcaacggttaaaaatgcaaatatcgtgattgattatgcggtcagattttgagtgtaagacataaaacagatcaccttagatcatagggttcacgtcagtttgtccttagacagtcgggagattgacagattagcaaaaatacaaacccaaaccccatgaatagcactaacaaaaataaaatgagaaaacacaatgaaaagaatgttaatcaatgcaactcaaaaagaagagttgcgtgttgcccttgttgatgggcaacgactgttcgacttggatattgaaagtccgggacacgaacaaaagaaagcaaatatctacaaaggtaaaattacccgtgttgaacctagtcttgaagcagcattcgttgattacggtgcagagcgtcacggtttccttccgttaaaagagatttctcgtgaatacttccctcaaggttatgtattccaaggtcgcccaaacataaaagatattattcaagaaggggcggaagttattgttcaagtcagcaaggaagagcgtggtaataaaggggcggctttaacgacctttatctctttggctggtagctatcttgttttaatgccaaataaccctcgtgctggcggtatttctcgtcgtattgaaggggacgagcgtttagatctgaaagaagcgttagattgcttagatgtacctgaagatgtgggtttaattgtgcgtactgctggggtgggtaaatcccctgaagagctacaatgggacttaaaagttttattacatcactgggaagcaatcaaaaaagcggcagaatctcgccctgcaccgttcttaattcatcaagaaagtgatgtgattgtgcgtgcaatccgtgattatcttcgtcgtgatattggtgagattttgatcgataatcgtaaggtatttgagaaagcaaaaaatcatatccgccttgtgcgtcctgattttatcaaccgtgttcgcctgtatgaaggtgaagtaccgttgttcagtcactatcaaatcgaatcccaaatcgaatcagcattccaacgtgaagtgcgtttaccgtcaggcggttctattgtgattgatgtaaccgaagcattgacagctatcgacatcaactcatctcgtgcgacccgtggtggagacattgaagaaacagcattaaataccaacttagaagcggcagacgaaattgctcgtcagttacgtttgcgtgacttgggcggtttaatcgtgatcgactttattgatatgactccagttcgtcatcaacgtgaagtggaaaatcgtatccgtgaagcgacacgccaagatcgtgcaagaatccagtttggacgcatttctcgtttcggattacttgaaatgagccgtcagcgtttaagtccatcattaagtgaagcgtcatcacacgtttgccctcgctgtcaaggtacaggaaaaattcgtgataacgagtcgattgcactctccattttacgtttattagaagaagaagcgattaaagaaaactcagtacaggttcacgctattgtgcctgtggaaattgcttcgtacttattaaatgaaaaacgtaaggcgattagcgacattgaaaaacgccacgatgtccaagtgattgttgtaccaaccgaaagtatggaaaccccacactttagcgtatatcgcctgcgtgagaatgagatcgttccaaccttaagttacgatttagcgaaacgctaccaagaacaagatgaagaaaatcacattcatcatcaccattcggaagaagcgttggttagccgtaataagccagtgattaccgttgaatcagtattacaaagttcagagttaaatttacagcctgcaccaacaccagttgagccagcaaaaccttcgttaatcagtcgaattattgcgaaaatcaaagcaatgtttgcaagcgaagagaaagaacctgagaagaagcaaggtaaaggtaaggctcgtaaccagcgtgaacgtcgtcagcaacgccgtgaaaaaccaaaccgcaacgaacgccaagagcgtaaaaacacggtcgttgaagcaacgaaagaagctgaagtcgttccagtagagcctaagaaacgtcgtgaaattgtagaagaagtggcaggtgtttcagttccgcaacagcgtgaagcgaaagtggctgagcgtcgccaacgtcgtgacttacgtaagaaagtgcgaattgaaactgcagaacattcagcggaaattaccgcttctttaccaccagcagaagagaatgcggctgattcatttgtggcagagcctgtggtgactacagtaaatgcagagatgcctttggaaacttcagagcctgtagtagaagagcgtacagagcaacgtgagcctcgccaacgccgtttacctcgccatttacgcgtaggcaatcagcgtcgtcgtgagcgtcgtgaggaagtaaaagcagtaatgccattaacttcggctgtcgcttcgcctgaacttgcaagcggtaaggtttggattaaatttagcgaaatgccaaaagctgttgcggaagagaaacctcgtttcttatctgttgatgagatgttacaacagcaagaacagccagttcaatctgtagcaagagaagtagctgaacccgtaaaagaggaagctaacactcaggctcatcaagattcagcggtaccatttggttatttcgtaactcaaagttcagatcgtgatttagtcaaagacaaccacaaacgtcgtacgaaagttgaagcagaatccgcagaagttgatccgaaagcagtggctttatcggctaaaccattcggacttgtggtttctcaaccgactaaccgagatttagttaaagaaaatcacgaacgtcgccatattaaattggaagaactagggcctcaagcggtcgaatctgagcagaaagttgcagctccgattccaaaaccgattaaggtttatcaaagtcaatatcagtttgaagggaaactaggcacattctctcgtgttgcacatacgcaagtagaaatgacggttgcagcagcaccagcggaagaaattgccttaattcaagcaaaagagtggcagaactcaaaatactatttctacggaaaaggctttggcggacatagtagtgcagtgagccacgtttattctgcaccgaggggtgcaaaaataaaaggttgatctttaatcacttgtaaatgcttagggaactaattcctaagtatttactctaaatgtggcaatttaaaccttaatttataggaattatttttatgaaaaaatctttattggccgctttagttttaggtgcagcaacactttctttaaccgcttgtgatcaagcaaaagagaaagttgctgaggtaaaacaaacaacagaaactaaagtagaagaaactaaacaattagttgaaactaaagtggatgggataaaggacgcagtgtcttctcagactgaagaagcaacaccagtcatagatactaaataatatttgtccatttcgtataattgaaatgaaatatacttctctataaacaaaattcaataagattgatatttagatattgaggagtaatttatgtaaataccggtttttgagattattagaaaatcggtattttttctttacaagaataaaagtattgaagtatttttaagaatttatagatacttcgtttttatacatgttttctaaaaccaagttaccagttggtgatggagtaagattgtaaatatataggaaaatggttttctatttcattggatactttgcctcagaatatacaggatagttttagaaataatattgcattaaatgcaatttatgaggcaagaagcatcgtattttctaatggttccaagattattgttcagtgaataccaaagtaaagttattttggaaaagctgtatgtttgtagattattttgacaaggtgctctttacttattagttagtctaagctaaaatgcctcaccttttttagttctatgccgccaccaatttgtgcggcttcatttaaacatatatttcctgaggtgatggcttatgccagtaattaaagttcgtgaaaatgaatcatttgacgtagcattacgtcgttttaaacgctcttgcgaaaaagcaggtcttttagctgaagttcgtgctcgtgagttctatgaaaaaccaactacaattcgtaaacgtgaaaaagcgtctttagcaaaacgtcatgctaaacgtaacttccgtgagaacgcgcgtaacactcgtttatactaattttaaattaggtagcagaagttaaattggaaccgtgaaacctttaaggaatcacggtttcaatgtttataccgtccattataagcggtctgaattgtaaaaaaatttgcaaaactatccgcttgctagcaaggagataatcaatgaaaggctctattcctcgttcatttattgatgatcttgttgctcgaaccgatattgtcgagctgatcaatagtcgtgttaaactcaaaaaagcagggcgagattaccaagcctgttgtccttttcatcacgaaaaaagtccctcttttacagtgagccaatctaaacagttttatcactgttttggttgtggcgtacacggtaatgtcattagctttttaatggaatatgacaagttagagtttcctgaagcaattgaggaacttgctgcattgcacgggttagaagtgcctcgtgaaaatgtgatcaatagagatggcaaaccacaagccagttataaaactcggcgtaatctttatgaattgttagatttggtcgctaagttctatcaacagcaattaacgcaagatagtgctagtcaagcctatttgcagcaacgaggtttatctcaagagattattgatcgttttgaaatcggtttttcaccaaatgcgatggacgcagtgcttcgtcgctttggaaataatcctgaagaagttcaaaagttgcttgatacgggtatgctctctaaaaatgatcgtggcaatgtgtatgatcgtttccgtaatcgtgtgatgtttccaattcgagataagcgtggtcgagtgattgcttttggtgggcgtgtattaggcgacgaaaaacccaaatatcttaattcccctgaatctgccacttatcataaaggcaatgagctttatggtttgtatcaagccttacaacataatgaaaaccctgactttttatttgtcgttgagggctatatggacgtagtggctttagctcaatttggggtgaataatgctgttgcctctttgggaacggcgacaacaggtgaacaaattcagttaatgttcagatcaacagagcaagtgatctgttgctacgacggcgaccgtgcagggcgagatgctgcgtggcgagcattagaaaatgcgttgtcttatttacacgatggcagacaactgaaatttattttcttacccgatggggaagatcctgatacctttattcgctctcagggtaaagagggttttgaacgctatttggaacaagcattgacattgagtgaatttttatttgattctttgcttacgcaggtcgatctttctactaaagagggaaaatctaagctcgcttcattagcattgcctttgatcaagcgtatcccaggtgaaatgctacgtttgtatttacgaaatatattggggcaaaaactgggtattcttgatccaatacaattggaatcgatgctgtctcagaaaagtgttgaaactgcacctaaacgccacaatatgccacatattgaaaggacaccgatgcggttactgattgcgttactgcttcaaaatcctcatttggttcaaaatgtacctgaagatgtgacatttttgcagagtttgcaggaaaaaggcttcgatttatttttggaattagtcaatatctgtcacgctaatcttggtatttcaatgggcggtttattggaatatctgcgagaaagcccaaattatcgccatttagaattattggcaaattgggatcacttggtatcccctgaaaatgtcgaaaacacttttattgatacgcttgattttttctataagaaactgcttgatcgacaaattgaaattttaatggcaaaagatcgtacaacaggtttaaatcagcaggaaaaacaggaattaatgatgttattgactgggcggtaagcggtcaaatacttataaatttttgcaaaactatttatcgcacctcaagcagtggtataatccactacttatttttgctcttaagaacggataaagctatggaacaatactctcaattagaagaacaacaatctcagttagaacttcttatcgctcaagggcgtgagcaaggatacttaacgatttcagaagttcacgaccacttaccagaagaacttgtcgatgcagatcagattgaagacattattcaaatgattaacgatatggggattaaggtgctggaaactgcccctgatgccgatgatttgatgcttgcaggcaatattgccgatgaagacgtagtggaagaggcgactaaagtactttctacggtagaatctgaaattggtcgaactaccgatcctgttcgtatgtatatgcgtgaaatgggaacggttgagttgcttacacgtgaaggtgaaattgatattgcaaaacgcattgaagaaggaattaacgaagttcagtgtgtcattgcagaataccctgaggccttaagtgaattaattgctcgttatgatcaagtcgaagaaggcactgtacgtttatccgatcttgtaaccgctttcgttgatccgaatgcggtagaaagtacccctgtagatgacctcgatgccgatctagatgaagaaagcgaaagtgataccgttgcagatattgatgatgaaagtgaagatggtgaatcatcaggcgatggtggtgatgataatagcattgatccagaacttgctcgtgagaaatttacgctattaaaagagcaacatcaaaaagccttacaagcaatccaaaaacatggacgtactagcaagcgttcaagagatcaaattcaagcactttccgatattttccgtgaatttcgcttagtgccaaaacaatttgatttgttagtggaaacgatgcaaaaaatgatgaagcaagtgcgagcagaagaacgtcaaattcaacgctatgctgtagaatatgcaggcatgaaaaagacggatttcatcaaagtattccaaggtaatgaattatctgaggcgtggattgataaagcgatcaatgctaaaaagggtggtgtgccaaaattagccaactatgtagataatattcgtgtaaatatcgcaaacttgcagaaacttgaggaaacaacaggtttaaccattacgcaaatccgtgaaattggcggacgcattgcagatggcgaattaaaagcacgcaaagcgaagaaagagatggtagaagccaacttacgtcttgttatctctattgctaaaaaatataccaaccgtggtttacaattccttgatttaattcaggaaggtaacatcggcttaatgaaagcagtagataaatttgaatatcgccgtggttataaattctcaacttatgcgacttggtggattcgccaagcgattactcgctcaattgcagatcaggctcgtactattcgtattcctgtgcatatgattgaaacgatcaacaaattaaatcgtatttctcgccaatgcttacaagagatgggacgtgaagcaacacctgaagagttagcagaaaaaatgggaatgccagaggataaaattcgtaaagtcctcaaaattgctaaagagccaatctcaatggaaacaccagtgggggatgacgatgattcacatttaggggatttcatcgaagatagctctcttgagttgcctcttgattctgcaacagcagaaagtttgcgaattgcaacgaatgctgtattagaggagggattaacacctcgtgaagcaaaagtattgcgtatgcgttttggtattgatatgaataccgatcacacccttgaagaagtgggtaaacaatttgatgtaactcgtgagcgtattcgtcaaattgaagcaaaagcgttacgcaagctccgccaccctagccgttccgaaactctacgcagtttcttagatgattaatggttaatccagtatagtagataaaggggcatagtagacaaaatggttgctaatgtttattttctttaaatgttagcaactctttttatttaaaaatcctgtataaacataatcttacgctttttcgttaatccattatgattatttaattttcgtttaagttcactaaataatccctctaagcgatttgtcgtcttttctatatttaattcagaatgtttttcatagataaaaataaaatccatataatgttttaaactggcataagcacttcttacattgcgatgtttataaggaaaatagcctttttcattcgctttataacccctttcttttaaaaaatgcttggtgttttatgaaccaagagtgtaatcgccgataaaattcattttttgagcttcttgtgagtgtttttgcaattatttttaattctttacccgcttgtgattgatgtttttttcttaatttcctcatcacaattgccaccatatgaaactgacacatctgtactggcgtattaaataaatctttcatcaaaccacgtctaccatcacagacaattgattgaattatatagtctttttctcttaacccattcagggcaagtttgtagtaaatatctttttcggttcgcacaaaataatgggaaatgacgttgtttgaatttgaatccattaacaccaatacaccaaaataacgaccgaagaatgtcgtatccataatgatgttcaagtatcgatttaaaggtagttttaaagctgttgtaggggctttatcaatatatctttgaatagttctgactgaacaatgatatttaacggcaagttgttgataggtttgttttccggatgtgtaatcagtccaaatttttattggatctaatttattcttaagggaaaatgttttatgacccttatgacaaaatatcgttgaatattatttgatgtaccatgtttctttattttcagactttggcaaaatgggcagttttttgttcatgtttcaaaaagagggcttaaggccttgtactataaggcgttaagccactttttatcaacaaatttgtctattacacctgcaataaaccataagcacctgagtcgttaagtatttaatagattttgcaactagtaaggcaaaaaagataatgcttgttcaaccacttctacacccgccccttgtttgcacgcattttcacttaaatgcctacgccactgtcttgcccctttacagttttggaatgctccaagaatatggcggacaatatgattgagataaacgccttgtgaaagttgctgttcaatgtaaggtagcattttttcaacggcttgttttggtgtaacaatatcggcgtttgggtcaaacagttcttgatcaatataaccaagcaaagacggattttgataggcttcacgcccaaccatcacgccatcaacaaattgcaagtgatgtttgatctcttcaatcgttttaatcccgccgttaatgctaattttaagatgtggaaaatcccgcttgagttgataaactcgttcatagtcaagcggtggggtttcacgattttctttcgggcttaaacctgacagccacgctttacgcgcgtgaacaataaaatcgttacagtaaagctgaattttctcaataaaatcgcataaaaattcatagctatctagatcgtcaatgccaatacgatgtttaacggtaacaggaatactcacttcttttttcattgcttctacacagcgagcgactaaatccgcttttcccattaaacaggcaccaaacataccattttgaacacgatctgatgggcaaccgacattcagattgatttccgcatagccccgttcttccactaattttgcacatttcgctaactgttcaggatcacttccccctaattgcaacgccacagggttttctgtgggatcgtaagcaagcagatcatatttcgcgtgcaaaattgcgggtgcggtaatcatctcactataaagtaggctatgttgagtaaattgacggtgaaaatagcgacagtggcgagttgtccaatcgagcattggtgcaacggaaaaacgcccgcgatagtaaggttcttgcattgataaaatccaaataatgtataaaacgaagaatctattgttattgataacaatagattcagattatttacaaagtagcttgtagggtgggtcttgacccaccatatagccgtaacatattgattttattggtgggttaaaacccaccctacaatattcaatccatctaatatatagtttgtcaatggtctaaatctattgtcattgataacaatagattcttataaagtttccattatgccataaaattgagttgaagattagaactacgcgatctaccccaacttcttcgccaacattgtcacaaaacgtagctgaatacaattgccgtgttcatcggttttatgtaaatgccccaaatcttcattgtatttaacaagttcccagccttgataatactgcttcagttcatcttcttggaatgtaaatgaaaaaggcattggacaagggaaatcctgagtgttcattgcacagacaataagattatatccaccgactttggtattttttttgcatattttcgataattgcagggatacaatgacgatttaggaacatcattacgacagtggaaacaataaagtcaaattcaccttgtatattagcttggttgatgtcgtaaatacccgtttggatatgttgtgcatcttctttttcgatgattgaattgaggaaatggatactttcttcattctgatcaactgcggttacatcaaacccttttaagttaagataaagtgcatttcgccctcttccacagccaaggtctaacactttgcctgtcgaaagataatttatcgcatttaatacttcagaatgtgttgcagtgagattatattttttagcgaaataatcttccggcgagcaataaaaagcgagctgacacgccagatcttcacttaatggctcaactttatgccaaatttgtggctccacaaaaggtggctggttttgttcgtcgaaaatcatttctctgacgatttcaccttcctcagttaattcatagtatttcaatgatccctttaagattgttaatttcgcccaagttcctactttagtattatgtttctcttgaaacatctgtggtaggctttccttatcccaaactggcatctgtttatagcaaattaagttgtccatatttttctccaaagttgcactatgttgaaaatgttatgctttttttaactaaaggcaacaaaaaaccgactattttagtcggtctttattaactatttgattaatatcaaatagttaatgatggtgggtgctctctgtttttccgtgctgttcaaaataaacggctaaatcattttgcaatgtagcgtgaatatccatttcgtgaaaacgttttgcaaggttatgcaaaaagtgacaataagagcgataaactatcgcttgccatatgcccggcatcagcaagtaaggcaaggctattaaagaaatagccagagattgcttcaacaaccataaaagtcgttataatagctaaactaatcaataggatagtcttattttgttgggcgtgcgtctccatataagaatgtgaatgggacataggttttaactccgaataatagaaatattaaaatgcaacaatttattcaactagccaatcagtatggaaaaatgcgtttgccttttttctttttaattgattttgaaaaacagaaaccattaatttatcctttatctgaaattgaagataaagggctttattttgattttaatggacaacaaaagttcattcaaccattaaaaataaatggaaattttgagttagagattattccacctgattatccacaatataaaaaagcctttgattttgttcaacaacagatccaaattgggaatagttatcttttaaacttaactcagcaaactgaaattaaaacaaattatcatttagcacaaatttttcagcaaagtaaagctaaatacaaattgttattagatgaaagatttgtctgtttttcccctgagtgtttcattcgtattaaagcgaataaaatctattcttatcctatgaaaggaacaataaatgcaaatgaagaagatgcggtaaacaaattattaaattcagaaaaagagtttaccgaacataataccattgttgatttaattcggaatgatttagctttagtatcaaaatatattcaggtcacgaaatatcgctatgttgaaaaagtggaaacacatcgtggggcgatttatcagacgagttctgaaatttgtggggaacttgatgaaaattggcaagaaaatattggcacaatgttggataaactcttgccagcaggctcaattagcggtgcgcctaaagtgaaaaccgttgaaattattcaacaagcagaacaacaagaacgtggttattatacggggattttcggttattttgatggtgaaaatgtagagagtgcggtggctattcgctatattgaaaaacaaggggatacatattattttcgtagcggtggcggaattactgcattaagtcagctagatggagaatataatgaaattttagagaaagtttatgtgccaatatccactctttgaaacggtagcaattattgatggtaagatacaaaatattttttatcatcaacaacgaatgaataatgcatttatatattattttaagcacgaaaatagttttgaactgttagatattattaaagtgcctgaagcatatcaaaaaggattagtacgttgtcgtattgattataacacaaaagaatatcaagttcagtttttccattatatacctaaagcaataaaaaactttcaatgcgtttatgtagaaaattttgattatcaattcaaatatactgaccgagttgaattagataaattaaaacaaaccgctggtgatgaaattattcttgttaataatggctttattagtgattgctctattggtaatttactttttttaaaacaaggaaaatggtatagcccaaatcattatttattaaaaggtacacaactaagttatttattagacgaacaaaaaattagcttaattgatatacctgtagaagcactttttgattatgaacaaataatggtgattaatgccttaaatccttttgatcttcaaagggcagtgccgattacaagcgataggatttttcgataaagttgtaaattttgtgatatagatcgaaaaactgaaaaaaatagttgcaactgtatggttaaacagtataataatttacagttttatggcaatgcatttgccctatccaaacaatgaacaaaggaaagcattatggctgagaataaaaaatcttcaaaaaacaataccgtcattaaacaagttccaccagaacagaaacaacaagccttagatgcggcactagctcaaattgaaaaacaatttggtaaaggctctattatgaaattagggcagactgagcaattagatattgagtctgtttcaacaggctcactagggctagaccttgctttaggtattggtggcttgccaatggggcgtattgttgaaatctatgggccagaatcgtcaggtaagacaacattaacactttctttaattgctcaagctcaaaaaggcaataaaacctgtgcttttattgacgctgaacacgctttagatcctgtctatgctcgcaatttaggggtaaatacagatgatttattgatttctcaaccagataatggtgaacaagctcttgaaatctgtgatgcgttagttcgttcaggggcagttgatgttattattgtggactctgtcgctgcacttacgccaaaagctgaaattgaaggggatatgggcgactcgcatatgggcttacaagcacgtttaatgtcacaagcgttgcgtaaactcactgcaaatatcaaaaataccaactgtttagtggtctttattaaccaaatccgtatgaaaattggcgtaatgtttggtaatccagaaacgacaacaggcggtaatgcattgaaattctatgcctctgttcgtttagatattcgtcgttgcggtgtagtcaaagatggcgatgaaattattggtagtgaaaccaaagtaaaagtggtgaaaaacaaagttgcaccgccattccgtgaagtacaatttgatattatgtacggcgaaggaatttctcgtatgaacgaactactgattttagctgaagcaaacggctttattaagaaatcaggggcgtggttctcttatgatggaacgaaaattggacaaggtaaaaataatgcagtgaaatggttaaaagagaaccctgaaattgcagataaactcgaacaagaaatccgaaatacactggcttcaaacccaaatagcctattaaaagtaacggcaagcgacagtatcgacgagagcgatgtcgaagagtttaacgaagaagaactataatagcgaaatgcggtttgtgaaaaccgcatttttattttactgcggtaaataaatgacacataaatattctgcgaatagctatttgctttatctactttctaaacgagaatatagcgaagctgaaattcgccacaaattacaacttaaagaatataatgcacaagaaattgagcaagccattgaacaagcaaaagcgaataaatggcaaagtgatgaacgctttgcgataagttacgtccgctatcgttcacaacaaggctatggaccacgccgtctaaaacaagagttacagctcaaaggggtaaaagagtgggtgattagccaagccattgatgaagcggaagttgatttttttgaacttgccgaacgtctttttgagaaaaaaagaccatcacattgggatataaaagcgaagcaaaaaatgtggcgatatatggttagccacggtttttataacgatcattttaggcatttattggatctggattatggggactatgatgaataaaattactttttttagccgttttgaagcagatattgtcagtggtaaaaagaccattaccattcgagataagtcagaaagctattttcaagcgggtcaagagttgagtgtttttacaaatgaaacagactgcttgtttgcccgtattcgtgtgctgtctgttacccctattcagtttgaacggcttaatgaaacacatgctaaacaggaaaatatgacacttgccgaactaaaacaagtgatcaaagagatttacccgaacgataacgacttttttgtgattgaatttgagttaatatagtttaaaaatgagcctttttaagtccacgaaacagacagaattatgtccgcaatgccattccccattacaactaaaacggggaaagcaggggctttttttagggtgtagtagctatccgcaatgcgattatctcaaacctatccaccaagcaagtcatatcatcaaaacccttgatgaacaatgccctgaatgtcaatcgccattacaattaaaacaagggcattttggtatgtttatcggttgtagccagtatcctgactgccattttacggtacacgaagaaactgaaatcgaagaagaatttgactgcccagaatgtcaaaaacataaattagtggcacgcacagggcgttcaggtaaaacattttatggctgttcaggttttcctgagtgtaaatttaccttacctaccaagcctgtaaaacaacaatgcccacaatgtttgggtgaactcgccaccataaaaaaagtgcgtgggaaaacctattttctctgtgcaaacagaaaatgtcagcatctatttagtgaaagcgaataatgtattcttttaatcaacttattgaaaaacttaaacaaaatcaagtgattgcctatcctactgaagccgtttttggattaggttgcaatccgcaaagtgaacaagcggtgagatccctgcttcaattaaaaaatcgtccagaagacaaggggttgattttaattgctcaccataaagaactgcttctgccctacattgatgatacacatttgacagaggtggaatggcaacgttttgaaacgcttggcgagcaggcgattacttggataatgccagccaaagcaacggttccacgttatttgaaagggcagtttgaaaccattgccgtgcgattatgccaagtgccagcggttgttgaactttgtacagcgacaggttttgcactcacttctaccagtgcaaatttaacgacgctcccaccttgccgaactgccgacgaagtgcgacagcaatttggcaactcgttcccagtattagatcaagccacaggcggaaaatcaaatccgtctgaaatccgtgacatttttagccaacatatttttcgacaaggatagacaatgaaccagtacgcagtgtggggaaatccgattgcacaaagcaaatccccaagaatacatacacttttcgggcaacaaacgggcaaagcgatctcttatgtagcgaaattaggcgatgaacaacagtttgaacagcaactcaaacaattttttgcagaaggtgcgaaaggtgcaaatatcacagccccttttaaagagagagcctttgcccttgcggatctttatagcgaaagttgcttacaagccgaagcctgtaatacgctcaagcggttagatgatgggcgtttatatgcggataatactgatggtgttggattagtgtccgatcttgcccgtttaggttggcttaaaccacatcaacggatactgattttaggggctgggggagcaaccaaaggtgtgctttatcccttattacaagctcaacagcagatcaccatttacaatcgaacggcagataaagcggccagtttagctaaaaagtttgcaaagtttgggcaaattcaatccgcttgtttcgatgaacttcccgaacagtcgttcgatttaattatcaatgcgacatcgcttggattgcaaggcaagtgcgtcgaattgccagcacgattacttacacaagccaacatttatgatatgcaatatgctccaaatatgcagaccccatttcttgaatacgcccgttcacaaggggcaacacaataccaagatggtttaggaatgttagttggacaagcagcttatacgtttcagttgtgggaagatgtattaccagatgttgaacctatattaaaacagataaaacaagaaatggaattttaaaacggcaatcgttaacttattataaaatcagtcttttatagagattattgttgttttttctgacaatttgccgaatctctagtcaaacaagcagaaaaatttacttttttcaaaaaagtatttgacgaggtagagtgaaatcagcataatacgccccgcaaagccgatatggtgacgcaaatggctacatagctcagctggttagagcacaacactcataatgttggggtcacaagttcgaatctcgttgtagccaccatttgcgggactggcgaaattggtagacgcaccagatttaggttctggcgccgagaggtgtgtgggttcaagtccctcgtcccgcaccattttaagcttgcaaataaaacgactggagtatcgccaagcggtaaggcactgggttttgatcccagcattcctaggttcgaatcctagtactccagccatcttatttcaaatcgaatgaactaacgcaagttagtttttttcttttggggtatcgccaagcggtaaggcactgggttttgatcccagcattcctaggttcgaatcctagtaccccagccatcttcttatttctctagataaaataattctctgatttttcaaattctctctattctttgctttttatctttactgaaattctttagaattaatgccctaatttacaaggggaacattatgcttaatccaaaaaatttagagtctatcgcacagcaacttcacaacgcattaccacaaggtttaaaaaatgtaggcaatgatttagaagaaaaatttaaacaaatcttacaagcccagcttgctaaacttgatgtggtcactcgtgaagagtttgaagttcaatctcaagttttacttcgtacccgtgaaaaattgaatgaattagaaaaacgcttagatgaactaagctcaacatcatcaactgaatcacaaaattaaattttagaggataattcaatgcaaaacatcaatccaacccaaactttcgcttggaatgcccttgaacagcacaaagctgagaatttgacgattccacaactatttaatgaagatccaaaacgttttgataaatattccttacgttttgaagatcaaattctcgttgatttttctaaaaatgcgatcaaccagcacacccttgcactattgcgtcaattagccgatgaatgccaagttaaatcagccacttacgcaatgtttaatggcgaaaaaattaaccgtacggaaaatcgtgccgtgcttcataccgccttacgcaaccgctcaaatacccctgttgaagtagatggcaaaaatgtgatgctagaagtgaatgcagttttagcgaagatgaaaggcttctgtgagcgtgttatttcaggggtgtcgaaaggctacacaggcaaggcgattactgatgtggtaaacattgggattggcggttcagacttaggcccatatatggtcactgaagcattacgtccatacaaaaatcacttaacaatgcactttgtttctaatgtcgatggcacgcatattgctgagaccttagcgaaaatcaatccagaaacaacccttttccttgtggcatcaaaaacctttactactcaagaaacaatgacgaatgctctttcagcacgtcaatggttattagatactgcaaaagacgaatctgctgtggcgaaacatttcgtagctctttcaacgaatgccaaagaggtcgctaaatttggtattgatacagaaaatatgtttgaattttgggattgggttggtggacgctactcactctggtctgcgattgggttatctattgctctttctatcggttttgaacactttgagcaactacttgatggtgcacacgcaatggataaacatttccttaatgccccagcagagcaaaatatcccattgacactcgcccttatcggcatttggaataataacttcttaggtgcagaatcagaagcaattttaccttatgatcaatatctgcaccgttttgcggcttacttccaacaaggcaatatggaatctaacggtaaatatgttgggcgagatggaaaatttgtcaattaccaaacagggcctatcatttggggtgaaccaggtacaaatggacagcacgccttctatcaattaattcaccaaggtacaaaattgatcccttgtgattttattgcacctgcacaaacccataatccgattggcgatcatcaccctaaattgctttcaaacttcttcgcacaaactgaagcacttgcttttggtaagtcaaaagaagtagtggaacaagagttcttacaagcgggtacatctttagaagaagttgtagaaattgtgccatttaaagtatttacgggcaacaaaccaacgaactcaattctagtccaaaaaatcaccccattcaccttaggagcgttgattgcaatgtatgaacataaaatcttcgttcaaggcgtaattttcaatatttatagctttgatcaatggggtgttgagttaggtaaacaacttgctaaccgtatcttgccagagctagaaaataacgaaaccattactagccacgacagttcaacgaatggtttgattaatcagttcaaattatggaaacaataatggcaaaatctgaccgcttactccaccaagatcagatagtctccgaaaattttagtagaaccgcagagaggtaagtttgagctttgtagtcggacaacgttggattagtgagtcggaaaataacttaggattaggcattgtcactgcagtggataaccgcactgtgaccctttcatttcctgcatcggacgaacaacgtgtgtacgctgttgccgttgcccctttaacccgtgtgcaattccaaaaaggcgatcgtgttaccagtattgatggctggcagttagatattgaagatgtcgttgaaaatcaaggggttgcactctatttaggtaaacgtgtcgatactcaagtagagagcgttctgcctgaaatgcaactcgatcataaagtgagttttagtaaaccgcaggatcgtctattctctgcccaaattgatcgcagtgatcgtttcgccctgcgttatcgtgctttgaagcatcaacaagcccagtttcaatctgaactgcgtggaatgcgtggtattcgtgcaagcctaattccccatcaattacatattgccaaagaagtcgggcaacgtcttgctccccgtgtgttacttgcagatgaagtggggttgggtaaaaccattgaagcaggtatgattttgcaacaacagcttttctccggacgagtagatcgtgtattggtgcttgtgccggaaagtttacagcatcaatggctggttgaaatgcttcgtcgttttagcctgaatttttcgctgtttgatgaggaacgttgtgccgatttcactaagaaagatgaagataataacgacatcagtgaaaatccgtttgaaacggaagccttagtgattgcctctatcgattggttatcggcaaatccacagcgtgcaaaacaagtgcttgataccgattgggatatgttgattgttgatgaagctcaccatttggaatgggacgagcaaaatccaagtatggcatatcagtttgtcgcacagctctccaagcagatttcagcagtcttgttactcacggcgacccctgagcaattaggacaagagagccattttgctcgtttagccttgctagatcctgaccgtttctacgattatcaagcctttgtggaagagcaaaaacagtatcagccagtcgccgatgcggtcgctaccttgcttaacgataagccgttaagtgccaaagagcaggaaagtatcagcgaattgctggcggaagaagatgttgagccgatgttccgtattattaattcggatgctagcgaagaacagagtcgggaagtccgccaagagttaattagtgagttaattgaccgacacggaacaagccgtgtgctattccgcaatactcgccaaggcgtaaaaggcttcccacatcgtatttacaatgaaattgtgttggaaatgcctacacaatatgcaaatgctttgaaagtaatgtgtatgatggggggaaataagatggaagatctgctctaccctgaacgcctattccaacgcatgaacccaaatgcgaagtggcacgagtttgatccacgcattgagtggttaattacattcttgaaaaatcatcgtgatgaaaaaattctggtgatttgtaagcaagcggataccgccattcagctagaacaagtgttgcgtgaaaaagaagctattcgctctgcggtgttccacgaaaaaatgtcgattgtggaacgagataaagcgtcggcttactttgctcaacaagaagatggcgcgcaggttctgattagttcaagtatcggttcagaaggtcgaaacttccagtttgcacgccgtttagtactgtttaatttgcctgataatccagacttactcgagcagagtatcgggcgtttagaccgtatcgggcaaaaacacgatattgaaatctatgtgccttgtttcaatcactccacccagttgatcttggcggaatggtatcatcgtggcttaaatgcctttgaagaaacttgtccgatgggggcaacgttatttagagaatttaatgcggaactcaccgcttacctactcaatcctgaacgtagcgaagccttcgaagcctttgtggaacaaacccataaacgccaacaacagcttaaagtggaattagaaaaagggcgagatcgtctgttagaactcaactcgaacggcggtgaaactgctcaacaattagctcaagctattgctgaacaagacgacaatccgcagttggtcagttttgccttaaatctatttgatgtgattggtctagagcaggaagatttaggcgagaaaagcattgtgattagcccgacaggacatatgcttgtgcctgatttcccagggttgtctgaagaaggcaacacagtgacttttgatcgtgaacttgccctaatgcgagaagatgtgttgttcttaacgtgggatcaccctatgatccgcaacggtattgatcttattacgtccgccgatattggtaagtgtgctgtttcattactcgtcaataaaaacttgccggcaggcacattactgcttgaagcgatctatatcgtagaagcccaagcaccaaaagatttacagctcacccgtttcctaccgccaacgcctgtgcgtatcttgctggataacaaaggcaacgatatggcatcgcaggtgtcgtttgcagggttggaaaaacagctcaagccggtcaataaacagatggcaaataaaattgcgaagatggctcgtggtgatattgagaagctgatcgcattcagtgatgaaaaagttgtgccacaggcacaatccttaattgaacaagcaaaacagaatgcggatcacactttaggtacagaattacaccgcttgacatcactacaagcagtgaataaaaacattcgtgctgatgaaattcaagtcctagagcagttgcgagaagcatcactgaaacatctagaccaagcaaattggcgattggatagcttgagggtgattgtgagtagttaacttaaaaggcatagtagacaaaagtgttgctaacatttagagaaaataaacactagcaactgttttgtcctcttggcatagtttttgacgaatcagcaactattttgtctattacaccttcttttttagataaaggttagaaactcattgataaatataagatttttctttcttcagctgacctcaggactaccttttttataactcttttattagcataaaggtcatatggctgtattctttttttatccaatgagtaatgtttgttatatattcttgttagcatctttatcgccaataaaattcacaatatccccagccgatccaccactgcgaataatatctcgcatttttcgcataaacgaagcagttttgcggaaaaagagttggtaggattggcaaaggtagttatgtttatttgcttcatttggtaggctaatcattcgatgtttcgggcaaccgccgtgacaaaacggtcgcacatcacaagcccaacagggctgagtgagtacggttcttttttgttgtccaaagttgcgttgtggttgggaatgcgcaatctcgcccaaaggctgttcatttaaattacccaccttatacgctggatagacaaaatggtcgcaggaatagacatcaccattcgcttccacaatcagcgactcgccacaggtttcttgatgaacacaactgcttgacgggtagccaagccattgcccaagcagattgtcaaattccaacacataaattttgccgacatcctgttgcacccactctttaaacacttcaagcaaaaaatgcccataaccttgcggtggcacagaaaaagcggtcggttttacttccttttttgcaaaaggtgctgtgccacagcctgtttcgacaatcgggataaattgcataaaggttgaacccaactcttttaaagcaaggtaggtttctctgcctttatgccaattttgatcgttaatcaccgtcaatgtattaaactccacaccgtagtctttcaataaatctaccgctcgtttgacccgttcaaaggtcggctgaccattgactgatatgcgatatttgttatgtacttcgctcaagccatcaatcgaaataccaatcaaaaattgatgtgttttgaaaaattctgcccattggcgatttagggcgatgccattggtttgaaaagcattggtgatcgttttgccgtttgcaaattcttgctgaaatctgaccgcttgtttaaaaaaatccaagcctaataacgttggctcacccccttgccacgcaaattcaacccgttgtcctgcacttgattgaatgtaattacgcacataatttcgcaaggtgtcttcattcataaaacgcacatcttgctcaatggtatattctttttcaagataaaagcagtattcacatttgatgttgcattgaaagctactcggttttgccatcaaatgaaaatgggctttgggggcgttttcaaacatagtgacctacttctgtttatgccaatcttgtaataaaccgttgcgtttcaactctttagtaatgcggatcgctgtttcggtttcacaccctgcatattcagcaatttcacggtgcgtccagttatagtaagggaagttttccgtgagaaaataaatgctgtcgataacacgatcaagggtgcgtaaataggcactttttgccaagcgttgttccgcttctcgcagttcatttgcaagggattgcaacaaaaatttgctcatcttcggattttctacgaagaaagtatcaatgtcttttggtttaatccgaatgatctccgcttcaaccaaaactttggcattgcaatggtagccgtcatcgccaaacaatgttcgataaccgaaataatcccctttttgatatagacgaacaagactctctttgccgttatctaaggtgtgataaagcccaataagtccattattgacataataaaactctttagcggtttcgccttgtttatatacggtcattcctttagtgaaggaatgaagatgggtgagttggcaccgttttaaatcggttggatgtagcaaattcataagcattttatttcctgacataccagaatttttattaattcatttaattattctacccaatattcagattggaaaaattttacattttatcaattataaataatagtacagagttaaacgcaatataggggcaatgtccagtaattctacttcaaaattaaagttccatatagaaggtattggaatagtagcgccatgttctccgtaactcagctcatttatacttttcttgatacaaccactctgctacctgcttcgcaaaataggtcaaaatcccatctgcccccgcacgtttaaaacaaagcagtgactccataatacactctttttctttgagccaaccattttgaatcgcggccatatgcatcgcatattcccctgatacttggtaggcaaaagttggcacaccaaaagtctcttttacacggtaaactaaatccaaataaggcatacctggcttgaccatcaccatatctgccccttcttgaatatcaagagcgacttcgtgcaacccttcatttccatttgcaggatcaagctgataggttttcttgttaccaccttttaagttacccgcagagccgactgcatcacggaaaggtccataatagtttgacgcatatttcgcagaatacgccataatttgagtattgataaaaccgtgagcctcaagtgcttggcggattgcaccaatacggccgtccatcatatcacttggtgcgacaatatctgcgcctgcttgtgcgtgagaaagcgcttgcttcactaggatttcggtcgtaatgtcgtttaccacataaccatcttcatcaataatgccgtcttgtccgtgagtcgtaaatgggtcaagcgccacatctgtaatcacgcctaatttttctccaaaggcttgttttaacgctcttactgcacgttgtgccaaaccgtcaggattataagcttcttctgccatcagtgatttttttgcatcgccaactacagggaaaagtgcgatagctggcacaccatatttgactaataattccgcttcaatcagtaattgatctaaagttaaacgttcaacacctggcattgaaggcactcttacacgttgattttccccttcaatgataaatacagggtaaattaaatcactcgtagttaagctattttcagcaactagacggcgactaaaatcgtgtttgcgtaaacggcgagggcggtgagctggaaatgaagttgaaagatattgggtcatataaaatcctatttgtaaaaaatgatagcttgtatataggcaaggctataatagtgggctattgtagcaattttttatatagagcacatctgtcccattctgactctacttttcccccttgctttttaacagcaaaactcgttaaaataacactagttattttaacagtatatattcctatgaatctcgacccaatttggctttatgcaacgatagcattactcttattgatctcactttggctcttttttagctattcccgttcacaacgagatagtcaagaacgacaacaggatcttgaacaattgcaacagcagttttcaacgctctcgcaaaaatatgagcaaatttcccttgaaaaaaatcaagtagaacaatttgccgttcagcaacagacaaaagcagaatcaacccttgagcgtttaaatgaacgagatttagcgattcaaaaacttcagcaacagcttaagcaggcagaattacaggaagaccaactagaacgttatattaatgaattaaaagagcggatcggttcggctcagactaaagcggaaagtttggaagaacagttacaacaaactcagttacagctacaacatcagcaagcagaaagcggtcagttacaggctaaattttcccaatcacagcaagaattaacggaattacgcacgacactttcggaaaaacaggcaaattttgaagctcaacagaagaatttcctagaagtccgccagcagttaaatgttgaatttcaacatcttgctcaacaaattctggaagaaaagagtaaatccttttctgagagtaatcagtcagcactcaatttactgctcaatccttttaaagagcagatcgaaagtttccaaaaacgtgtcaatgaggtgcatagtgaagcaataaaaggcaatgcggatttaggggctgagatcaaacgcgtgcttgagattgggctgtcaatgtcacaggaagcacaaaatctcaccacggcattaaaaggcaataataaaattgcaggaaactggggagaaattcagttagaaagtgcgttacaaacagcagggcttttggctggggaacattatattgcccaagagagttaccgagatgaagagggaaaacgctttgctcctgattttgtggtgaagttgcctgacgataagcatttgattttagacagtaaagtttccttaattgcctacgatcaagcggtacgatccgaagataattttgcaattcaacaagcacttgatgaacactgccgttcacttcgtactcacattgatggattgtctaagaaaaattatagccagttgattgggataaaaagtcctgatttcgtgttgatgtttgtaccgattgaacctgcttatattgaagcaatgaagcacgatccacagctctttaattatggctatgaacgtaatgtcattttggtttctcacacaacattaatgccgattttacgcacagtcgcaaatttatggcgaattgagcgaggtaatgcagaggcacgagagatcagtgaaaaagcaggggatatttataaccaggtttgcgtcattgcagagcgtcttgctaaattgggtaataccttgaatactgcaagcaatcaatataaccaaagtgtaacagcactggtcggtaaacagggattgctaggcaaagtcgagcgtttccaacagctttctgcaaaagcacagcaaactaccccacaagttgaattgcttgaaactgattgggatacgactcgtttacatttactggttgaaaaaccgataacacaggataatgtttaatgttgcttattattgataatcacgactcttttacttttaaccttgttgatttattacgcaaaatcggggttgaaatgcaggtggtgtcggtggaagagttagatttagacgatgtggaacgttttagtcatattatgatttcaccaggtcctgatgtaccaagagcatatccacaactatttgcaatgctagaacgttatcaccaacataagtcaattttaggggtttgtcttggacaccaaactttgtgcgaattttttggcggtgaactttacaatcttaatcaagttcgccacggacagcaacgcccattaattcagcaacaagccaacccattgtttaaaaatttaccgaagcaattcaatatcggcttataccattcttgggcaatttcgcaaaaatcattagaaaacacaccgcttgttgctactgcaacttgcgatcaaggcgtattaatggcagttaaacatcgctctcttgcgatctatggcgtgcaatttcaccctgagtcttttattacggaatacggggaacagatgttgagaaattggctggggcattaatcatacgaaaaaatttacattttctatccttttgattttcttccttttcttttgagcttatcaaagtgatttcactcactttgatttttatcaattccctttacattaaaatgcataaactactacatattgtgtttttaatggtttaaaaccacaagatatagtggttatataatgaaacagatccgttttatttcagaacagattgtgtggcaagaagtccccaatgaaacctctttagcttttctaatttcaggttgtcctttaggttgtaaaggttgccacagcatagaaagttggaaacttggaagcggtcagtttctctcagaaatttacttacaacagcgattagcgcaatatcaagggctgattagttgtgtgttgtttatggggggagaatggttgcctgaattgttattgcaacggttacagcttgttcgtcagtctggtttaaaaacttgtctttatacaggattagagcttgagcaactgccaccagagattttagcagtgttggactatgtcaaaacaggtcgctggattgctgaacttggcgggttaaattgtattaccacaaaccaacgatttattaatcttcaaacaggtgaagtgctaaatgcacattttagacaggataaacaatgattagacttgaacattcgcaattactcggcaaattaaattttatcgaccaatacattcacgctaaaaatgcggcggacgcttcaacaatagacgctaacgctaatgttacccaaaagaatttagcaacaatggaacaggaattgatgaaagatttcttcgttcagatcaatcgagccaaagtaagcggtaagattgcagagatttttggtcaatctcttgcggacgaatatctgcgacaaattgaagcacacgaaatttatgttcacgatgaaaccagcttgaagccttattgcgtatcggtaacgctttatccttttttaagagatggcttaaccaaactgggcggtgaatcccaagcaccgcaacaccttgcatctttttgtggctcttttattaaccttgtctttgcaattagctcgcaatttgcaggtgcagtggcaaccgttgagtttttgacctattttgactattttgctcgtaaggattatggtgataattatcttcaaacacatcaacacgaaattgccaaccatttacagcaagtggtgtatagcattaatcaacctgctgccgctcgtggttatcaaagtgtcttttggaacatttccatctacgaccattactattttgatgcaatgttcggcaattttgtctttcctgatctcacagtgccaaattggcaaaccacatcagcgttgcaagatttctttatgcagtggtttaatcaagagcggacaaaagcgattttaacctttccagtcgtgacagcggcaatgctgactgaaaatgacaaatgcaaagacagtgattttgccgataaaatggcaaaagccttagccgaaggaaattccttctttatttatcaatcggataatcctgattcgcttgcatcttgttgccgtttacgcaatgaaattgccgatcactctttttcttactccttaggggctggtggtgttgcaactggctcaattaatgtaattacactcaatatgaaccgtttggagcaagatggacgagatttggcgacagaagtcagcaagatccatcaatatcaatatgcttaccgaaagctaatggaagattatcttaaagcaggaatgttgcccgtttatgacgcagggtttatttcattagataagcagttcctgactattggcattaacggaatggtcgaagcggctgagtttcggggaattaaggtaggttacaattcagcgtatattgattttgtgcgtgagcgactatttgcaatttatcaagccaatcagaccgcttataaaacctacggcgtgaaatttaataccgaatttgtccctgcggaaaatttaggggtgaaaaatgcgaagtgggataaagaagcgggctatgttgtaccgagagagtgctataactcttatttctatgtggtagaagatgaacaaatcaatgcgttagataaatttctattacacggaaaagcgttggttgaataccttgatggcggttcagcattacatctgaatttagaagaagccctgagccagcaaagctaccgctcactattggacattgcggcaaaaacgggctgtaactatttttgtatcaatgtgaaaatcaccttatgtaacacctgtgaccatattgataaacgcaccctttcacaatgtagctgttgcggttctaaagacatcgatcacgcaaccagagtcattggctatttaaaacgtatttcgtcttttagttctgctcgtcaaaaagagcaggcgttaaggcattatcatcgccaagcggcataataaaaggggcgtatgcccctgatattaatgaacctttggtttttccgccattttaggtttggcgaaatggctatgtaaaaagagtgtgacgactcgcagatactcaataatttcttcgcctgagtcaagcaattcatcatttttatcttcttcactataacctaatttggcgatttcatctaaatcatcaatggcttcaccaacttcgtcagtttcttgctgcaaagtgggctgtgctaaacctaacccaagtaaaaaatgcccagtccattctgcaataccatctgccattgcaaaaccatcttcttcatttaaccataatgaaaagagtgtgttagcttcatcaaaactatcgctaagttgttgataaaattcggttaattttgcaagtggagcttgagaaaatgcgtgtccatcattggtaaattgataggttaatgttttccaagactcatcttgaataccgccagcgattaatccgcttaaaaaaccgtgaaattcagcaggggtatagtcgatatgtaactcagaaatgagttgtttaaagtcgcttgattgtgaaattgccatattagattatttgtgatttgttcaaagggtggcataatagcaaaaatttttgtgttcgtaaggatttctcaacaatgtcgaaaaataacattgaattatcgctctttggacaagtgctacgtctatattgcccaccagaacaacaagaggcgttattggcttcagccaagcggttagaagatcgagttgcagtgctaaaagagcaatctggtattattcagcttgaaaaagtgttgtcgatcgttgccttaaatctcaactatgaattagaacaagaacaacgcaaaaatgctgaaaacaaaaatgtgttaatggcgtgcgtagagcaactagatagttctcttgcaaaattccaatctagtgggatggattcggtttctgttggtcaagaaaataacgaataaagcgaatttctatgattttattgatctgaacactaggaaaaattagcaaattccgttagtattctctttgcctgaggtgtgcgttgttagttacgtccctgagccgatatttaaaacactttgagttgagctcttatattgttggtgagcaggctcgtttacgagaagcctaaaaacgataatgttcgactcccttgaaccgtctggttcaaggaccaccaccgataacggcacttcgggtctttttttatgaataatatttctccactttctataagcgaacaacgcaaccaacttcgcaagcagatgcgagccaaacgtctagccttaaccgctgatgaacaagcctttgcggcacaagatattatcccaaaatcattagcactcattgaacgctattccgctcaacatattgccttttatttgccatttaatggtgaaatctcaccgcttgcgttgatggatagacttatcaagcaaggcaaaaagatatatctgcctgtgctacaccccttttcagccaaccaactgctttttctccaatatcaaggggaaccacagctagagcgaaatcgttttgggattttacagcccaaattagatgtacgaaatgtgttgccactcaatgaattagaaatgatcttcgtcccactggttgcctgtgacacacaaggcaatcggcttggtatgggaggcggtttttacgaccgcacccttgcccaagccaagcagttaatcagcgttgggctagctcatcaatgtcagcagttggaatatttgccgttagagagttgggatgagccgttggattatgtggtggtaggaaatcaagcctaaaaccgtttttccaccgtcaaaaaccattctccattttttcttgaatagaaatcaggtatattgctttgaattttcacataactaaaattcagcttcggcattaaccctttccatgcccactgctcattccacagcgaccaattcgcccgatattcattatctacacgcttatagccgtaaaggtaatgtttcccttcaaaattgcgtttggcatagcctccgctgagttcgctgccccaatgtttccaacggtaaataacaccaagcgttcccccaattttatgggaagaagaggctttttctttagtttgctctcgattggcttcaatacttgcaaaaatttgccaagatctgaccgcttgccaacgtaatgtcaaagctccactgtttttaaaaccgtcataacggcttgcagttaaactgtcgtgataacgtttttgactatgcgttaaacgagaggaagcgatccattttggcgttaagtagcgataaccgtgtaaggttgcaccgaatagtctgctataacgtgggctacccaaccaattttgctcaataaaaggcgtaatgcctaagcccattttggcattgcgatattgatagcccaagctaaaacggagcgattgttcgctgtaatcctgattatcccagtagtaaacaccgctgtaatgaaccgaaccgttaaagtagtgattaccggttaaattatgggcttttgatacgccaataccatagcgaaaaccttctgctgattgcggtaaggaggcttgatctttgacaaattgccgtccgttgatattcaccacaggcgaagatgacgcattatttacattatcggtacgcacatattgtaggctgaaatccggttgccaactctgctcttcctccattctagccaaataacgttcagtcagctgttgcattgacgggtctaaatttgctttcgtcattgtcagctgttcagtggcttggcggtattgctgattttcgtaaagcattacccctaaatcaaaacgagggtaagccaatgtcggctgttgcgctaaaaccgcttgataatgttcaattgcctcaggataacgttgctgcccgtaataaaatgcccctaaagcataatgaacaagggttatatcgtaatgagattgttgctgataagcctgtaacaatgtcggtaaacgctgccactgttgttcgataatcgcttggtttatttgagcttcaaggctttgcggattcgccaatggcaaagaggttttaggggaagcggtcagatccgccgatttttttgcaaatttttgctcaaaaccgaccgcttgtgacaaccgttcaaagctaacaggatcagcaaaaggatttgccaaaagtatcggacttacaaataaaagaataaaaggaaattgagatgatttcataaaatgtaggtcgggcatttatgcccgacttgtgagtaaaaaaataaaaggaaattgagatggtttcataaaatgtaggtcgggcatttatgcccgacaaatggttattgattggggtgtcgggcataaatgcccgacctacagaccctatcccaaattctgtgtaaacacccatttcaacttaacggtgatcgtctaggcgatcaccaaaatcaatcatcaatcgattcatcgccggtttccggttctgaatcggcattgtccatttttttgatgcatctttaatcgcaagccaaatcactttgaaaactgaatcatccgtcgggaatacatttcgtttttaatcacgcgacgaatcacgctattgagcgattccacggcattcgtggtataaatcgctttacgaatgtcagccggataatcaaaaaatgtggcaatatttgcccagttatcttcccagcctttcgccacaagcgggtattttgcctgccatttttgcgaaagtgcggtcagattttcgcgagcctgtgcttccgtcgaggcctgataaacctgctttaaatctgcggtgacggctttgtaatctttccacgaaacgaatttcaaagctgttacgcactaaatgcacaatgcaaagctgaatcttcgttttaggatagactgcattgatggcttctgggaagccttttaaaccgtctacacaggcaataaaaatgtcttttaagcctcgattttgaagctctgtcagcacatttgcccagaacttcgcaccttcattttcagcaatccaatcacggtcacgaggcgtctcaatttctatctcaccttcatcacaaatgacggtcttagatgtgtaaccgttacgtgcatttttaccttttctaggctgatgtttttcataaccaagatggtcggtcagttcaccatttaacgcagcctcgacggtgattttcttgagcatccgtgaaaattgattgaggtcttctggtgtttttaggtttttggcaaattccgctgccaaggcgtgaagttgtttttcgttcataataaaatacctgtgtctgaatgtattatctcagaaacaggtatttacacaaattgtgggagaggctcatttattgaaatttaattatatttccattcattgatgatagttttatactttcaataacctctattgattctattgccgtttttatatttgatacaggttgttttcctgtttcaataccttcaattagacttaaaatggcatctatcattctttcatttggagtagtattgtgttttgaatagactaaatctaaatgttcatacttgctacctgatgaattttcactacttgaaaatttatataaatcataagatgatccattgttgtataatcttattcgcccattttcgccaagtatgtctaattcaaacatatatttcattggggaagaactagtacctttaatgaacccaatagaattagacttaaactttatcattcctgttcctccgacatcagaaataccgtgaacatttctcacaaaatctttttgaatatctccaacaacatattcaatatctgaaccagaaaaataaagcaataaatctattaaatggcttgtactcgtatgtaaagcagttgcaccataaccaactaaagaataaatattccctatagcatttgaatctaatagtcccttgatttcttgaataagattatcccaacgaaaaatgtaattaacagcgataataacattatgcttatcgcataactcaactatttccttagattcttctagagaataagaaatagtcttttcacagaaaatcactttaactccattcttaatacactctttgatgatatcaaaatgtgtttgaataggtgtacatatactgacaatatcaaatttattagatttcagcatttctttataatctgtatatccatttggtatatcacattctttttggatagaatctaccaaagatttcttaacatcacatactgatgatattcgtatattttcaatacttttatatgctttaatatgactccatatgatttttctgtttggatctttatctataccataagcaatcaagcctaatcctataacacccacattatacatattaatctccatgggattttttcctcaatgaaataacacatcctacaataacgattgcagcaccaaaaccttgataaatagaaatagtttcacctaaagtaaagtaaccaataaacgcagtagataagggaactgttaattgaataatattgaaaacaactaccccttgtttttgaacaatataaaatgcaaataacatacctgttagcactccatacattccagcaaagattaatccgatcagcaagcctgaactaatatcttgtaattgataaataacacctgtattacttgctaaaagtagataaacaagtccagataaagtagcagtggatgcactgataacgatggcatttaatttttttgcgacctttttaacgaaaaggttttgaatagattgaataaatatagctgtccccaaaaagagtgaccctgttataaaatcattacccccaccagttttgttgctataaattacaaatatcaaagaaccaattacagataagacgctaccaatataaaagctcttttgttttactttttccctttcatcttgaaagaaaattgcggccataataacagctaaaggcatagacataatgccaaaaatactgcctgctaaagctgaagtatatttaagaccattaataaaaaaatacatattaccagtcataaaaatagctaacaaaagaagatataagatgattgaaggttctctgagcaacttaagtagttctgttctatattttaatatacaaataaaaacgaataacaacccaccagagagaaatcgaacagcattattatttaaagtatcaaaatgaatactcatataacgcataataggaaaaccaaaacccattaacaaaacataagaaaatcttataaaagaatcattacccatacgactaagccccatacctaaaaggtaagtaagattaggtaattataaaatatttgtattgtttctcatagaaaaagagcatagattttgacatctatgcccttttcctataatctgtttcgtgcgttctttgctaagataacactaagataacagaccctagagaagtcatatcttagcaaagggtagctagtaatgcgaccctatcccaaattctgtgtaaacacccatttcaacttaacggtgatcgtctaggcgatcaccaaaatcaatcataaatcgattcatcgccagtttccagttctgaatcggcattgtccattttttgatgcatctttaatcgcaagccaaatcactttgaaaactgaatcatccgtcgggaatacatttcgttttttaatcacgcgacgaatcacgctattaagcgattccacggcattcgtggtataaatcgctttacgaatgtcagccggataatcaaaaaatgtggcaatatttgcccagttatcttcccagcctttcgccacaagcgggtattttgcctgccatttttgcgaaagtgcggtcagattttcgcgagcttgtgcttccgtcggggcctgataaacctgctttaaatctgcggtgacggctttgtaatctttccacgaaacgaatttcaagctgttacgcactaaatgcacaatgcaaagctgaaactacgatacaatctaggtaaacaattggataaaccgcatcaagtgggcgattttgccattccattacgcgttctttcacggcgtcggtaacgcgagaaatcaggctgcttgacacatccgcatcatagagttctttgaacatttcaacgatttcctgattacttaaccctttggaatataaggcaataatctgctcatccattcctgtgatgcgggtttgatttttcttgataagttgcggttcaaaggtgccgtcacggtcacgaggcgtctcaatttctatctcaccttcatcacaaatgacggtcttagatgtgtaaccgttacgtgcatttttaccttttctaggctgatg
